US012678493B2

(12) United States Patent
Chen et al.

(10) Patent No.: US 12,678,493 B2
(45) Date of Patent: Jul. 14, 2026

(54) COMPOSITIONS AND METHODS FOR MULTIPLEXED TUMOR VACCINATION WITH ENDOGENOUS GENE ACTIVATION

(71) Applicant: YALE UNIVERSITY, New Haven, CT (US)

(72) Inventors: Sidi Chen, Milford, CT (US); Ryan D. Chow, San Jose, CA (US); Guangchuan Wang, New Haven, CT (US)

(73) Assignee: Yale University, New Haven, CT (US)

( * ) Notice: Subject to any disclaimer, the term of this patent is extended or adjusted under 35 U.S.C. 154(b) by 1214 days.

(21) Appl. No.: 17/048,021

(22) PCT Filed: Apr. 17, 2019

(86) PCT No.: PCT/US2019/027956
§ 371 (c)(1),
(2) Date: Oct. 15, 2020

(87) PCT Pub. No.: WO2019/204503
PCT Pub. Date: Oct. 24, 2019

(65) Prior Publication Data
US 2021/0113674 A1     Apr. 22, 2021

Related U.S. Application Data

(60) Provisional application No. 62/743,990, filed on Oct. 10, 2018, provisional application No. 62/659,543, filed on Apr. 18, 2018.

(51) Int. Cl.
| | |
|---|---|
| *A61K 39/00* | (2006.01) |
| *A61K 39/395* | (2006.01) |
| *A61P 35/00* | (2006.01) |
| *C07K 16/28* | (2006.01) |
| *C12N 9/22* | (2006.01) |
| *C12N 15/11* | (2006.01) |
| *C12N 15/86* | (2006.01) |

(52) U.S. Cl.
CPC ...... *A61K 39/0011* (2013.01); *A61K 39/3955* (2013.01); *A61P 35/00* (2018.01); *C07K 16/2818* (2013.01); *C12N 9/22* (2013.01); *C12N 15/11* (2013.01); *C12N 15/86* (2013.01); *A61K 2039/5152* (2013.01); *A61K 2039/53* (2013.01); *A61K 2039/545* (2013.01); *C12N 2310/20* (2017.05); *C12N 2750/14134* (2013.01); *C12N 2750/14143* (2013.01); *C12N 2800/80* (2013.01)

(58) Field of Classification Search
CPC . A61K 39/00; A61K 39/0011; C12N 2310/20
See application file for complete search history.

(56) References Cited

U.S. PATENT DOCUMENTS

2017/0204407 A1*     7/2017   Gilbert ............... C12N 15/1082

FOREIGN PATENT DOCUMENTS

| | | |
|---|---|---|
| WO | 2016/011080 A2 | 1/2016 |
| WO | WO-2016164356 A1 * | 10/2016   ......... A61K 31/7105 |
| WO | 2017/004153 A1 | 1/2017 |
| WO | 2017/07545 A1 | 5/2017 |
| WO | 2017/083722 A1 | 5/2017 |
| WO | 2017/152015 A1 | 9/2017 |
| WO | 2017/192924 A1 | 11/2017 |
| WO | 2018/161009 A1 | 9/2018 |

OTHER PUBLICATIONS

Gilbert et al. Genome-scale CRISPR-mediated control of gene repression and activation. Cell 2014, 159:647-661. (Year: 2014).*
Ravindranath et al. Immunogenicity of membrane-bound gangliosides in viable whole-cell vaccines. Cancer Investigation 1997, 15; 5:491-499. (Year: 1997).*
Lorenz et al. Anti-Tumor Immunity Elicited by a Recombinant Vaccinia Virus Expressing CD70 (CD27L). Human Gene Therapy 1999, 10:1095-1103. (Year: 1999).*
Fu et al. High-frequency off-target mutagenesis induced by CRISPR-Cas nucleases in human cells. Nature Biotechnology 2013, 31; 9:822-827. (Year: 2013).*
Wu et al. Target specificity of the CRISPR-Cas9 system. Quantitative Biology 2014, 2;2:59-70. (Year: 2014).*
Alejandro Chavez et al: "Comparison of Cas9 activators in multiple species", Nature Methods, vol. 13, No. 7, May 23, 2016 (May 23, 2016), pp. 563-567.
Supplementary information, May 23, 2016, for Alejandro Chavez et al.: "Comparison of Cas9 activators in multiple species", Nature Methods, May 23, 2016.
Chow, R.D. et al. "AAV-mediated direct in vivo CRISPR screen identifies functional suppressors in glioblastoma," Nature Neuroscience, Aug. 14, 2017 (Aug. 14, 2017), vol. 20, pp. 1329-1341.
De Charette, Marie et al: "Turning tumour cells into antigen presenting cells: The next step to improve cancer immunotherapy?", European Journal of Cancer, Elsevier, Amsterdam NL, vol. 68, Oct. 15, 2016 (Oct. 15, 2016), pp. 134-147.
Extended European Search Report issued Jan. 19, 2022 for European patent application No. 19788924.9.
Giovanni Germano et al: "Inactivation of DNA repair triggers neoantigen generation and impairs tumour growth", Nature, vol. 552, No. 7683, Nov. 9, 2017 (Nov. 9, 2017), pp. 116-120.

(Continued)

*Primary Examiner* — Christopher M Babic
*Assistant Examiner* — Jennifer S Spence
(74) *Attorney, Agent, or Firm* — Saul Ewing LLP; Kathryn Doyle; Peter Brunovskis

(57) ABSTRACT

The present invention includes compositions and methods for treating or preventing cancer. Embodiments include cell-based and viral vector-based vaccines that utilize gene expression activation systems to augment the product of endogenous genes to treat or prevent cancer.

7 Claims, 98 Drawing Sheets

Specification includes a Sequence Listing.

(56)                References Cited

OTHER PUBLICATIONS

Hisin-Kai Liao et al: "In Vivo Target Gene Activation via CRISPR/Cas9-Mediated Trans-epigenetic Modulation", Cell, vol. 171, No. 7, Dec. 14.

International Search Report and Written Opinion issued Aug. 29, 2019 for Intl. Appl. No. PCT/US2019/027956.

Luke A. Gilbert et al: "Genome-Scale CRISPR-Mediated Control of Gene Repression and Activation" , Cell, vol. 159, No. 3, Oct. 23, 2014 (Oct. 23, 2014), pp. 647-661.

Martin Kampmann: "CRISPRi and CRISPRa Screens in Mammalian Cells for Precision Biology and Medicine", ACS Chemical Biology, vol. 13, No. 2, Oct. 16, 2017, pp. 404-416.

Sau, S. et al., "Multifunctional Nanoparticles for Cancer Immunotherapy: A Groundbreaking Approach for Reprogramming Malfunctioned Tumor Environment," Journal of Controlled Release, Jan. 31, 2018 (Jan. 31, 2018), vol. 274, pp. 24-34.

Siebenkas Cornelia et al: "Inhibiting DNA methylation activates cancer testis antigens and expression of the antigen processing and presentation machinery in colon and ovarian cancer cells", PLOS One, vol. 12, No. 6, Jun. 16, 2017.

Wang Guangchuan et al: "Multiplexed activation of endogenous genes by CRISPRa elicits potent antitumor immunity", Nature Immulogy, Nature Publishing Group US, New York, vol. 20, No. 11, Oct. 14, 2019 (Oct. 14, 2019), pp. 1494-1505.

Zhuting Hu et al: "Towards personalized, tumour-specific, therapeutic vaccines for cancer", Nature Reviews Immunology, vol. 18, No. 3, Dec. 11, 2017 (Dec. 11, 2017), pp. 168-182.

Qi, Lei S. et al., "Repurposing CRISPR as an RNA-Guided Platform for SequenceSpecific Control of Gene Expression," Cell, 152(5): 1173-1183 (Feb. 2013).

Gilbert, Luke A. et al., "CRISPR-mediated modular RNA-guided regulation of transcription in eukaryotes," Cell, 154(2):442-51 (Jul. 2013).

Konermann, Silvana et al., "Genome-scale transcriptional activation by an engineered CRISPR-Cas9 complex," Nature, 517(7536):583-8 (Jan. 2015).

Chavez, Alejandro et al., "Highly efficient Cas9-mediated transcriptional programming," Nat Methods, 12(4):326-8 (Apr. 2015).

Tanenbaum, Marvin E. et al., "A protein-tagging system for signal amplification in gene expression and fluorescence imaging," Cell, 159(3):635-46 (Oct. 2014).

* cited by examiner

Day 0
Cancer cells
allograft

Day 4
CAVac
administration

Day 7
administration of
monoclonal antibodies (i.p.)

Day 10
CAVac
administration

Day 13 or 14
administration of
monoclonal antibodies (i.p.)

Day 18
CAVac
administration

Sample harvest for
molecular, cellular and
phenotypic profiling

E0771/B6 + PBS

E0771/B6 + AAV-PCAVac

E0771 on C57BL/6J

Spiders: E0771 on C57BL/6J

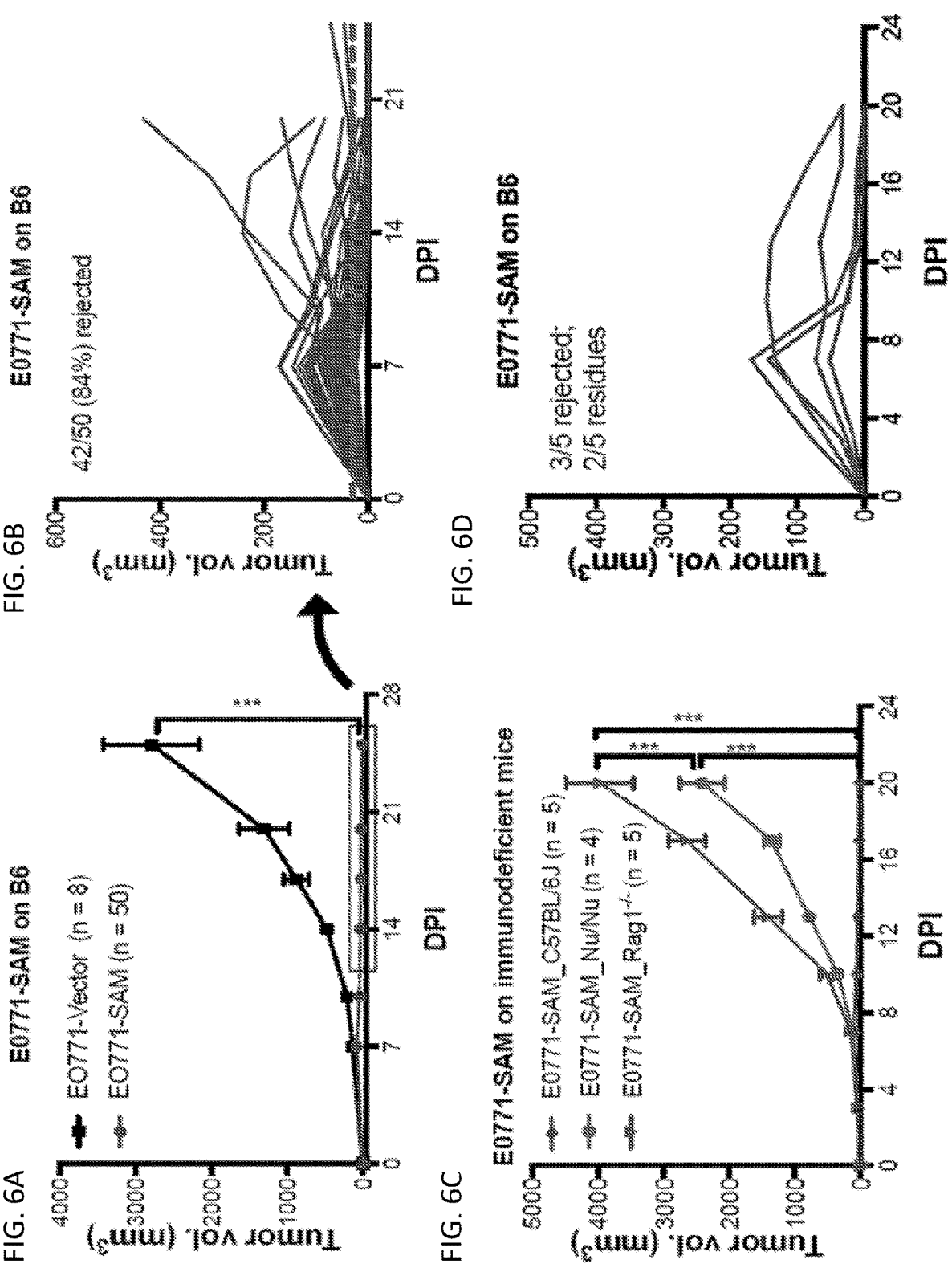

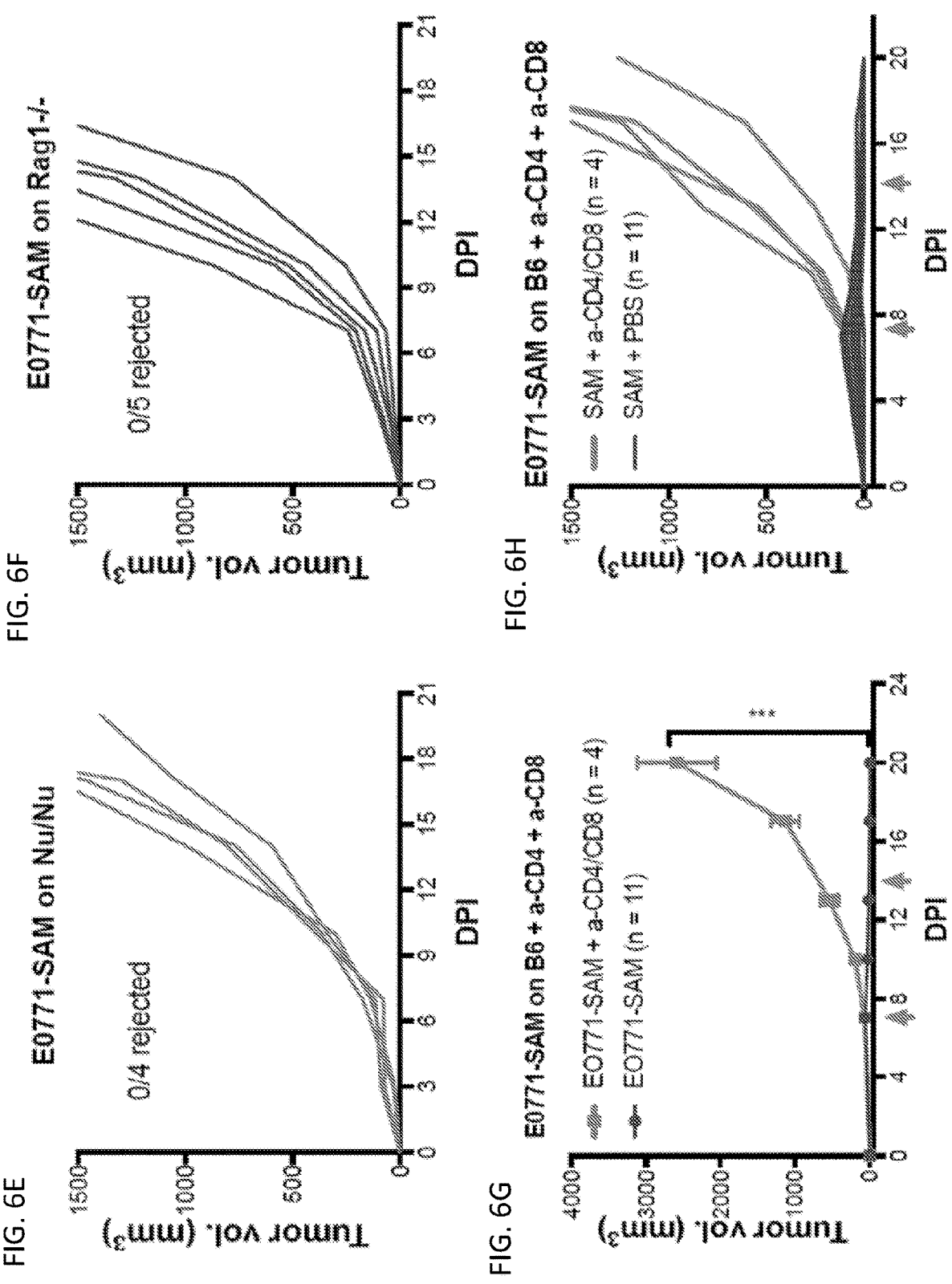

E0771 + Cell-based CAVac

E0771 + PBS

E0771 + CAVac in combinations

E0771 + PBS in combinations

FIG. 10A   Gene activation by AAV-CRISPRa

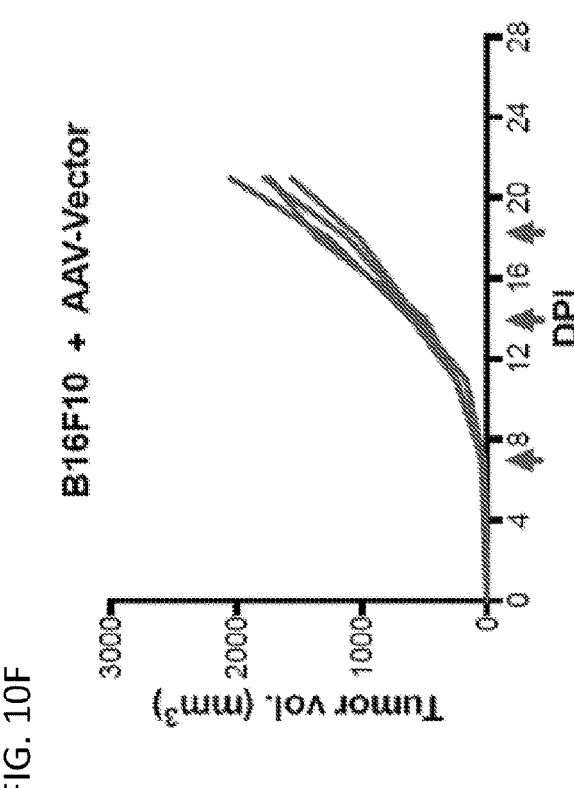
FIG. 10F
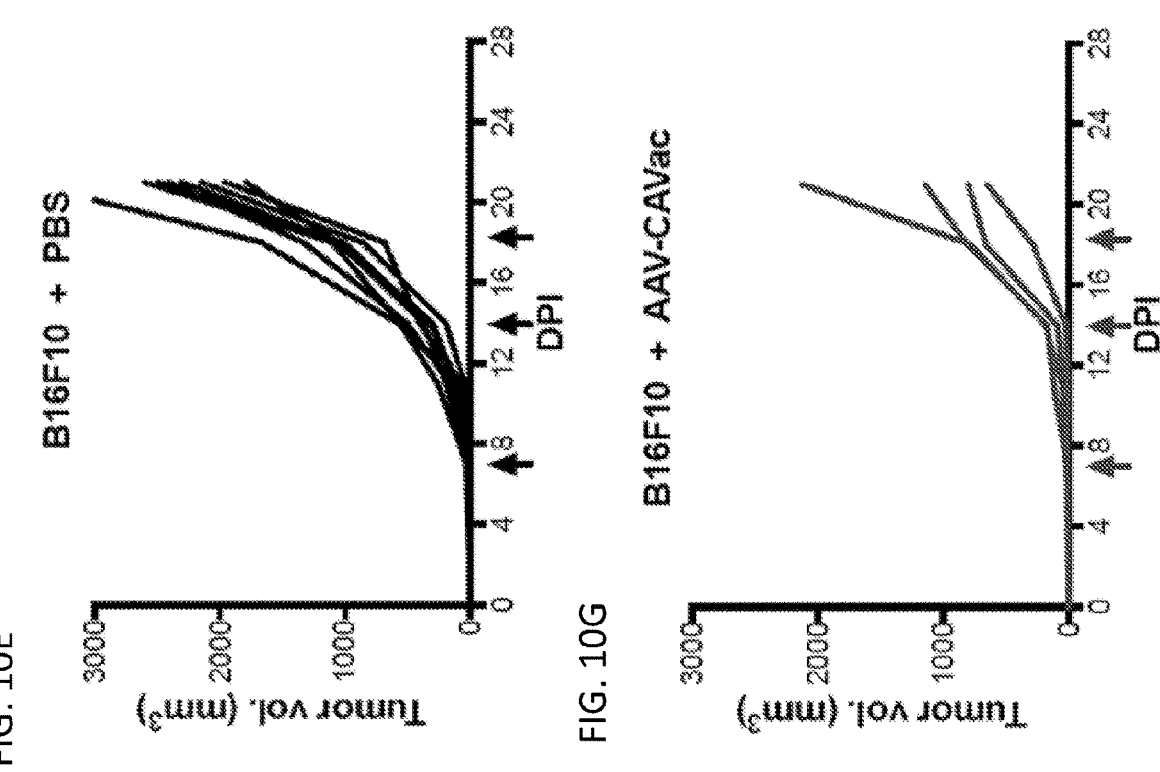
FIG. 10E
FIG. 10G

CAVac

| Sample | CDR3 | V | J | Frequency |
|---|---|---|---|---|
| TILs_15 | CASSSTGVQDTQYF | TRBV16 | TRBJ2-5 | 14.78% |
|  | CASSLGGLMTGQLYF | TRBV29 | TRBJ2-2 | 8.50% |
|  | CAWSQGASYNSPLYF | TRBV31 | TRBJ1-6 | 8.36% |
| TILs_16 | CASSPTGVQDTQYF | TRBV16 | TRBJ2-5 | 19.94% |
|  | CASSSEGVQNTLYF | TRBV16 | TRBJ2-4 | 3.18% |
|  | CASSFWGASSYEQYF | TRBV14 | TRBJ2-7 | 2.82% |
| TILs_17 | CASSTGGAQDTQYF | TRBV15 | TRBJ2-5 | 8.79% |
|  | CASSRTGVQDTQYF | TRBV16 | TRBJ2-5 | 8.78% |
|  | CASSDGGQ_NNSPLYF | TRBV13-3 | TRBJ1-6 | 3.79% |

AAV-CAVac

| Sample | CDR3 | V | J | Frequency |
|---|---|---|---|---|
| TILs_21 | CASSPDI_QDTQYF | TRBV24 | TRBJ2-5 | 20.69% |
|  | CAWSLQISNERLFF | TRBV31 | TRBJ1-4 | 13.44% |
|  | CASSIDDSGNTLYF | TRBV19 | TRBJ1-3 | 12.93% |
| TILs_20 | CAWSLVSNERLFF | TRBV31 | TRBJ1-4 | 10.78% |
|  | CASSLIDSGNTLYF | TRBV16 | TRBJ1-3 | 8.81% |
|  | CASGRNQDTQYF | TRBV13-2 | TRBJ2-5 | 4.91% |
| TILs_38 | CASGERTFNNQAPLF | TRBV13-2 | TRBJ1-5 | 1.42% |
|  | CASSFWGRGTEVFF | TRBV14 | TRBJ1-1 | 1.24% |
|  | CASSFWGRGAETLYF | TRBV14 | TRBJ2-3 | 0.97% |

FIG. 12E

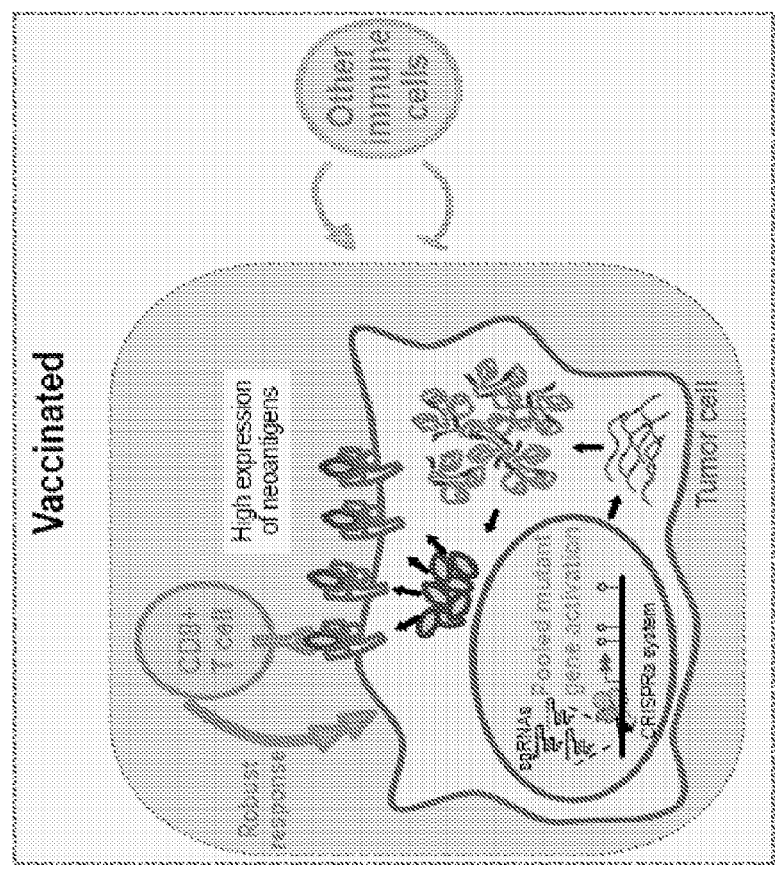
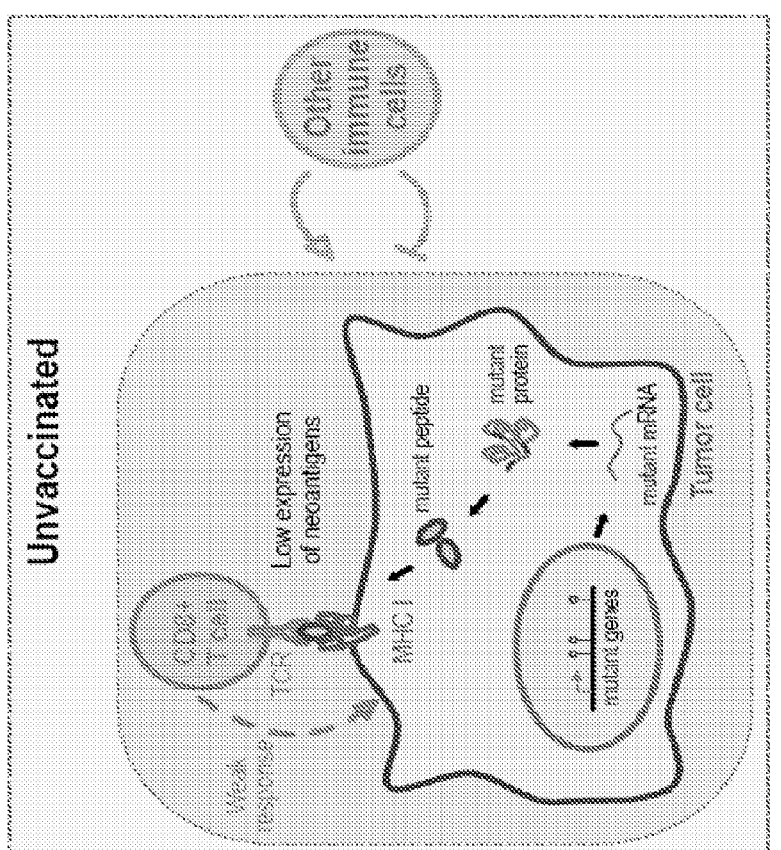
FIG. 14

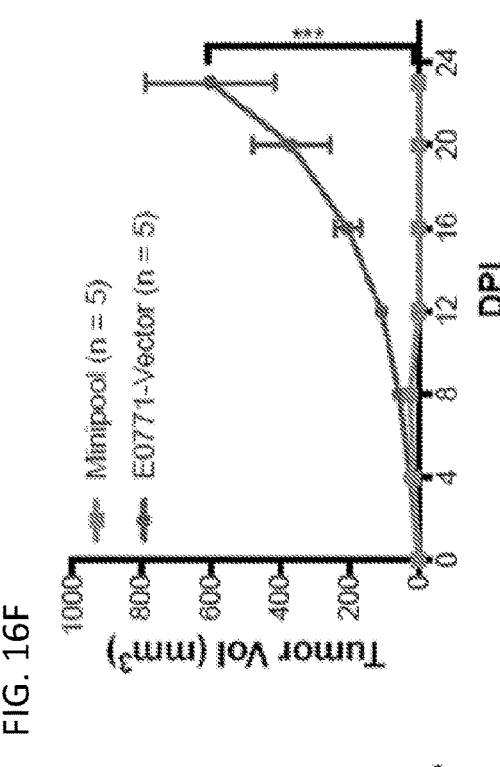
FIG. 16E
FIG. 16F
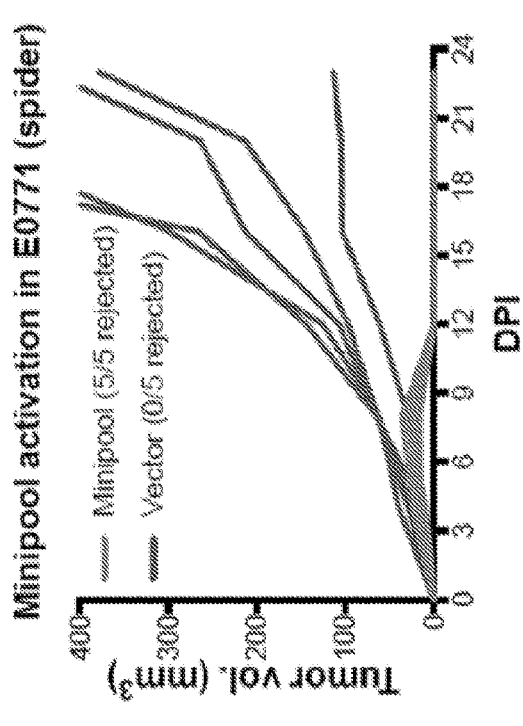
FIG. 16G

FIG. 17A
FIG. 17B
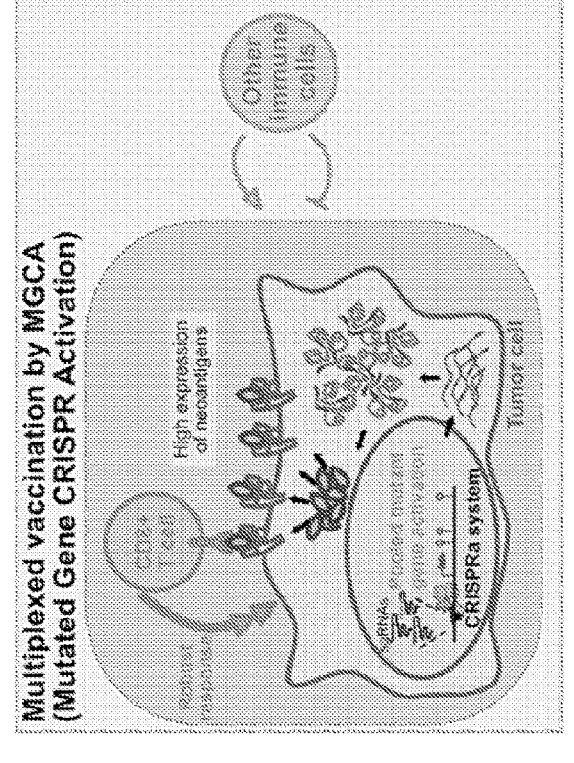
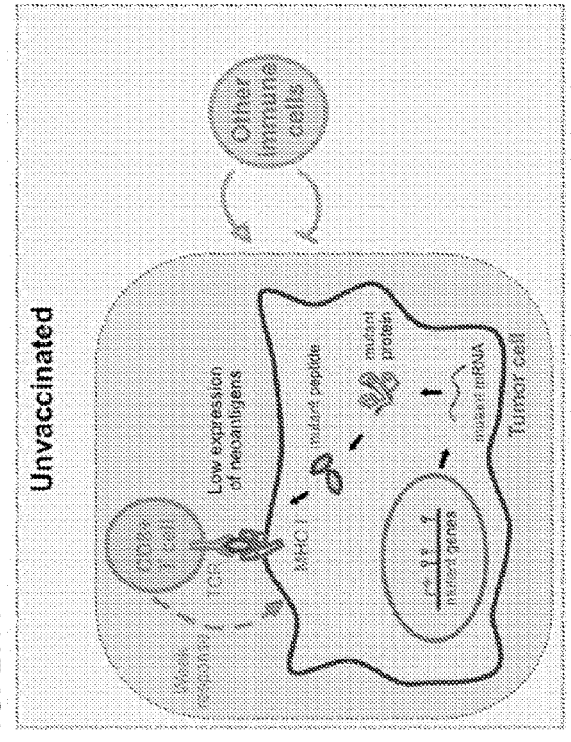
FIG. 17C

| Category | PBS | AAV-Vector | AAV-PCAVac |
|---|---|---|---|
| N | 21 | 11 | 15 |
| PD (>1.3) | 100% | 82% | 33% |
| SD (0.7~1.3) | 0% | 18% | 20% |
| PR (<0.7) | 0% | 0% | 20% |
| CR (=0) | 0% | 0% | 33% |
| CR+near-CR (residue) | 0% | 0% | 47% |
| Severe TRAE | 0% | 0% | 0% |

FIG. 19

| TNBC model, two-side tumor induction Treatment on one side ( n >=8) | PBS | AAV-Vector | AAV-PCAVac |
|---|---|---|---|
| Regression of primary tumor | 0% | 33% | 66.70% |
| Regression of distant tumor | 0% | 25% | 62.50% |

FIG. 20

| TNBC model, rechallenge after cure ( n = 5) | AAV-PCAVac |
|---|---|
| Growth of re-challenged tumor | 0% |

FIG. 21

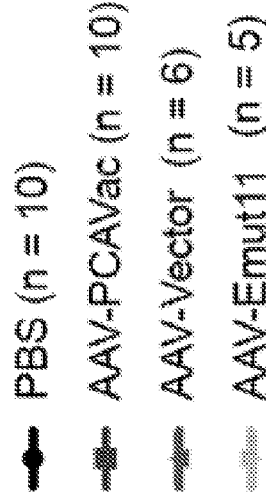
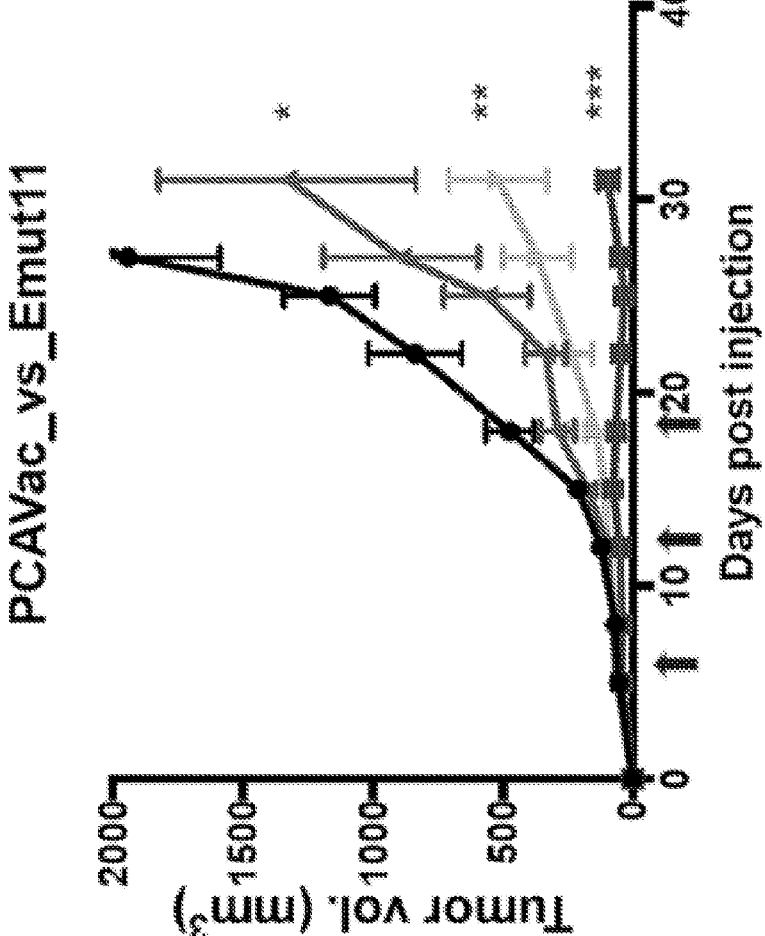
FIG. 22

| Gene | gRNA target sequence | SEQ ID NO: | Gene | gRNA target sequence | SEQ ID NO: |
|---|---|---|---|---|---|
| CD70 | GCTTCAGTTTGTCTGTGGGA | 23779 | TNFSF9 (4-1BBL) | CCCTCCCTCCCTTCCCTCCC | 23832 |
| | ATTCACTGAGCATCTATTAG | 23780 | | ACAGGGCCTGGACAGGGAAG | 23833 |
| | ATCAGGAAGCATCCGCATCC | 23781 | | AGAAAGTTCCGGGAGTCGAG | 23834 |
| CD80 | GAGAGTTCTGAATCAGGGTG | 23782 | TL1A (TNFSF15) | CAGAGGGCTGTCAGAGGGAG | 23835 |
| | TCCAGGCCTGTTCTGAGCAC | 23783 | | AACTTGGTTTCTGTTGTAGG | 23836 |
| | GGACCTTTGAGTTGCCCTCA | 23784 | | ATTCCCTAGCCGGGCAGGGC | 23837 |
| CD83 | CCAAGTCCGCGTTGCTGCTG | 23785 | CD30L(TNFSF8) | AATTGTAGCGAGATAGACGA | 23838 |
| | ATCTGCATGACCCACTCGAT | 23786 | | GTGGTTGGTGTACACTCACG | 23839 |
| | GTTTGAGGGTCATCTAGCTG | 23787 | | CGTTCTGTGGCTGAGCCTAA | 23840 |
| CD86 | GCAGGCAGGAGTGGGTGGGT | 23788 | TAP1 | TGCAGGCAACTTGCAGACTG | 23841 |
| | CTTTGTAGATTATTCGAGTT | 23789 | | TTCACGCAAGCAAGTTAAGG | 23842 |
| | GAGTTCGGTTTCAGTCTTGA | 23790 | | CGTGCCGTTCTACCAGCATT | 23843 |
| IFNa4 | AAAGAGAATTGGAAAGCAAG | 23791 | B2M | ACGACCTCCGGATCTGAGTC | 23844 |
| | TGTGTACATCTCTCTTAAAT | 23792 | | CCGTGATATTTCAAACAGCC | 23845 |
| | CAGGCTCTCAGAGAACCTGT | 23793 | | AGCATCAACAGCTAGGAGAC | 23846 |
| IFNb1 | GAAATTCCTCTGAGGCAGAA | 23794 | Tapasin | GCGGAGTCTAGGCTGATAAA | 23847 |
| | CCTGTGCTATTTATAAGGGA | 23795 | | GGTCTGGGAACGCGGGAGTG | 23848 |
| | GTGAGAATGATCTTCCTTCA | 23796 | | TATTTATTGGTCACTTCACT | 23849 |
| IFNg | AGAGTTTCCTTTCGACTCCT | 23797 | TAPBPR | CTCCAGCCCTCTCATAGTTG | 23850 |
| | TTAAGATGGTGACAGATAGG | 23798 | | AGGATTTAACATGGACTGAA | 23851 |
| | ATACCTGATCGAAGGCTCCT | 23799 | | CTGTGATCGAACAGACGAGA | 23852 |
| CXCL9 | AAACCCTACTCTCAGATCCC | 23800 | ERp57(PDIA3) | GCAGTGTGGCAGCCGCCGAT | 23853 |
| | TAGTTCTTCTACGGTCAGCTG | 23801 | | AACAGCTGGTAACTGCCGAT | 23854 |
| | TAACCACAAATTGATCGTCC | 23802 | | CTGCGTCACGCACGCGTCGGG | 23855 |
| CXCL10 | ACTTTGGAGATGACTCAGCA | 23803 | Calreticulin | GGTCGCACTATGGGCCAATG | 23856 |
| | TTTATTGTGACCCATGAACT | 23804 | | GTAGGTCTAAACCAGTCAAA | 23857 |
| | GCAATGCCCTCGGTTTACAG | 23805 | | GGGTCGACCACGCGTTGTGG | 23858 |
| IL-2 | TTTCAAAGAGTCTACCTGTG | 23806 | ERAP1 | TGATAGGGAATGCATTCTCC | 23859 |
| | GCAATTTATACTGTTAATGC | 23807 | | ACTTTGAGTTCCCGAAGCCC | 23860 |
| | TCCATTCAGTCAGTGTATGG | 23808 | | CAAGCCTAAGGGATCTAGCC | 23861 |
| CXCL3 | CACACTCATCAAGAGCCCGG | 23809 | NLRC5/CITA | AGCTGGCCGTGCAGAGAGGA | 23862 |
| | GTGGGCAAGAAGCGAAGGAA | 23810 | | TCATCTGGGAGATGAGCCTC | 23863 |
| | AGAGGACACACGTGTGCTAC | 23811 | | TTCGGTTGGCATTCGGCTAA | 23864 |
| CCL5 | AGGCAGAGTCATACTTCCAA | 23812 | TAP2 | GGGTCTGAGATGCTTTGAAA | 23865 |
| | CTACCCTGGCTCCCTATAAA | 23813 | | GGCGCCTGTCAATTTGCGGG | 23866 |
| | TTATGACAGCAACAAGTGTT | 23814 | | TTGCTAGTAGCGGCCTTGGA | 23867 |
| CD40L | TGGTGTCTTCTGACCAAGAA | 23815 | Cystatin C (x) | CTAGTCTGTTCTTGCCTTGT | 23868 |
| | TCGTCGCAACCCACACTTCC | 23816 | | GGGAGGGTGGCCGCCGGAAA | 23869 |
| | TTAACTAATCCTGAGTAAGG | 23817 | | GAATCTGGCAGCTCTTTAAG | 23870 |
| OX40L/TNFSF4 | AAGTCACTCAATTCATAACT | 23818 | Cystatin B | GGACGCTAAGAAGGGTTTGG | 23871 |
| | CAACTCCCTGTTAGCCCGGA | 23819 | | CTGTCACCACCCTCCGTTCC | 23872 |
| GITRL(TNFSF18) | AGTGCTTAGCAGTGTTCCAA | 23820 | | CTTCACGTCCTTTCCCTGAA | 23873 |
| | GCACCAGGCCAAACATACAA | 23821 | Calnexin | TGGGAAGGCGCTTCGAGCGA | 23874 |
| | CACTACAAGGGAAGTTCAGA | 23822 | | TTCTTAGATCTTGCGCAAAG | 23875 |
| Flt3L | CGCCACCTAGTGGTAACAAG | 23823 | | CCACGAAGAATAGCCCTAGG | 23876 |
| | GGGCCCTGAAAGGATAGCGA | 23824 | Sec61a1 | AGCGGCCGGTGGCCCATCCC | 23877 |
| | TTCTACATACACTTCGAAGC | 23825 | | GCTGTCGGGAAGACGACTGT | 23878 |
| LIGHT (TNFRSF14) | TGTGACTCAGGTGGGATGGA | 23826 | | GCACACGCCCAGTTCCGGTG | 23879 |
| | GAGGAGGTACGTGAGGGAAAG | 23827 | Sec61b | TCGCAGACTCTTGGATGACT | 23880 |
| | CAGTGAGAGTGATCGACCGG | 23828 | | AATCTTTACAGGCATATCTC | 23881 |
| B7-H2 (ICOSL) | GAGACTTGGGCATGAGTTAC | 23829 | | TCACACGGCCCAGTTGTTGT | 23882 |
| | AACCCAATCGGCTGCTGAGC | 23830 | Sec61g | GTACATCTAATTCCTCATTG | 23883 |
| | CCGCCTGTGCCCAATTAGCC | 23831 | | TTCAAACTATTCTCCATTCC | 23884 |
| | | | | GACTTTCTGCTTATTATTCA | 23885 |

FIG. 27

| Gene Name | Guide Sequence | SEQ ID NO: | Gene Name | Guide Sequence | SEQ ID NO: |
|---|---|---|---|---|---|
| TNFRSF14 | CCCACCTCACTCACACACTC | 23886 | CD86 | AGAGAAACAACACCACAGCC | 23995 |
| TNFRSF14 | GGGACCCTCGGCTGCTCCCC | 23887 | CD86 | CTTTGTCATGTTTGTGGATG | 23996 |
| TNFRSF14 | GAGAACTCGCCCCTCCCATC | 23888 | CD86 | CCAAGCAAGAGCACTGTCCC | 23997 |
| TNFRSF14 | TCCCCCTTCTACAGGAAACC | 23889 | CD86 | TCCAAATAACTTCTGCCGGC | 23998 |
| TNFRSF14 | GTGGACTGGAATGGTGCAGG | 23890 | CD86 | TTTGTAGTCATTCTCATCAG | 23999 |
| TNFRSF14 | ACCCACAGGGCCCCTTTATT | 23891 | CD86 | GCTTTACACTCATGCTCCGA | 24000 |
| TNFRSF14 | AAACACAGATGGACTTTGGG | 23892 | SEC61A1 | CCCGGCGGGCCCCGCGCGCC | 24001 |
| TNFRSF14 | AAAAATGTCAGTCAGCGCCC | 23893 | SEC61A1 | GCGCGGCGAAGCGCGGCGGC | 24002 |
| TNFSF18 | TTTATGTTCTGAGTTTGTGT | 23894 | SEC61A1 | GCCCCTTCCCGACAGGCCCC | 24003 |
| TNFSF18 | AAAGCACAAGGGAAGTTCAG | 23895 | SEC61A1 | CCGGCATGCAGCGGGGCTCC | 24004 |
| TNFSF18 | TTTTCTAACACAGTGACAGA | 23896 | SEC61A1 | GAGGTCTCGGCGAAGCGGCG | 24005 |
| TNFSF18 | CTTAAGTGCTGACTCTCATT | 23897 | SEC61A1 | GGTGTGCGGCTGCGCAGACT | 24006 |
| TNFSF18 | ACCAGATCAAATACAACAAA | 23898 | SEC61A1 | TAACGCGAGAGCGCGCGGGG | 24007 |
| TNFSF18 | AGCAATATGGTAATTAGTAG | 23899 | CXCL3 | GAAGGCGACGGCCCCGCCCC | 24008 |
| TNFSF4 | TTTTTTTCCTCTGGGCTAAC | 23900 | CXCL3 | CCCGTATCCGACTCCACCCC | 24009 |
| TNFSF4 | ACAGTCACTCAAATCAGAAC | 23901 | CXCL3 | GGTGGACTCACTGCCTCTCC | 24010 |
| TNFSF4 | TTTAACGCTGCAACTTTTGC | 23902 | CXCL3 | CATTTTCTGCCCCAAATTCC | 24011 |
| IFNG | AGAGTTTCCTTTAGACTCCT | 23903 | CXCL3 | TGCACGGGGGTTACTCTGGA | 24012 |
| IFNG | TAAATACCAGCAGCCAGAGG | 23904 | CXCL3 | GAGGCGTAGGCGTCACCAGT | 24013 |
| IFNG | ATCCTCAGGAGACTTCAATT | 23905 | CXCL3 | AGATCGATCCGGAGTCCCGA | 24014 |
| IFNG | AACTAAGGTTTTGTGGCATT | 23906 | CXCL9 | TGTTCTCTAAAGAATTTCTC | 24015 |
| IFNG | AAGATGAGATGGTGACAGAT | 23907 | CXCL9 | GACCACAAACTTGATTGTGC | 24016 |
| PDIA3 | CGGAGCGCGGGGCGGGGCCG | 23908 | CXCL9 | AAACCCTAGTCTCAGATCCA | 24017 |
| PDIA3 | GCTGTGTGGCAGCCGCTGAT | 23909 | CXCL9 | TTTCTCTCCTAAACTCTGAT | 24018 |
| PDIA3 | CAGGGGCTAGGGCCGGGTCC | 23910 | CXCL10 | TCCCTCTGCTCCTCTTTTTT | 24019 |
| PDIA3 | CCCAGGTTTCGGCTCACCCC | 23911 | CXCL10 | CTGCAACATGGGACTTCCCC | 24020 |
| PDIA3 | GGCTGCGCGTCGCCTTCGTC | 23912 | CXCL10 | TTATTGTAGCCTCCAAGTTA | 24021 |
| PDIA3 | GGCGAGTGTCTGGGCGAGCG | 23913 | CXCL10 | GTTGACTTAGCAAAACCTGC | 24022 |
| PDIA3 | GGCTGGGCCCGGTCCTGGGC | 23914 | ERAP1 | TCGGTCCCCAACTTGAGCAC | 24023 |
| PDIA3 | ACCAACTCGTTACCGCCGAG | 23915 | ERAP1 | GGGTTAGGGGCATGCAGGAA | 24024 |
| B2M | AAGAAAAGGAAACTGAAAAC | 23916 | ERAP1 | TGGACTTGTCAGCGCCTGCC | 24025 |
| B2M | AGACAGGTGACGGTCCCTGC | 23917 | ERAP1 | TTTCACTGTTTAGCGTTGCG | 24026 |
| B2M | GTGCCCAGCCAATCAGGACA | 23918 | ERAP1 | TTTCTCTCACACTAAAAGAA | 24027 |
| B2M | GAAAGTCCCTCTCTCTAACC | 23919 | ERAP1 | CTGGAACAATGATGTGAGCT | 24028 |
| B2M | CAAGCCAGCGACGCAGTGCC | 23920 | ERAP1 | TTCCGTTCCTCATTGACTAT | 24029 |
| B2M | GAGTCTCGTGATGTTTAAGA | 23921 | ERAP1 | TAGTTCCTTGCCATATCCTA | 24030 |
| B2M | TGAGTTTGCTGTCTGTACAT | 23922 | ERAP1 | AAACAGTCAGCAAAACACTG | 24031 |
| NLRC5 | CAGGGGCAAGGGCTGGTGCC | 23923 | ERAP1 | TCGGTCCCCAACTTGAGCAC | 24032 |
| NLRC5 | CCACTATTCCAGACTCCAAA | 23924 | ERAP1 | GGGTTAGGGGCATGCAGGAA | 24033 |
| NLRC5 | GGAGTTGGGGGGACTGTGTC | 23925 | ERAP1 | TGGACTTGTCAGCGCCTGCC | 24034 |
| NLRC5 | TTCTCAGATGTGTCTCCGGC | 23926 | ERAP1 | TTTCACTGTTTAGCGTTGCG | 24035 |
| NLRC5 | GAAGAACAAGGTCTAGCGGA | 23927 | CANX | GCCGGGAGTGAGGCAGGAAG | 24036 |
| NLRC5 | GACACAAGGAGCTGCAGTCG | 23928 | CANX | GCTACTCAGGGGCCAGGGGC | 24037 |
| CCL5 | TCTAGATGAGAGAGCAGTGA | 23929 | CANX | GCGGGACTTGGCGCCGGCTG | 24038 |
| CCL5 | GAGACAGAGACTCGAATTTC | 23930 | CANX | TGTTGGTTGGGCGGGAGGTG | 24039 |
| CCL5 | AAGAAAACTGAAATAGCCTC | 23931 | CANX | CGATGCCCACGCCGGCCAAC | 24040 |
| CCL5 | ATTTTGGAAACTCCCCTTAG | 23932 | CANX | TCTTCGTGGAGTGTGAAGAT | 24041 |
| CCL5 | GCCCTTTATAGGGCCAGTTG | 23933 | CANX | ACCGTCCCATACGCCCCCTA | 24042 |
| CCL5 | TTATGATACCGGCCAATGCT | 23934 | CANX | ATGTCGGGGCTTGCGCGGGA | 24043 |
| TNFSF9 | TGGCCGCGGGCGGAGGGGCG | 23935 | CD83 | ACTTGGCTCCCTGCCTTCCC | 24044 |
| TNFSF9 | GGGCGTGGCCGCGGGCGGAG | 23936 | CD83 | GTACTGACTGATAACCTCCC | 24045 |
| TNFSF9 | GAAAGGCTCTGGGCTGGGAA | 23937 | CD83 | ACACGCATACACAACATTTT | 24046 |
| TNFSF9 | CGCAGAGTCACGGGGACGAG | 23938 | CD83 | TACAGACTTGTATGTTTCCA | 24047 |
| TNFSF9 | AAAGCGGAGAGAGATCCGAG | 23939 | CD83 | TAATAGGAGACACTCTCCTT | 24048 |

FIG. 28A

| Gene Name | Guide Sequence | SEQ ID NO: | Gene Name | Guide Sequence | SEQ ID NO: |
|---|---|---|---|---|---|
| TNFSF9 | AGCTGCTTGGCTACAAAAGG | 23940 | CD83 | GACGGGGGCGGGGACGGGGG | 24049 |
| TNFSF9 | TTGGAAGGCCGGAAACGGAA | 23941 | CD83 | CCGCCCCCGCGCGCCCGGGC | 24050 |
| CD70 | GGCGGGGAGGGGTTGGGGGC | 23942 | CD83 | GCGCACGCGGCGAGGGCGGC | 24051 |
| CD70 | ATGTCTCCTGCCTGAAGGTC | 23943 | CD83 | CCCCGCGTGACGCCCAGCGC | 24052 |
| CD70 | CAGGATGCAGGCAGTGGCCC | 23944 | CD83 | CGACGCGAACTCGGGGCGCC | 24053 |
| CD70 | CAACTGCCTCCACCCACTTT | 23945 | TAP2 | GGGTCTCGCGCGCCCCCTCC | 24054 |
| CD70 | ATGTCCGGCCGGTCGAGGGG | 23946 | TAP2 | CGCTTTCGCTTCCCCAGCCA | 24055 |
| CD70 | TCAGACTGGCAGCGGTTGGA | 23947 | TAP2 | AGGCGAGTGAGACTCATTGC | 24056 |
| CD70 | GGCAACTCTGAGGCTCACCC | 23948 | TAP2 | GGCTCCAGTTCCGCTGTCTG | 24057 |
| CD70 | GGGACTTGAGCAATTGGCGA | 23949 | TAP2 | TTCATTCTGGGCTGGGCCGC | 24058 |
| CALR | CAGGGGCGGGCCCAAGGGCT | 23950 | TAP2 | TACAGTGCGAACCAGAGTTC | 24059 |
| CALR | GTCAGGTTGGTTTGAGAGGC | 23951 | TAP2 | TCTCGCGCGCCCCCTCCCGG | 24060 |
| CALR | CGGAACGCTGGGTTCCCAGA | 23952 | TAP2 | AGTAAAATACAGTTGTCTCA | 24061 |
| CALR | GTGGTGAGGCCAATAGAAAT | 23953 | TAP2 | AGGCGAGTGAGACTCATTGC | 24062 |
| CALR | GGCATAGACCAATGACAAAG | 23954 | TAP2 | GCTCCAGTTCCGCTGTCTGC | 24063 |
| CALR | CAATGGAAAAAGACGGCCAT | 23955 | TAP2 | TACAGTGCGAACCAGAGTTC | 24064 |
| CALR | TGGGTATAAAAGTGCAAGGC | 23956 | TAP1 | CGGCGCCGCCAGGAGGCGCC | 24065 |
| CALR | CTTCGTCGGTTCACTATGTT | 23957 | TAP1 | GGAGGCAGGGAGAGGCGAGA | 24066 |
| CST3 | GCGGGGAGAGGCAGGGGAGG | 23958 | TAP1 | TTCCCACCCCAGCCTCAGGG | 24067 |
| CST3 | GGGGAGAGGCAGGGGAGGCG | 23959 | TAP1 | AAAGCAGCCCCGCAGCACCC | 24068 |
| CST3 | GAGGGAGAAGGGAGGTGGGA | 23960 | TAP1 | GGCTGCCTCGTCACTTGTCT | 24069 |
| CST3 | GGGAGGGAAGGGGATGGATG | 23961 | TAP1 | ACTGGTGCAAGTGGAAAGGC | 24070 |
| CST3 | GCAGGGGAGGCTGGGATGGG | 23962 | TAP1 | GCGCGGCGCTAACGTGTGTA | 24071 |
| CST3 | GAGGCCGGGAGGGGCTGGGA | 23963 | SEC61G | AGCGCAGCGCGACGTGCGCC | 24072 |
| CST3 | AAGGACAGGGAAGCCTGGAG | 23964 | SEC61G | CTCTTCCAGGAAGCGTGGCC | 24073 |
| CST3 | ACTGATAGGGAGGGACCTGG | 23965 | SEC61G | CGCCCACTCCTCCGTCCTAT | 24074 |
| CSTB | GCGGGGCGCGGGGCGGGGCG | 23966 | SEC61G | TAGACTCACACTCCTAAGGA | 24075 |
| CSTB | GGGAGGAGGCACTTTGGCTT | 23967 | SEC61G | GCGCACTGAGGTTTCGCGTA | 24076 |
| CSTB | GGGAGGGAGCGCCCCCCTCC | 23968 | SEC61G | GCATTGCGGAGCTCGCTAGT | 24077 |
| CSTB | TGGGTCTCCGCGCCCAGCGC | 23969 | SEC61G | CGTTATCCCTTTTTTCCGGC | 24078 |
| CSTB | AGTCCCCTGCGGGGTCGCGG | 23970 | IFNB1 | TGAAAGGGAGAAGTGAAAGT | 24079 |
| CSTB | GCCCCGCAAGAAGGGACGCG | 23971 | IFNB1 | ATGGTCCTCTCTCTATTCAG | 24080 |
| CSTB | GGAAAGACGATACCAGCCCC | 23972 | IFNA4 | GAAGACTTTGCTCTGTGCAT | 24081 |
| CSTB | ACCTGGCCACCACTCGCCGC | 23973 | IFNA4 | TATTTTTCACCTGCACTCAA | 24082 |
| ICOSLG | GGGCGGGGCGGGGACGGGGC | 23974 | IFNA4 | CAACTAGGGAATTTAGAAAA | 24083 |
| ICOSLG | GGGGCGCTGCGCGGCGGCTC | 23975 | SEC61B | ACTGACTCAGGCCCCGCCCC | 24084 |
| ICOSLG | CGGCGCCCAGGTCCGCGTCC | 23976 | SEC61B | ATCCAAAGGAAGGAGGCCGG | 24085 |
| ICOSLG | CGAGACCGCCCCGGGACAGG | 23977 | SEC61B | AGACGACCCAGGCGTCCCTG | 24086 |
| ICOSLG | TCGCCAGAGGAGCCAGGCCG | 23978 | SEC61B | AGGACCTTGCCTGCAAGTCC | 24087 |
| ICOSLG | GTGTGCCCGTCGGCCGGAGG | 23979 | SEC61B | GTCTCTACTTCCCATACAGC | 24088 |
| ICOSLG | GGCAGGTCGGCCTGTCCGCC | 23980 | SEC61B | GTAGGGATTGGACTTTCTGA | 24089 |
| ICOSLG | CTGGGCAGAGCCGAACTTTC | 23981 | SEC61B | GTCTGTAGCAGACTGTCTAC | 24090 |
| CD80 | TTCTCCTCCCCTAGGCCGCC | 23982 | TNFSF15 | TTCCAATCCAAAATCCTGCA | 24091 |
| CD80 | GCCTCCCTCACCACCGTGCA | 23983 | TNFSF15 | ACCCGCAGCAAGCACCACCA | 24092 |
| CD80 | GCTTTTGTAGAGGCTGTGGC | 23984 | TNFSF15 | TAAACTTGCCCAAAGCCATG | 24093 |
| CD80 | CAAACACCCTGTCCAACTCC | 23985 | TNFSF15 | GTGGCACTGGACCAAGCTGG | 24094 |
| CD80 | TAGAAGAAGACGGCAGCAGA | 23986 | TNFSF15 | TCTTGAACACAAATGAATCT | 24095 |
| CD80 | AATGGTGCCCGAGAAGAGTG | 23987 | TNFSF15 | CAAGGTTTCTCTCCTATCAT | 24096 |
| CD80 | CATGAAACACCACGAGCACC | 23988 | TNFSF15 | TGTGCTCTTGAAGAGGGGAG | 24097 |
| CD86 | TTAAAGAAAGTTAGCTGGGT | 23989 | TNFSF15 | CTCCTTCCTTCGTTTACAGA | 24098 |
| CD86 | GAGTTTAAACTGCAAGGAAA | 23990 | TNFSF15 | GTGCATTCTCTAGCAGGGTA | 24099 |
| CD86 | TCAAAATCTGTAGAGAAAAG | 23991 | TNFSF15 | AACTTGGTTTCTGTTGTAGG | 24100 |
| CD86 | TTAAATTTCTTCCTCAAGTG | 23992 | TNFSF8 | GGGGAGGTCTTCTGAGCCAC | 24101 |
| CD86 | GCTCATCTTAACGTCATGTC | 23993 | TNFSF8 | AGCTGCACCTTCTTTCAGCG | 24102 |
| CD86 | CTCCCTTTGGGGGTTTCCCA | 23994 | TNFSF8 | CCCAGCAAGGACTCATTATC | 24103 |
| | | | TNFSF8 | TTGAACAGGAAGGCGTTTTG | 24104 |

FIG. 28B

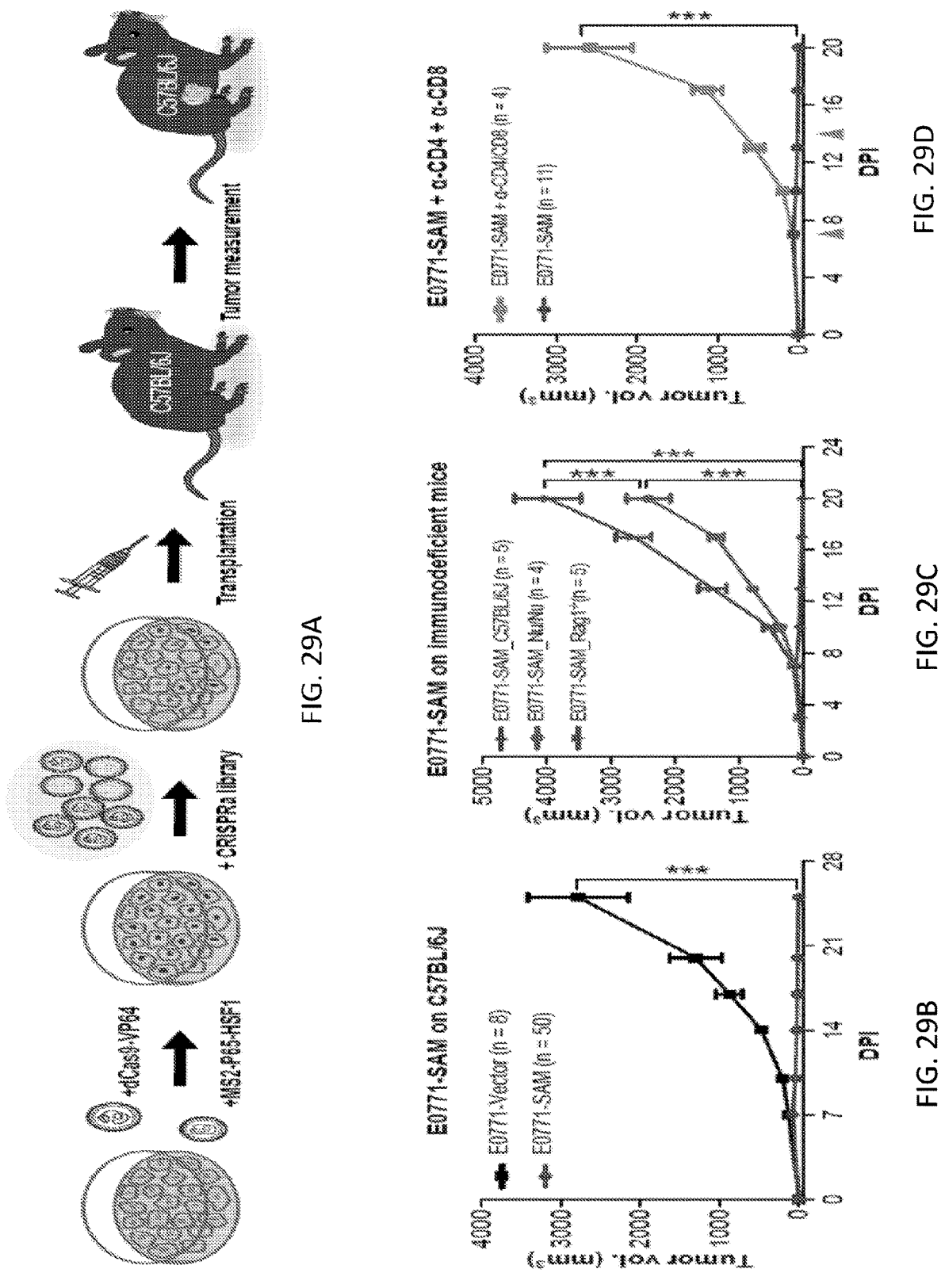

PBS

| Sample | CDR3 | V | J | Frequency |
|---|---|---|---|---|
| TILs_18 | CASRGHW_AETLYF | TRBV16 | TRBJ2-3 | 4.17% |
|  | CASSAGT_TYEQYF | TRBV12-2 | TRBJ2-7 | 3.90% |
|  | CASSSLGDNQDTQYF | TRBV19 | TRBJ2-5 | 3.80% |
| TILs_37 | CGAGLGGLDTQYF | TRBV20 | TRBJ2-5 | 4.84% |
|  | CASSPDWGEQYF | TRBV19 | TRBJ2-7 | 4.57% |
|  | CGARLGGRAEQFF | TRBV20 | TRBJ2-1 | 2.71% |
| TILs_42 | CAIGTGGYKVVF | TRAV8N-2 | TRAJ12 | 5.80% |
|  | CASSIANRGFSDYTF | TRBV19 | TRBJ1-2 | 4.53% |
|  | CASSLDGVYAEQFF | TRBV18 | TRBJ2-1 | 3.97% |

AAV-vector

| Sample | CDR3 | V | J | Frequency |
|---|---|---|---|---|
| TILs_31 | CASSFWGRYAEQFF | TRBV14 | TRBJ2-1 | 8.69% |
|  | CASSPRLGGAETLYF | TRBV16 | TRBJ2-3 | 2.37% |
|  | CASSIVTGGGEQFF | TRBV19 | TRBJ2-1 | 1.57% |
| TILs_28 | CASSLYGAGAEQFF | TRBV16 | TRBJ2-1 | 8.41% |
|  | CASSASSYEQYF | TRBV13-3 | TRBJ2-7 | 7.61% |
|  | CALINMGYKLTF | TRAV8D-6 | TRAJ9 | 4.59% |
| TILs_53 | CAMENNYAQGLIF | TRAV13N-1 | TRAJ26 | 2.11% |
|  | CAMGRSGSFNKLTF | TRAV13N-1 | TRAJ4 | 1.44% |
|  | CAVGPEPGYQNYYF | TRAV7-5 | TRAJ49 | 1.36% |

AAV-g-MAEGI

| Sample | CDR3 | V | J | Frequency |
|---|---|---|---|---|
| TILs_58 | CATGTGGYKVVF | TRAV8N-2 | TRAJ12 | 3.31% |
|  | CALRAPYGSSGNKLIF | TRAV12N-2 | TRAJ32 | 2.65% |
|  | CASSSDWNYAEQFF | TRBV4 | TRBJ2-1 | 2.38% |
| TILs_36 | CATSSGGSMQLIF | TRAV8D-2 | TRAJ22 | 3.36% |
|  | CGARDHRAQAPLF | TRBV20 | TRBJ1-5 | 1.99% |
|  | CASADWGNQDTQYF | TRBV19 | TRBJ2-5 | 1.47% |
| TILs_38 | CASGERTFMNQAPLF | TRBV13-2 | TRBJ1-5 | 1.42% |
|  | CASSFWGRGTEVFF | TRBV14 | TRBJ1-1 | 1.24% |
|  | CASSFWGRGAETLYF | TRBV14 | TRBJ2-3 | 0.97% |

AAV-p-MAEGI

| Sample | CDR3 | V | J | Frequency |
|---|---|---|---|---|
| TILs_45 | CASSIGTSGERLFF | TRBV19 | TRBJ1-4 | 0.91% |
|  | CAWSQIGGGAETLYF | TRBV31 | TRBJ2-3 | 0.79% |
|  | CILRGTGGNNKLTF | TRAV21 | TRAJ56 | 0.52% |
| TILs_46 | CALILNTGNYKYVF | TRAV6-5 | TRAJ40 | 1.89% |
|  | CGARLGGYEQYF | TRBV20 | TRBJ2-7 | 1.71% |
|  | CASSRRGGADTQYF | TRBV17 | TRBJ2-5 | 1.63% |
| TILs_48 | CASSLGGTMSDYTF | TRBV16 | TRBJ1-2 | 1.11% |
|  | CASRETGVISNERLFF | TRBV14 | TRBJ1-4 | 0.62% |
|  | CAANTEGADRLTF | TRAV14D-2 | TRAJ45 | 0.56% |

FIG. 35C

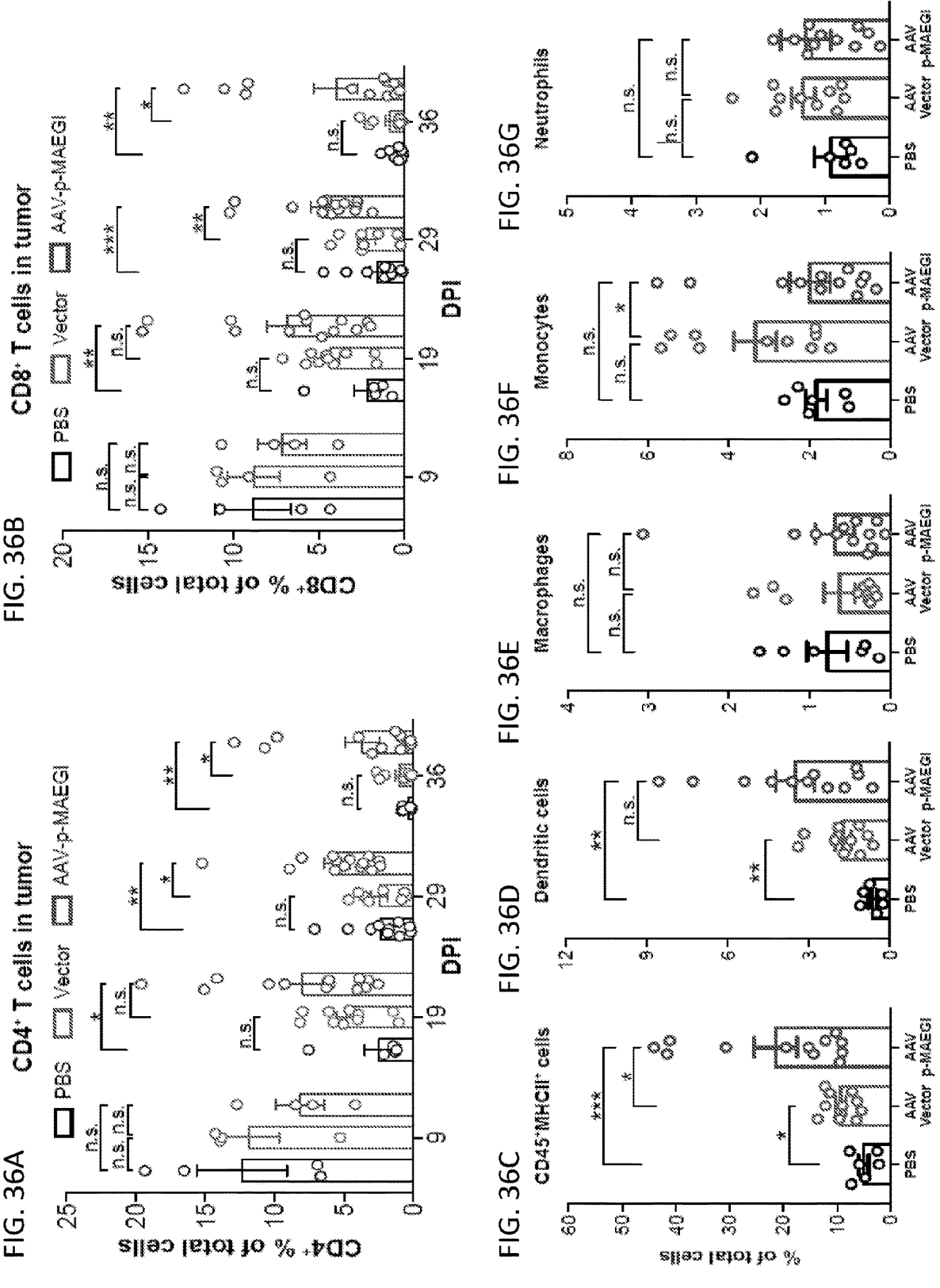

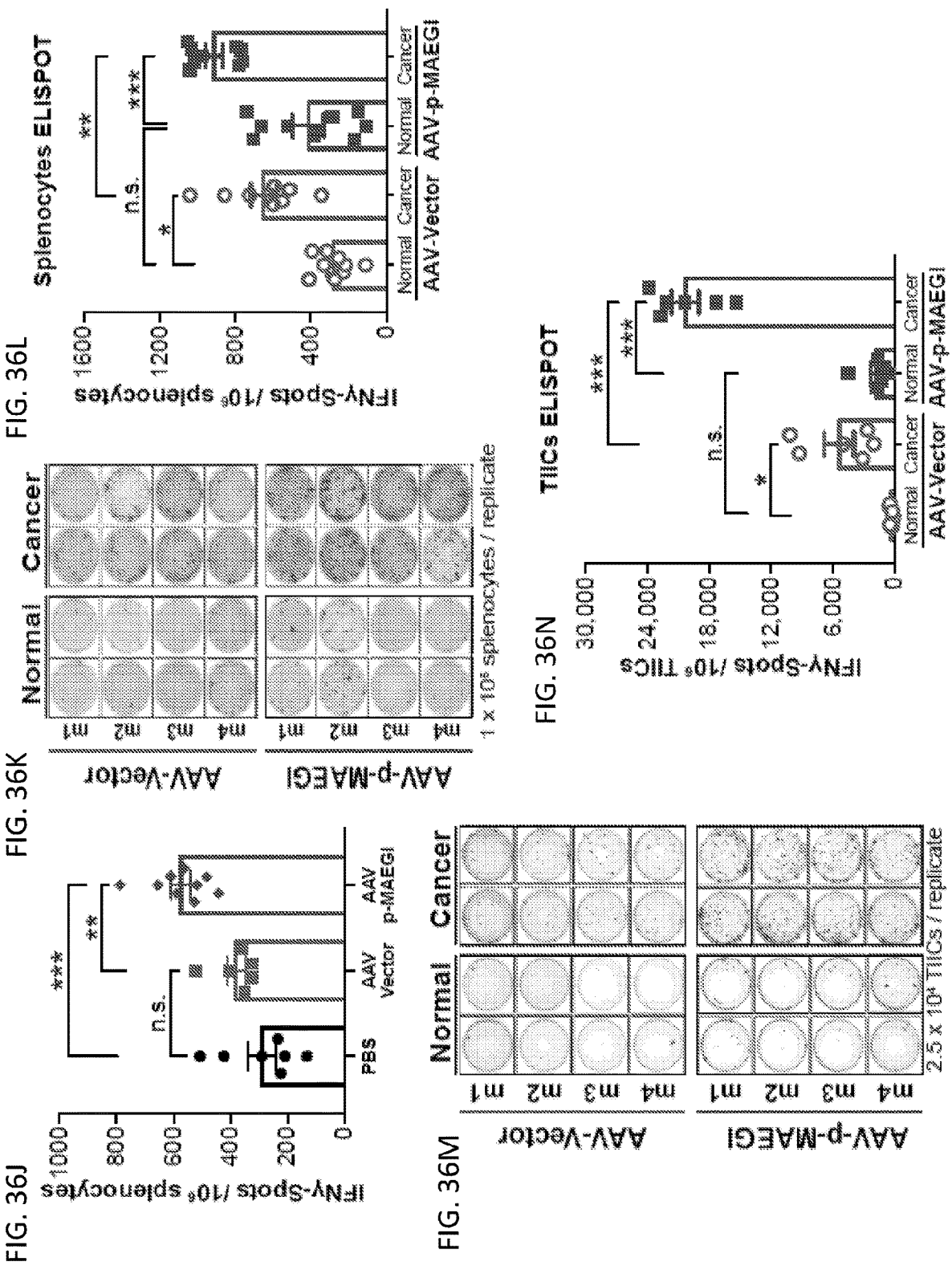

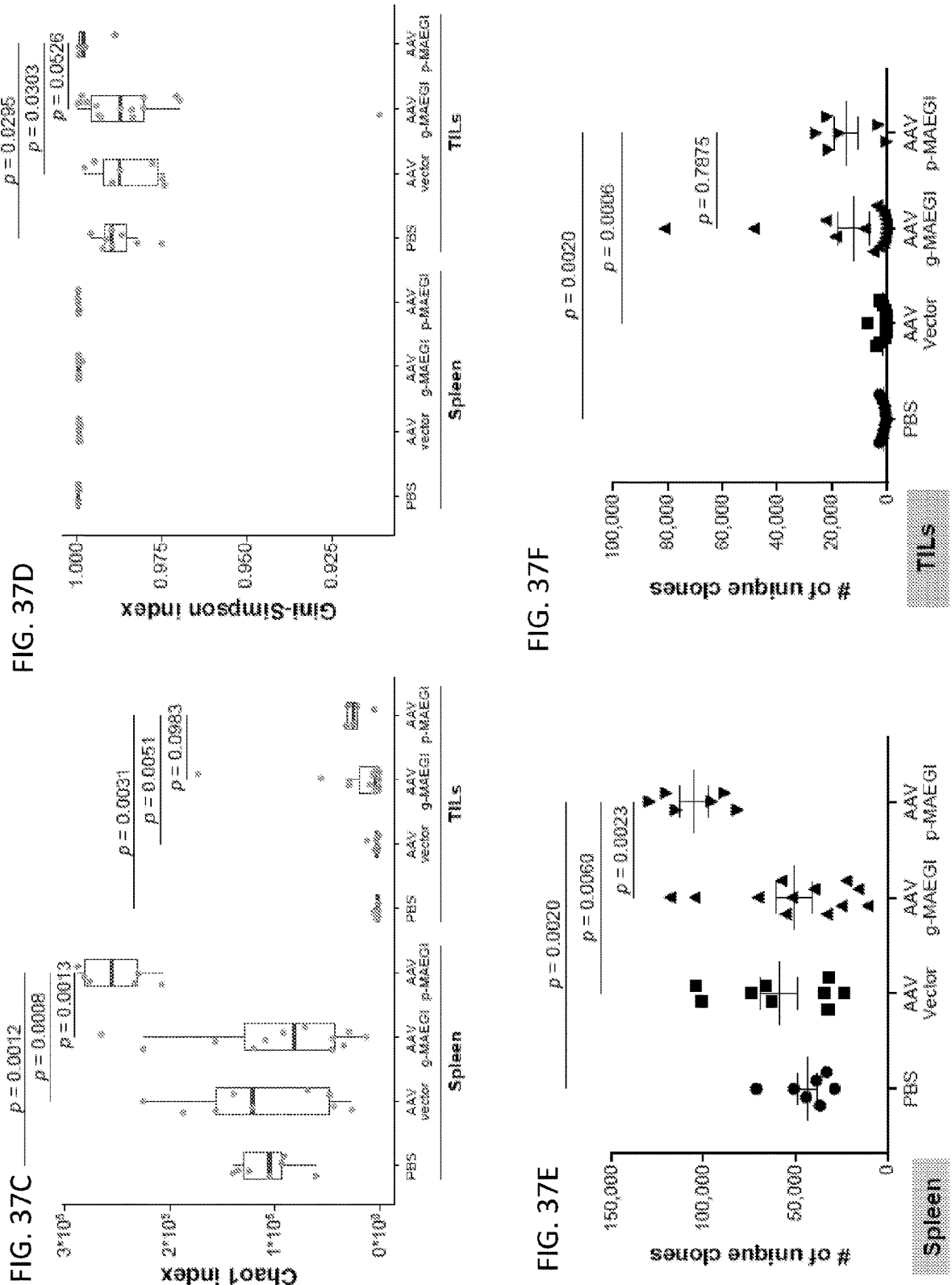

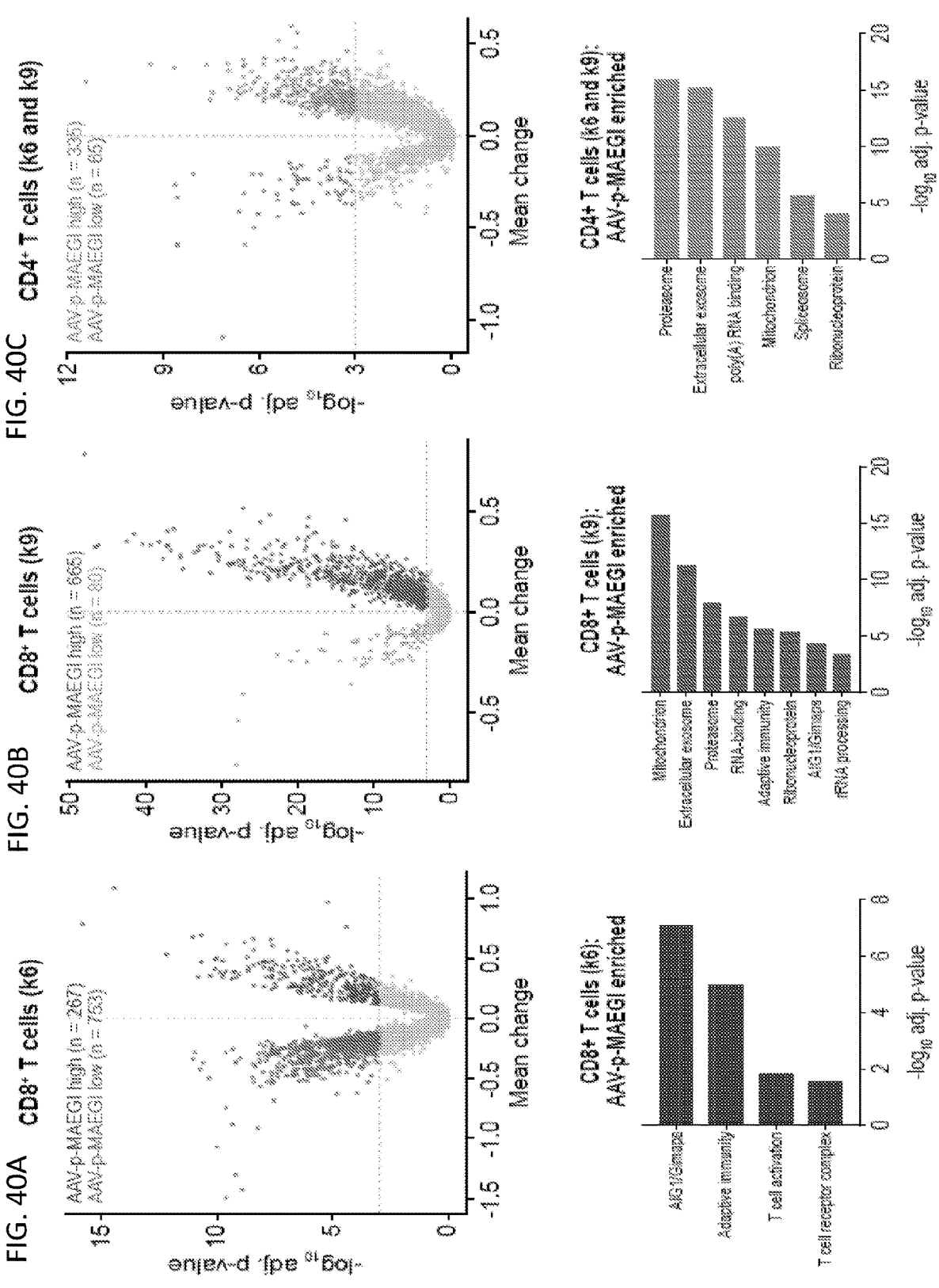

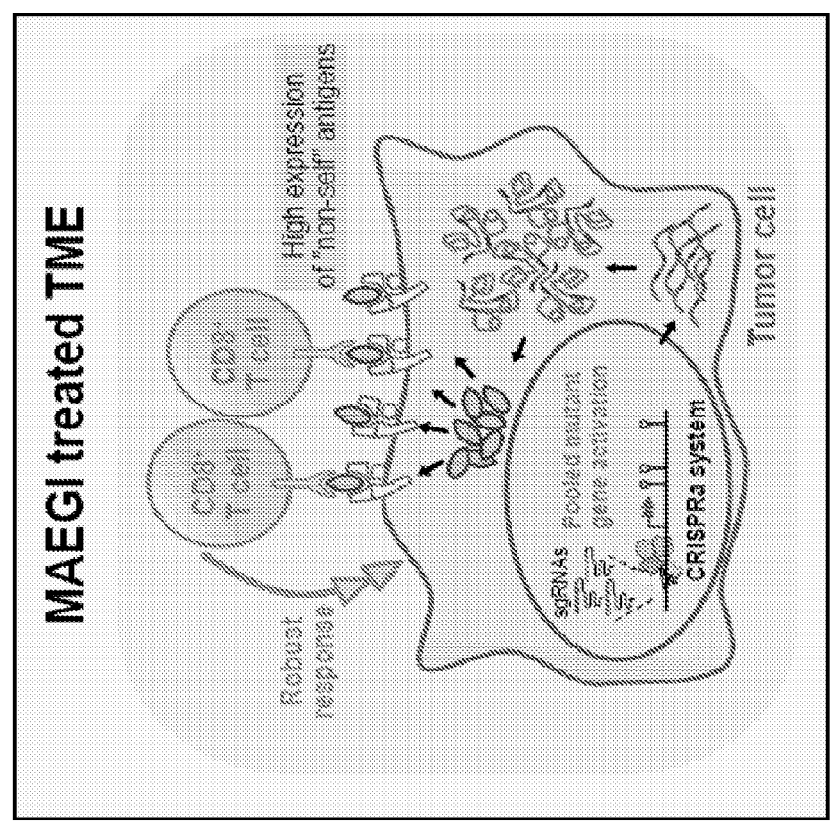
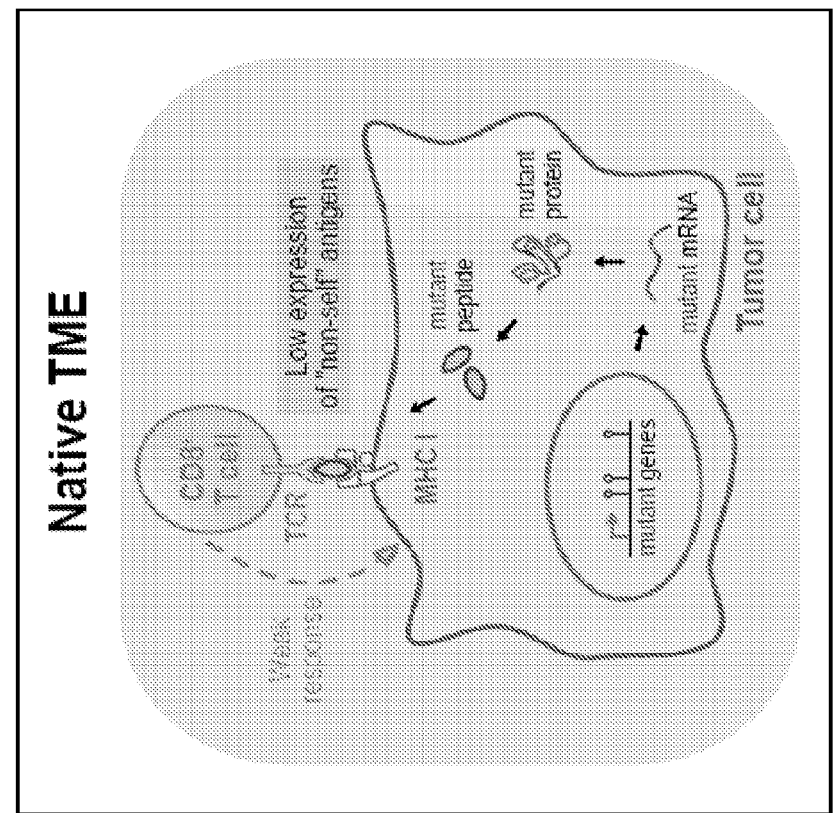
FIG. 40D

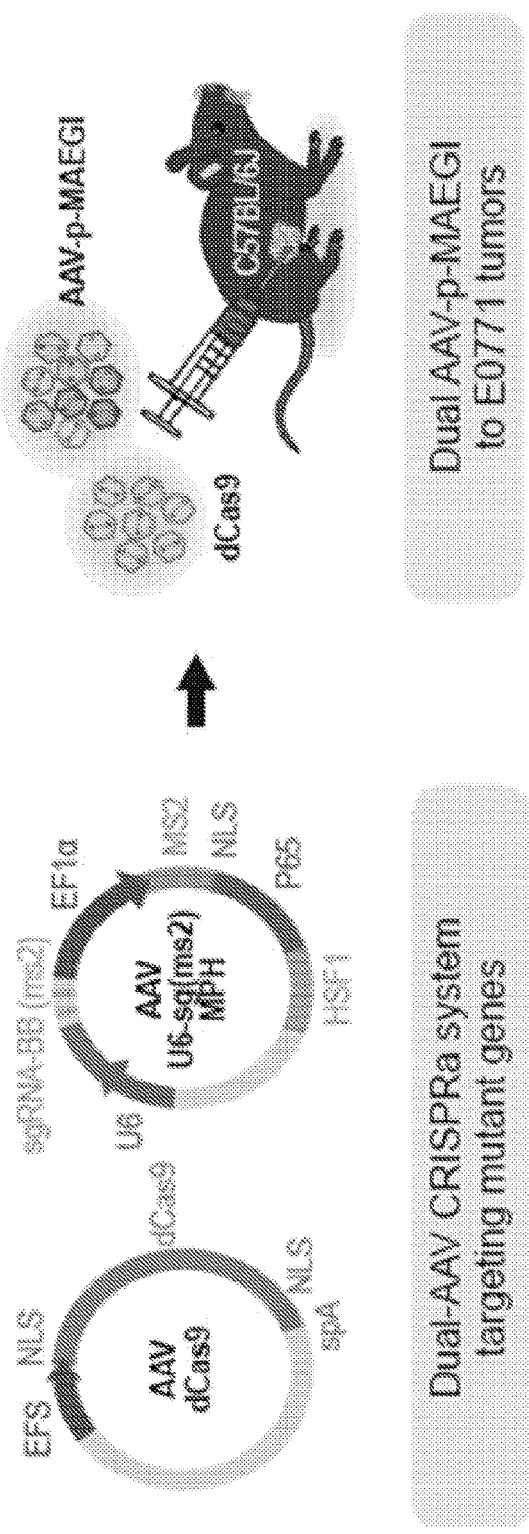
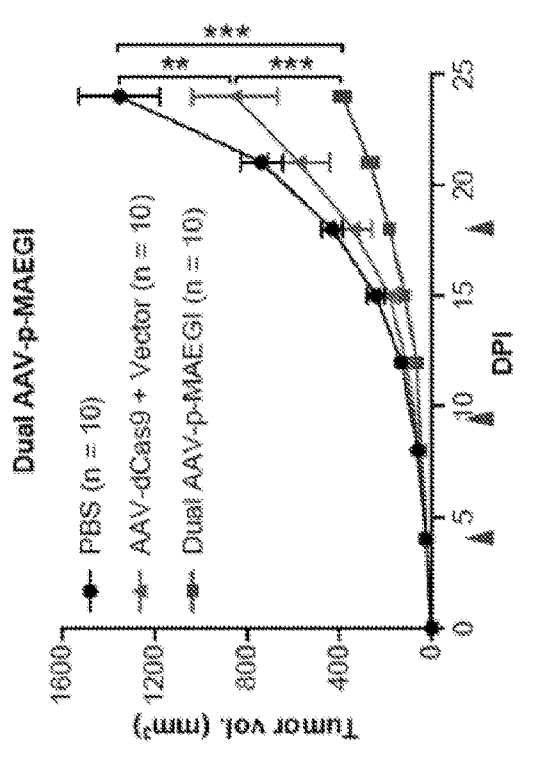
FIG. 46

COMPOSITIONS AND METHODS FOR MULTIPLEXED TUMOR VACCINATION WITH ENDOGENOUS GENE ACTIVATION

CROSS-REFERENCE TO RELATED APPLICATIONS

The present application is a 35 U.S.C. § 371 national phase application from, and claims priority to, International Application No. PCT/US2019/027956, filed Apr. 17, 2019, and published under PCT Article 21(2) in English, which is entitled to priority under 35 U.S.C. § 119(e) to U.S. Provisional Application No. 62/659,543, filed Apr. 18, 2018, and U.S. Provisional Patent Application No. 62/743,990, filed Oct. 10, 2018, which are hereby incorporated by reference in their entireties herein.

STATEMENT REGARDING FEDERALLY SPONSORED RESEARCH OR DEVELOPMENT

This invention was made with government support under CA238295, CA231112 and CA209992 awarded by the National Institutes of Health; and under W81XWH-17-1-0235 awarded by the United States Army Medical Research and Material Command. The government has certain rights in the invention.

BACKGROUND OF THE INVENTION

Immunotherapy has transformed cancer treatment by leveraging the patient's own immune system against the tumor, thereby turning several previously lethal cancers into manageable diseases for a subset of patients. Major types of immunotherapy include checkpoint blockade, adoptive cell transfer, human recombinant cytokines, and cancer vaccines. Although antigen recognition is a key process in the anti-tumor immune response, there has been limited success using cancer vaccines in the clinic over the past several decades. Traditional cancer vaccines are often dendritic cell-based vaccines such as sipuleucel-T. Recent advances of peptide- and RNA-based vaccines showed that targeted delivery of multiple mutated neoantigens can generate a strong anti-tumor effect, providing direct clinical evidence of effective cancer vaccines against late-stage melanoma. Tumor cells harbor a multitude of mutations that frequently encode mutated, partially truncated, or amplified genes that are immunogenic. However, many of these mutations might not be expressed at levels sufficient to elicit an effective T-cell-mediated response. Synthesis of these peptides or transcripts is possible with parallel protein- or RNA-synthesis, but the cost of this approach is proportional to the number of mutations identified.

A need exists for new types of cancer vaccines that can elicit strong, durable, and specific immune responses against cancer antigens, while maintaining efficacy, versatility, and cost-effectiveness. The present invention satisfies this need.

SUMMARY OF THE INVENTION

As described herein, the present invention relates to compositions and methods for or treating or vaccinating against cancer via multiplexed activation of endogenous genes by the CRISPRa system.

In one aspect, the invention includes a method of vaccinating against cancer in a subject. The method comprises contacting a cell with a composition comprising a CRISPR activation (CRISPRa) system, wherein the CRISPRa system increases expression of at least one endogenous gene resulting in a modified cell. A therapeutically effective amount of a composition comprising the modified cell is administered to the subject, thereby vaccinating against cancer in the subject.

In another aspect, the invention includes a method of treating cancer in a subject in need thereof. The method comprises contacting a cell with a composition comprising a CRISPRa system, wherein the CRISPRa system increases expression of at least one endogenous gene resulting in a modified cell. A therapeutically effective amount of a composition comprising the modified cell is administered to the subject, thereby treating the cancer in the subject.

In yet another aspect, the invention includes a method of vaccinating against cancer in a subject in need thereof. The method comprises administering to the subject a therapeutically effective amount of a composition comprising a vector comprising a CRISPRa system. The CRISPRa system increases expression of at least one endogenous gene in the subject, thereby vaccinating against cancer in the subject.

In still another aspect, the invention includes a method of treating cancer in a subject in need thereof. The method comprises administering to the subject a therapeutically effective amount of a composition comprising a vector comprising a CRISPRa system. The CRISPRa system increases expression of at least one endogenous gene in the subject, thereby treating the cancer in the subject.

Another aspect of the invention includes a method of vaccinating against cancer in a subject in need thereof. The method comprises obtaining a cancer cell from the subject, determining at least one mutated endogenous gene, and designing a CRISPRa system comprising an sgRNA library specific for the at least one mutated endogenous gene. A therapeutically effective amount of a composition comprising the CRISPRa system is administered to the subject, thereby vaccinating against cancer in the subject.

Yet another aspect of the invention includes a method of vaccinating against cancer in a subject in need thereof. The method comprises obtaining a cancer cell from the subject, determining at least one mutated endogenous gene, and designing a CRISPRa system comprising an sgRNA library specific for the at least one mutated endogenous gene. A cell is contacted with a composition comprising the CRISPRa system, wherein the CRISPRa system increases expression of the at least one mutated endogenous gene resulting in a modified cell. A therapeutically effective amount of a composition comprising the modified cell is administered to the subject, thereby vaccinating against cancer in the subject.

Still another aspect of the invention includes a method of treating cancer in a subject in need thereof. The method comprises obtaining a cancer cell from the subject, determining at least one mutated endogenous gene, and designing a CRISPRa system comprising an sgRNA library specific for the at least one mutated endogenous gene. A therapeutically effective amount of a composition comprising the CRISPRa system is administered to the subject, thereby treating the cancer in the subject.

In another aspect, the invention includes a method of treating cancer in a subject in need thereof. The method comprises obtaining a cancer cell from the subject, determining at least one mutated endogenous gene, and designing a CRISPRa system comprising an sgRNA library specific for the at least one mutated endogenous gene. A cell is contacted with a composition comprising the CRISPRa system. The CRISPRa system increases expression of the at least one mutated endogenous gene resulting in a modified cell. A therapeutically effective amount of a composition comprising the modified cell is administered to the subject, thereby treating the cancer in the subject.

In another aspect, the invention includes a method of generating an anti-tumor response in a subject. The method comprises contacting a cell with a composition comprising a CRISPRa system. The CRISPRa system increases expression of a plurality of endogenous genes resulting in a modified cell. A therapeutically effective amount of a composition comprising the modified cell is administered to the subject, thereby generating an anti-tumor response.

In yet another aspect, the invention includes a composition comprising a cancer vaccine comprising a modified cell comprising a CRISPRa system capable of increasing expression of a plurality of endogenous genes.

In yet another aspect, the invention includes a composition comprising an AAV vector comprising a CRISPRa system capable of increasing expression of a plurality of endogenous genes.

Another aspect of the invention includes a vector comprising two sgRNA cassettes in a CRISPRa system, wherein the first sgRNA cassette is used for activation of antigen presentation machinery, and the second sgRNA cassette is used for activation of patient-specific mutated endogenous genes, either in single gene or pooled format.

Yet another aspect of the invention includes a method of treating cancer in a subject in need thereof. The method comprises administering to the subject a therapeutically effective amount of a composition comprising a vector comprising a CRISPRa system. The CRISPRa system increases expression of at least one antigen presentation gene in the subject, thereby treating the cancer in the subject.

Still another aspect of the invention includes a composition comprising an sgRNA library, wherein the sgRNA library comprises a plurality of sgRNAs that target a plurality genes in the cell.

In another aspect, the invention includes a vector comprising the nucleic acid sequence of SEQ ID NO: 24,105.

In yet another aspect, the invention includes a vector comprising the nucleic acid sequence of SEQ ID NO: 24,106.

In still another aspect, the invention includes a method treating cancer in a subject in need thereof. The method comprises contacting a cell with a first AAV vector comprising a CRISPRa system, and a second AAV vector comprising dCas9. The CRISPRa system increases expression of at least one endogenous gene resulting in a modified cell. A therapeutically effective amount of a composition comprising the modified cell is administered to the subject, thereby treating the cancer in the subject.

In various embodiments of the above aspects or any other aspect of the invention delineated herein, the CRISPRa system comprises an sgRNA library. In certain embodiments, the CRISPRa system comprises an sgRNA library comprising a plurality of sgRNAs. In certain embodiments, the sgRNA library comprises at least one sgRNA that targets at least one endogenous gene in the cell. In certain embodiments, the sgRNA library comprises a plurality of sgRNAs that target a plurality of endogenous genes in the cell. In certain embodiments, the sgRNA library comprises a plurality of sgRNAs that target a plurality of antigen presentation genes in the cell. In certain embodiments, the sgRNAs are customized.

In certain embodiments, the sgRNA library comprises at least one sequence selected from the group consisting of SEQ ID NOs. 1-37. In certain embodiments, at least one of the sgRNAs comprises a nucleotide sequence selected from the group consisting of SEQ ID NOs: 23,886-24,104. In certain embodiments, the plurality of sgRNAs comprise at least one sgRNA selected from the group consisting of SEQ ID NOs: 23,886-24,104. In certain embodiments, the plurality of sgRNAs comprise the nucleotide sequences consisting of SEQ ID NOs: 23,886-24,104. In certain embodiments, the plurality of sgRNAs comprise at least one sgRNA selected from the group consisting of SEQ ID NOs: 51-259. In certain embodiments, the plurality of sgRNAs comprise the nucleotide sequences consisting of SEQ ID NOs: 51-259. In certain embodiments, the plurality of sgRNAs comprise at least one sgRNA selected from the group consisting of SEQ ID NOs: 260-348. In certain embodiments, the plurality of sgRNAs comprise the nucleotide sequences consisting of SEQ ID NOs: 260-348. In certain embodiments, the plurality of sgRNAs comprise at least one sgRNA selected from the group consisting of SEQ ID NOs: 349-4,187. In certain embodiments, the plurality of sgRNAs comprise the nucleotide sequences consisting of SEQ ID NOs: 349-4,187. In certain embodiments, the plurality of sgRNAs comprise at least one sgRNA selected from the group consisting of SEQ ID NOs: 4,188-7,980. In certain embodiments, the plurality of sgRNAs comprise the nucleotide sequences consisting of SEQ ID NOs: 4,188-7,980. In certain embodiments, the plurality of sgRNAs comprise at least one sgRNA selected from the group consisting of SEQ ID NOs: 7,981-11,808. In certain embodiments, the plurality of sgRNAs comprise the nucleotide sequences consisting of SEQ ID NOs: 7,981-11,808. In certain embodiments, the plurality of sgRNAs comprise at least one sgRNA selected from the group consisting of SEQ ID NOs: 11,809-23,776. In certain embodiments, the plurality of sgRNAs comprise the nucleotide sequences consisting of SEQ ID NOs: 11,809-23,776. In certain embodiments, the plurality of sgRNAs comprise at least one sgRNA selected from the group consisting of SEQ ID NOs: 23,779-23,885. In certain embodiments, the plurality of sgRNAs comprise the nucleotide sequences consisting of SEQ ID NOs: 23,779-23,885.

In certain embodiments, the CRISPRa system comprises a nucleic acid encoding dCas9-VP64, and a nucleic acid encoding MS2-p65-HSF1 and a genome-scale lentiviral SAM CRISPRa sgRNA library. In certain embodiments, the CRISPRa system comprises a nucleic acid encoding dCas9-VP64, a nucleic acid encoding MS2-p65-HSF1, and a nucleic acid encoding a genome-scale lentiviral SAM CRISPRa sgRNA library.

In certain embodiments, the cell is from a cancer cell line. In certain embodiments, the cell is from the subject. In certain embodiments, the cell from the subject is a cancer cell.

In certain embodiments, the subject is a mammal. In certain embodiments, the subject is a human.

In certain embodiments, administering the therapeutically effective amount of the composition comprises a one dose, a two dose, a three dose, a four dose, or a multi-dose treatment.

In certain embodiments, the method further comprises contacting the cell with a substance that induces senescence in the cell prior to administering to the subject. In certain embodiments, the substance that induces senescence in the cell is mitomycin.

In certain embodiments, the cancer is selected from the group consisting of breast cancer, lung cancer, pancreatic cancer, melanoma, glioma, hepatoma, colon cancer, pancreatic cancer and brain cancer.

In certain embodiments, the method further comprises administering an additional treatment. In certain embodiments, the additional treatment is selected from the group consisting of chemotherapy, radiation, surgery, an immune checkpoint inhibitor, and an immune checkpoint blockade (ICB) antibody. In certain embodiments, the immune checkpoint inhibitor blocks CTLA-4 or PD1 or other immune checkpoint targets. In certain embodiments, the immune checkpoint inhibitor is a monoclonal antibody selected from the group consisting of anti-CTLA4 and anti-PD1.

In certain embodiments, administering the composition alters the tumor microenvironment. In certain embodiments, administering the composition augments host immune responses against established tumors.

In certain embodiments, the composition is administered intratumorally.

In certain embodiments, the composition comprises a vector. In certain embodiments, the sgRNA library is cloned and packaged into an AAV vector.

In certain embodiments, the CRISPRa system is in an AAV vector, a lentiviral vector, or an adenoviral vector. In certain embodiments, the AAV vector is AAV2, AAV8, AAV9, AAV-DJ, or other AAV serotypes.

In certain embodiments, the cell comprises a plurality of mutated endogenous genes, and the activation system comprises an sgRNA library specific for the plurality of mutated endogenous genes and increases expression of the plurality of mutated endogenous genes.

In certain embodiments, determining the subject-specific mutated endogenous gene or genes comprises whole-exome sequencing of the cancer cell and whole-exome sequencing of a non-cancer cell from the subject. The sequencing data from the cancer cell is compared to sequencing data from the non-cancer cell and at least one mutation is determined. Thereby, the subject-specific mutated endogenous gene or genes is determined.

In certain embodiments, the mutation is selected from the group consisting of a single nucleotide polymorphism (SNP), an insertion, a deletion, a frameshift, and a rearrangement.

In certain embodiments, the endogenous genes contain detected somatic mutations.

In certain embodiments, the vector comprises the nucleic acid of SEQ ID NO: 38. In certain embodiments, the first AAV vector comprises the nucleic acid sequence of SEQ ID NO: 38 or SEQ ID NO: 49. In certain embodiments, the second AAV vector comprises the nucleic acid sequence of SEQ ID NO 24,105 or SEQ ID NO 24,106.

BRIEF DESCRIPTION OF THE DRAWINGS

The following detailed description of specific embodiments of the invention will be better understood when read in conjunction with the appended drawings. For the purpose of illustrating the invention, there are shown in the drawings exemplary embodiments. It should be understood, however, that the invention is not limited to the precise arrangements and instrumentalities of the embodiments shown in the drawings.

FIG. 1A is a schematic of the experimental design for cell-based endogenous gene tumor vaccination used in this study. The E0771 version of CRISPR activation based vaccine (E0771-CAVac, or CAVac for short) was generated by transducing E0771 cells with lentiviral vectors carrying CRISPRa machinery and a genome-scale CRISPR activation sgRNA library, then treating the cells with mitomycin. For prophylactic vaccination, C57BL/6J mice were pre-inoculated with cell-based CAVac, and then challenged by transplanting syngeneic tumors with identical cell of origin or tumors with different cell of origin. For therapeutic vaccination, syngeneic orthotopic breast tumors were established by intramammary transplantation of E0771 cells into C57BL/6J mice. After transplantation, tumor-bearing mice were treated with PBS, or E0771-CAVac at indicated times. Tumor sizes along time were measured to assess the therapeutic effects. FIG. 1B shows prophylactic efficacy of E0771-CAVac against syngeneic tumors with identical cell of origin. Growth curves of orthotopic transplanted tumors of E0771 in C57BL/6J mice pre-inoculated with PBS or E0771-CAVac. (PBS treated mice, n=7; E0771-CAVac treated mice at indicated dates prior to tumor induction. CAVac@-d14, CAVac treatment at dpi=−14 (n=5); CAVac@-d7, dpi=−7 (n=6); CAVac@-d3, dpi=−3 (n=6)). Two-way ANOVA using Sidak's multiple comparisons test for the following comparisons on study endpoint (dpi=23): CAVac@-d14 vs. PBS, p<0.0001; CAVac@-d7 vs. PBS, p<0.0001; CAVac@-d3 vs. PBS, p<0.0001. Two-sided Kolmogorov-Smirnov (KS) test of whole-curves for the following comparisons: CAVac@-d14 vs. PBS, p<2.2e-16; CAVac@-d7 vs. PBS, p<2.2e-16; CAVac@-d3 vs. PBS, p=9.62e-11. FIG. 1C shows therapeutic efficacy of E0771-CAVac against established orthotopic tumors. $2 \times 10^6$ E0771 cells were transplanted into the mammary fatpad of syngeneic C57BL/6J mice. Tumor-bearing mice were treated with PBS or E0771-CAVac at indicated times (arrows), and tumor sizes were measured after these treatments. (PBS treated mice, n=11; E0771-CAVac, n=8). Two-way ANOVA using Sidak's multiple comparisons test for the following comparisons on the last two time points (dpi=24 and 28): CAVac vs. PBS, p=0.0009 & 0.0488 respectively. Two-sided KS test of late-stage curves (13 dpi onward) of CAVac vs. PBS, p=0.016. FIG. 1D shows Haemotoxylin and Eosin (H&E) staining of representative end-point tumor sections from PBS and E0771-CAVac treated mice. Arrows point to inflamed tumor regions with lymphocyte infiltration. FIG. 1E shows CD8 immunohistochemistry (IHC) staining of representative end-point tumor sections from PBS and E0771-CAVac treated mice. Arrows point to inflamed tumor regions with CD8$^+$ cells. FIGS. 1F-1G show results from ELISPOT experiments for CAVac. Tumor-specific immune responses in tumor-bearing C57BL/6J mice in different treatment groups were assessed by measuring the ratios of tumor-stimulated IFNγ-producing splenocytes with ELISPOT assay, using mitomycin-treated tumor cells as the stimulants. Spots were counted using CTL Immunospot Analyzer. FIG. 1F shows representative pictures of spots obtained from triplicates per mouse with three mice for each treatment group. FIG. 1G shows quantification of ELISPOT experiment of PBS (n=4), cell lysate (n=4) or CAVac (n=5). Two sided unpaired t-test for the following comparisons: PBS vs. cell lysate not significant; CAVac vs. PBS, p=0.0159; CAVac vs. cell lysates, p=0.0317. Results were shown from an average of 2 independent experiments. FIG. 1H is a schematic of an experiment to test the combinatory therapeutic effects of CAVac plus immune checkpoint blockade or CD4$^+$ T cells depletion. FIG. 1I shows combinatorial therapeutic efficacy of CAVac plus anti-CTLA4 or anti-CD4 against established breast tumors of E0771. Experiment in (FIG. 1I) is also plotted separately for anti-CTLA4 (FIG. 1J) and anti-CD4 (FIG. 1IK) respectively for better visualization and statistics of data. (PBS treated mice, n=8; E0771-CAVac treated mice, n=8; anti-CTLA4 treated mice; n=6; CAVac+anti-CTLA4 combination treated mice, n=4; anti-CD4 treated mice; n=3; CAVac+anti-CD4 combination treated mice, n=6). FIG. 1J shows combinatorial therapeutic efficacy of CAVac plus anti-CTLA4 against established breast tumors of E0771. Tumor growth curves in syngeneic C57BL6J mice that were treated by PBS, E0771-CAVac, anti-CLTA4, or the combination with scheme indicated in FIG. 1H. Two-sided KS test of whole-curves for the following comparisons: CAVac vs. PBS, p=0.5899; anti-CTLA4 vs. PBS, p=0.00537; Combination vs. PBS p=1.068e-08; Combination vs. anti-CTLA4, =3.437e-05; Combination vs. CAVac, =1.375e-08. Two-way ANOVA using Turkey's multiple comparisons test at last time point (dpi=27) for the following comparisons: E0771-CAVac vs. PBS, p<0.0001; anti-CTLA4 vs. PBS, p<0.0001; Combination vs. PBS, p<0.0001; Combination vs. anti-CTLA4, p=0.016; Combination vs. CAVac, p<0.0001. FIG. 1K shows combinatorial therapy efficacy of CAVac plus anti-CD4 against established syngeneic tumors. Tumor growth curves in C57BL/6J mice treated by PBS, E0771-CAVac, anti-CD4, or the combination administrated as indicated. Two-sided KS test of whole-curves for the following comparisons: anti-CD4 vs. PBS, p=2.02e-5; Combination vs. PBS p=6.89e-6; Combination vs. anti-CD4, =0.81; Combination vs. CAVac, =1.49e-05. Two-way ANOVA using Turkey's multiple comparisons test at last time point (dpi=27) for the following comparisons: E0771-CAVac vs. PBS, p<0.0001; anti-CD4 vs. PBS, p<0.0001; Combination vs. PBS p<0.0001; Combination vs. anti-CD4, p=0.05; Combination vs. CAVac, p<0.0001. Error bars: All data points in this figure were presented as mean±s.e.m. Asterisks: * p<0.05,  p<0.01, * p<0.001.

FIG. 2A shows schematics of an experimental design used in the study. AAV-CAVac was generated by cloning of a genome-scale activation sgRNA library mSAM into AAV-CRISPRa vector, followed by pooled viral packaging into AAV9. C57BL/6J mice with established tumor(s) were treated with AAV-CAVac. FIG. 2B shows therapeutic efficacy of AAV-CAVac against established orthotopic syngeneic E0771 tumors by intratumoral administration. Growth curves of orthotopic transplanted E0771 tumors in C57BL/6J mice treated with PBS, AAV-Vector, and AAV-CAVac at indicated times (arrows). (PBS treated mice, n=8; AAV-Vector treated mice, n=6; AAV-CAVac treated mice, n=6). Two-way ANOVA using Turkey's multiple comparisons test at last time point (dpi=31) for the following comparisons: AAV-CAVac vs. PBS, p<0.0001; AAV-CAVac vs. AAV-Vector, p=0.0224. Two-sided KS test of whole-curves for the following comparisons: PBS vs. AAV-Vector, p=0.26; AAV-CAVac vs. PBS, p=0.00014; AAV-CAVac vs. AAV-Vector, p=0.0048. FIG. 2C shows therapeutic efficacy of AAV-CAVac against established orthotopic syngeneic B16F10 tumors by intratumoral administration. Growth curves of orthotopic transplanted B16F10 tumors in C57BL/6J mice treated with PBS and AAV-CAVac at indicated times (arrows). (PBS treated mice, n=8; AAV-vector treated mice, n=4; AAV-CAVac treated mice, n=4). Two-way ANOVA using Turkey's multiple comparisons test at last two time points (dpi=21 and 25) for the following comparisons: AAV-CAVac vs. PBS, p<0.0001 for both time points; AAV-CAVac vs. AAV-Vector, p=0.0008 at dpi=21. FIG. 2D shows H&E staining of representative end-point E0771 syngeneic tumor sections from PBS, AAV-Vector, and AAV-CAVac treated mice. Arrows point to inflamed tumor regions with lymphocyte infiltration. FIG. 2E shows CD8 IHC staining of representative end-point E0771 syngeneic tumor sections from PBS, AAV-Vector, and AAV-CAVac treated mice. Arrows point to inflamed tumor regions with CD8+ cells. FIGS. 2F-2G show results from ELISPOT experiments for AAV-CAVac. Tumor-specific immune responses in tumor-bearing C57BL/6J mice in different treatment groups were assessed by measuring the ratios of tumor-stimulated IFNγ-producing splenocytes with ELISpot assay, using mitomycin-treated tumor cells as the stimulants. Spots were counted using CTL Immunospot Analyzer. FIG. 2F shows representative pictures of spots obtained from triplicates per mouse with four mice for each treatment group (PBS, AAV-Vector and AAV-CAVac). FIG. 2G shows quantification of ELISPOT experiment of PBS (n=4), AAV-Vector (n=7) and AAV-CAVac (n=9). Datapoints from all mice from FIG. 2F were shown. Two sided Mann-Whitney test for AAV-CAVac vs. PBS, p=0.0028; AAV-CAVac vs. AAV-Vector, p=0.005. Results were shown from the combination of 2 independent experiments. Error bars: All data points in this figure were presented as mean±s.e.m. Asterisks: * p<0.0,  p<0.01, * p<0.001.

FIG. 3A is a schematic of the experimental design. Syngeneic orthotopic E0771 tumor bearing mice were treated with PBS or AAV-CAVac. Whole immune population within the tumor microenvironment was purified by anti-CD45 enrichments by FACS (CD45+ tumor infiltrating immune cells, TIIs), and subjected to single cell RNA-seq. FIG. 3B shows a t-SNE based dimensional reduction plot showing the clustering patterns of immune cell populations from all TIIs sequenced. Clusters 0 to 10 have 1,256, 1,215, 1213, 964, 901, 870, 302, 266, 181, 180, and 101 cells, respectively. FIG. 3C shows a t-SNE based dimensional reduction plot showing the clustering patterns of immune cell populations based on TIIs scRNAseq data from mice treated with PBS (n=5,383 cells) or AAV-CAVac (n=2,075 cells). FIG. 3D is a bar plot showing proportions of cells in each of the 11 clusters of the whole CD45 immune cells from mice treated with PBS and AAV-CAVac, respectively. Differences in cluster-specific proportions were assessed by two-sided Fischer's exact test (***, p<0.0001). FIG. 3E is a heat map of cluster-specific markers identified from scRNA-seq. Of note, cluster 0 is marked by MHC-II molecules, cluster 1 is marked by Ifit family genes, and cluster 9 is marked by T cell specific markers including Cd3d, Cd3g and Gzmb.

FIGS. 4A-4Q illustrate exome-guided AAV-CRISPRa based mutated gene set activation as precision multiplexed tumor vaccination (AAV-PCAVac or p-MAEGI, which are used interchangeably herein) against established tumors. FIG. 4A is a schematic of the experimental design. Genomic DNA of cancer cells and normal tissues were extracted, purified, and subjected to whole-exome sequencing. Somatic SNPs and indels in cancer cells were identified by comparison to matched normal tissues, and the CRISPRa sgRNAs targeting these mutants were designed. The mutated gene set customized sgRNA library was synthesized and pool-cloned into the AAV-CRISPRa vector, which was packaged into AAV9 to generate AAV-PCAVac. FIGS. 4P-4Q are growth curves of E0771 local (FIG. 4P) and distant (FIG. 4Q) tumors in mice treated by AAV-Vector (n=18), or AAV-PCAVac (AAV-p-MAEGI) (n=18). Inset, pie charts detailing the response rates for each treatment. (FIG. 4P) Two-way ANOVA: AAV-p-MAEGI vs. AAV-Vector, p<0.0001. (FIG. 4Q) Two-way ANOVA: AAV-p-MAEGI vs. AAV-Vector, p=0.0003. Error bars: All data points in this figure are presented as mean±s.e.m. Asterisks: * p<0.05,  p<0.01, * p<0.001.

FIG. 5A shows library representation of genome-scale CRISPRa library (mouse SAM) transduced E0771 cells from 6 infection replicates from two independent experiments. Out of the 66,749 sgRNAs in the library, the six replicates cover from 99.44% to 99.69% of the total sgRNAs. FIG. 5B is a heat map of pairwise Spearman correlations of library representation of mSAM transduced E0771 cells between the 6 infection replicates from two independent experiments. Pairwise correlation coefficients range from 0.88 to 0.93 between infection replicates, indicating high reproducibility. FIG. 5C shows the expression of dCas9 protein in dCas9-VP64 transduced cell lines E0771-dCas9 and E0771-dCas9-MPH confirmed by western blot using monoclonal antibody against Cas9. Anti-GAPDH was used as an internal control. FIG. 5D shows quantification of gene activation by CRISPRa at mRNA level based on qPCR assay for genes including Cd70, Cd80, Cd86, $Ifn\alpha4$, $Ifn\beta1$, and $Ifn\gamma$. Two-sided unpaired t test for the following comparisons, each gene vs. vector: Cd70, p<0.0001; Cd80, p<0.001; Cd86, p<0.05; $Ifn\alpha4$, p<0.001; $Ifn\beta1$, p<0.001; $Ifn\gamma$, p<0.0001.

FIGS. 6A-6H illustrate the finding that genome-scale activation of endogenous genes leads to robust immune rejection of syngeneic tumors. FIG. 6A shows growth curves of SAM activated E0771 cell induced syngeneic orthotopic tumor. As compared to vector transduced cells (n=8), SAM transduced E0771 cells (n=50) generated tumors were often quickly rejected by the C57BL/6J host. As compared to vector transduced cells (n=8), SAM transduced E0771 cells (n=50) generated tumors were often quickly rejected by the C57BL/6J host. Two-sided KS test, p<2.2e-16. FIG. 6B shows spider plot growth curves of SAM activated (n=50) E0771 cell induced syngeneic orthotopic tumor. Most (42/50, 84%) of SAM E0771 tumors were rejected by C57BL/6J mice; None (0/8) of vector E0771 tumors were rejected. FIG. 6C shows growth curves of SAM activated E0771 cell induced orthotopic tumor in syngeneic immunocompetent mice (C57BL/6J, n=5) and two strains of immunodeficient mice (Nu/Nu, n=4; $Rag1^{-/-}$, n=5). Two-sided KS test for the following comparisons of full-curve: C57BL6/J vs. Nu/Nu, p=3.2e-06; C57BL/6J vs. $Rag1^{-/-}$, p=1.97e-07; Nu/Nu vs. $Rag1^{-/-}$, p=0.22; Two-sided KS test for the following comparisons of late-stage curve (14 dpi onward): C57BL/6J vs. Nu/Nu, p=3.2e-06; C57BL/6J vs. $Rag1^{-/-}$, p=6.1e-07; Nu/Nu vs. $Rag1^{-/-}$, p=0.022; Two-way ANOVA using Tukey's multiple comparisons test for the last timepoint (20 dpi) of the following comparisons: C57BL6/J vs. Nu/Nu, p<0.0001; C57BL6/J vs. Rag1$^{-/-}$, p<0.0001; Nu/Nu vs. Rag1$^{-/-}$, p<0.0001. FIGS. 6D-6F show spider plot growth curves of SAM activated (n=50) E0771 cell induced syngeneic orthotopic tumor. Most (4/5, 80%) of SAM E0771 tumors were rejected by (FIG. 6D) C57BL/6J mice; None (0/9) of SAM E0771 tumors were rejected by (FIG. 6E) Nu/Nu (0/4) or (FIG. 6F) Rag1$^{-/-}$ (0/5) mice. FIG. 6G shows growth curves of SAM activated E0771 cell induced syngeneic orthotopic tumor under T cell depletion. SAM transduced E0771 cells (n=11) generated tumors were quickly rejected by the C57BL/6J host if the mice were not treated. Depleting T cells by treating mice with both anti-CD4 and anti-CD8 (n=4) rendered the tumors capable to grow rapidly C57BL/6J host. Two-sided KS test, untreated vs anti-CD4+ anti-CD8 treated p<7.9e-10. FIG. 6H shows spider plot growth curves of SAM activated E0771 cell induced syngeneic orthotopic tumor under T cell depletion. All (11/11, 100%) of SAM E0771 tumors were rejected by C57BL/6J mice untreated; None (0/4) of vector E0771 tumors were rejected by C57BL/6J mice treated with both anti-CD4 and anti-CD8. Error bars: All data points in this figure were presented as mean±s.e.m. Asterisks: * p<0.05,  p<0.01, * p<0.001.

FIG. 7A shows growth curves of E0771-SAM escaper tumors in C57BL/6J mice, either untreated (n=13), or treated by checkpoint blockade antibodies anti-PD1 (n=11) or anti-CTLA4 (n=11). When treated with either anti-PD1 (n=11) or anti-CTLA4 (n=11), all E0771-SAM transplanted C57BL/6J mice rejected the tumors. Two-sided KS test for these comparisons: anti-PD1 vs untreated, p=6.008e-06; anti-CTLA4 vs untreated, p=2.853e-06. FIGS. 7B-7D show spider plot growth curves of E0771-SAM tumors in C57BL/6J mice, either (FIG. 7B) untreated (n=13), or treated by checkpoint blockade antibodies (FIG. 7C) anti-PD1 (n=11) or (FIG. 7D) anti-CTLA4 (n=11). In the duration of study (28 dpi), of the 13 E0771-SAM transplanted mice in untreated group, 5/13 completely rejected tumor, and 8/13 either grew larger or remained sizable tumor; All anti-PD1 (11/11) and anti-CTLA4 (11/11) treated mice completely rejected E0771-SAM tumors. Error bars: All data points in this figure were presented as mean±s.e.m. Asterisks: * p<0.05,  p<0.01, * p<0.001.

FIGS. 8A-8F are spider plots of tumor growth curves of the experiment shown in FIGS. 1A-1F. FIGS. 8A-8B illustrate the therapeutic effect of CAVac on syngeneic orthotopic E0771 tumors in C57BL/6J mice. FIG. 8A shows growth curves of PBS treated E0771 tumors. FIG. 8B shows growth curves of CAVac treated E0771 tumors. FIGS. 8C-8F show growth curves of synergistic effect testing of CAVac and CTLA4 blockade or CD4$^+$ T cell depletion on syngeneic orthotopic E0771 tumors in C57BL/6J mice. FIG. 8C is a spider plot of tumor growth curves of PBS treated E0771 tumors. FIG. 8D is a spider plot of tumor growth curves of CAVac treated E0771 tumors. FIG. 8E is a spider plot of tumor growth curves of anti-CTLA4 and anti-CTLA4+ CAVac treated E0771 tumors. FIG. 8F is a spider plot of tumor growth curves of anti-CD4 and anti-CD4+CAVac treated E0771 tumors. FIG. 8G is a spider plot of anti-CTLA4+CAVac treated E0771 tumors with data of long-time points after tumor rejection. Data from PBS-treated tumors in FIG. 8C was used as a control. Arrowhead points out that no tumor relapse was observed in these mice after 90 days, indicating the anti-tumor responses induced by combining CAVac and anti-CTLA4 were long-lasting.

FIG. 9A shows results from testing the effect of untransduced E0771 lysate against established syngeneic orthotopic E0771 tumors. Tumor-bearing mice were treated with PBS or E0771 lysate at indicated times (arrows). (PBS treated mice, n=6; E0771 lysate, n=10). Two-sided KS test for E0771 lysate vs. PBS, p=0.77. FIG. 9B shows results from testing the effect of active CAVac and inactivated CAVac against established syngeneic orthotopic E0771 tumors. (PBS treated mice, n=4; CAVac, n=3; CAVac lysate, n=3). Tumor-bearing mice were treated with PBS, CAVac, or CAVac lysate at indicated times (arrows). Two-sided KS test of late-stage curves (17 dpi onward) of the following comparisons: CAVac vs. PBS, p=0.004; CAVac lysate vs. PBS, p=0.97. Two-way ANOVA using Tukey's multiple comparisons test for the last timepoint after tumor induction (24 dpi) of the following comparisons: CAVac vs. PBS, p=0.0004; CAVac lysate vs. PBS, p=0.2115. FIG. 9C shows the single dose effect of CAVac against established syngeneic orthotopic E0771 tumors. Tumor-bearing mice were treated with PBS or CAVac at +3 dpi (arrows). (PBS treated mice, n=6; CAVac@d3 (CAVac at +3 dpi), n=5). Two-way ANOVA using Sidak's multiple comparisons test for the last two timepoint after tumor induction (dpi=24 or 28) of the following comparisons: CAVac@d3 vs. PBS, p=0.013 and p=0.003 respectively. Two-sided KS test of late-stage curves (17 dpi onward) of CAVac vs. PBS, p=0.0078. FIG. 9D shows CD8$^+$ T cell depletion abolished the effect of CAVac against established syngeneic orthotopic E0771 tumors. Tumor-bearing mice were treated with PBS (n=5) or CAVac+anti-CD8 (n=3) at indicated days (upward arrows for CAVac, downward arrows for anti-CD8). Of note, the data of the PBS-treated mice here were same as the five PBS-treated mice (experiment 2) used in FIG. 1I-K, as these treatments were done together. Two-sided KS test of CAVac+anti-CD8 vs. PBS, p=0.78. Error bars: All data points in this figure were presented as mean±s.e.m. Asterisks: * p<0.05,  p<0.01, * p<0.001.

FIGS. 10A-10G illustrate additional spider plot growth curves of AAV-CAVac and combinatorial treatments. FIG. 10A shows quantification of AAV-CRISPRa mediated gene activation at mRNA level based on qPCR assay for genes in minipool, including Cd70, Cd80, Cd86. Two-sided unpaired t test for the following comparisons, each gene vs. vector: Cd70, p<0.0001; Cd80, p<0.001; Cd86, p=0.0054. FIG. 10B is a spider plot of tumor growth curves of PBS treated E0771 tumors. FIG. 10C is a spider plot of tumor growth curves of AAV-Vector treated E0771 tumors. FIG. 10D is a spider plot of tumor growth curves of AAV-CAVac treated E0771 tumors. FIG. 10E is a spider plot of tumor growth curves of PBS treated B16F10 tumors. FIG. 10F is a spider plot of tumor growth curves of AAV-Vector treated B16F10 tumors. FIG. 10G is a spider plot of tumor growth curves of AAV-CAVac treated B16F10 tumors.

FIG. 11A are a series of Violin plots of representative cluster #0 specific differentially expressed genes between AAV-CAVac and PBS treated mice. Cc18 and Cc17 were more highly expressed in AAV-CAVac treated mice (adjusted p=1.6e-33 and p=2.73e-10), whereas Pkm and Aldoa were more highly expressed in PBS treated mice (adjusted p=8.57e-22 and p=4.85e-19). FIG. 11B are a set of Violin plots of representative cluster #1 specific differentially expressed genes between AAV-CAVac and PBS treated mice. Cc18 was more highly expressed in AAV-CAVac treated mice (adjusted p=6.65e-20), whereas Pkm was more highly expressed in PBS treated mice (adjusted p=3.03e-14. FIG. 11C are a series of Violin plots of representative cluster #9 specific differentially expressed genes between AAV-CAVac and PBS treated mice. Cc18 and Gm26917 were more highly expressed in AAV-CAVac treated mice (adjusted p=1.73e-12 and p=1.46e-6), whereas mt-Nd2 and Hmox1 were more highly expressed in PBS treated mice (adjusted p=5.97e-6 and p=9.79e-5).

FIGS. 12A-12E illustrate interrogation of the T cell repertoire in CAVac or AAV-CAVac treated mice using TCR sequencing. FIG. 12A is a schematics of the TCR-seq experimental design. Mice were treated with PBS, CAVac, or AAV-CAVac. Samples including spleens and tumors were harvested from mice for genomic DNA extraction, and subjected to RT-based TCRa/TCRb capture followed by Illumina sequencing. FIG. 12B is a global occupied clonal homeostasis plot showing clone size patterns of TCRseq data from T cell populations in tumors or in spleens. Hyperexpanded clones are shown in black. FIG. 12C is a global clonal proportion plot showing the relative frequency of the top N clones. FIG. 12D is a scatterplot demonstrating positive correlation between endpoint tumor size and Gini-Simpson index of clonal distribution of the TCR repertoire of all TIL samples from CAVac and AAV-CAVac treated mice. Spearman correlation coefficient R=0.5433, p=0.03632. FIG. 12E shows CDR3 amino acid sequences from major (top 3) clones from three example TIL samples from CAVac and AAV-CAVac treated mice.

FIG. 14 illustrates a simplified model of action for vaccination by multiplexed endogenous gene activation. Left, the unvaccinated tumor microenvironment. In a setting of low neoantigen expression, CD8+ T cells detect rare mutant peptides presented on MHC-I by tumor cells and initiate weak tumor killing. Right, the vaccinated tumor microenvironment. Using CRISPRa, mutated genes in tumor cells are overexpressed, leading to amplified production and presentation of neoantigens to CD8+ T cells. With enhanced engagement of the TCR, CD8+ T cells initiate more robust killing in the vaccinated microenvironment.

FIG. 15A shows representative flow cytometry pictures and gating of CD45$^+$, CD3$^+$, CD4$^+$, and CD8$^+$ T cell populations in the spleens (splenocytes) from tumor-bearing mice treated with PBS or AAV-PCAVac. FIG. 15B shows quantification of CD4$^+$ and CD8$^+$ T cell populations from splenocytes of tumor-bearing mice treated with PBS, AAV-Vector, or AAV-PCAVac. From left to right, bar-dot plots with Mann Whitney test for the following comparisons: Fraction of CD4$^+$ T cells in all cells in spleen (absolute fraction); AAV-PCAVac vs. PBS, p=0.0003; AAV-PCAVac vs. AAV-Vector, p=0.0028. Fraction of CD4$^+$ T cells in all CD45$^+$ immune cells in spleen (relative fraction); AAV-PCAVac vs. PBS, p=0.0007; AAV-PCAVac vs. AAV-Vector, p=0.0048. Fraction of CD8$^+$ T cells in all cells in spleen (absolute fraction); AAV-PCAVac vs. PBS, p=0.0032; AAV-PCAVac vs. AAV-Vector, p=0.0016. Fraction of CD8$^+$ T cells in all CD45$^+$ immune cells in spleen (relative fraction);

AAV-PCAVac vs. PBS, p=0.0012; AAV-PCAVac vs. AAV-Vector, p=0.0016. FIG. 15C shows representative flow cytometry pictures and gating of CD45$^+$, CD3$^+$, CD4$^+$, and CD8$^+$ T cell populations in the tumor from tumor-bearing mice treated with PBS or AAV-PCAVac. FIG. 15D shows quantification of CD4$^+$ and CD8$^+$ T cell populations of the tumors from mice treated with PBS or AAV-PCAVac. From left to right, bar-dot plots with Mann Whitney test for the following comparisons: Fraction of CD4$^+$ T cells in all cells in tumor (absolute fraction); AAV-PCAVac vs. PBS, p=0.0007; AAV-PCAVac vs. AAV-Vector, p=0.0256. Fraction of CD4$^+$ T cells in all CD45$^+$ immune cells in tumor (relative fraction); AAV-PCAVac vs. PBS, p=0.0115; AAV-PCAVac vs. AAV-Vector, p=0.0256. Fraction of CD8$^+$ T cells in all cells in tumor (absolute fraction); AAV-PCAVac vs. PBS, p=0.0047; AAV-PCAVac vs. AAV-Vector, p=0.0332. Fraction of CD8$^+$ T cells in all CD45*immune cells in tumor (relative fraction); AAV-PCAVac vs. PBS, p=0.0161, AAV-PCAVac vs. AAV-Vector, p=0.0248. Error bars: All data points in this figure were presented as mean±s.e.m. Asterisks: * p<0.05,  p<0.01, * p<0.001.

FIGS. 16A-16G illustrate boosting the expression levels of single genes or a small set of genes in tumor cells with CRISPRa resulted in tumor rejection in mice. FIG. 16A shows growth curves of Arhgap30 or Nolc1 activated E0771 cell induced syngeneic orthotopic tumor. As compared to vector transduced cells, sg-Arhgap30 or sg-Nolc1 transduced E0771 cells generated tumors that grew slower and often got rejected by the C57Bl/6J host. Two-way ANOVA using Tukey's multiple comparisons test for the following comparisons: sg-Arhgap30 vs. vector, p=0.0003 and p<0.0001 for dpi 20 and 23, respectively; sg-Nolc1 vs. vector, p=0.0123 and p=0.0002 for dpi 20 and 23, respectively. Two-sided Kolmogorov-Smirnov (KS) test for the following comparisons: sg-Arhgap30 vs. vector, p=0.003; sg-Nolc1 vs. vector, p=0.02. FIGS. 16B-16D show spider plot growth curves of Arhgap30 or Nolc1 activated E0771 cell induced syngeneic orthotopic tumor in vector (n=7) (FIG. 16B), sg-Arhgap30 (n=3) (FIG. 16C), and sg-Nolc1 (n=3) (FIG. 16D). All (3/3) of sg-Arhgap30 E0771 tumors were rejected by C57BL/6J mice; 2/3 of sg-Nolc1 E0771 tumors were rejected; None (0/7) of vector E0771 tumors were rejected. FIG. 16E shows quantification of gene activation by CRISPRa at mRNA level based on qPCR assay for genes used in minipools experiment, including Cd70, Cd80, Cd86, Ifnα4, Ifnβ1, and Ifnγ. Two-sided unpaired t test for the following comparisons, each gene vs. vector: Cd70, p<0.0001; Cd80, p<0.001; Cd86, p<0.05; Ifnα4, p<0.001; Ifnβ1, p<0.001; Ifnγ, p<0.0001. FIG. 16F shows growth curves of minipool (sg-Cd70, sg-Cd80, sg-Cd86, sg-Ifnα4, sg-Inβ1, and sg-Ifnγ) activated E0771 cell induced syngeneic orthotopic tumor. As compared to vector transduced cells, minipool transduced E0771 cells generated tumors were all quickly rejected by the C57BL/6J host. Two-sided KS test, p=3.51e-8. FIG. 16G shows spider plot growth curves of minipool activated (n=5) and vector control (n=5) E0771 cell induced syngeneic orthotopic tumor. All (5/5) of minipool E0771 tumors were rejected by C57BL/6J mice; None (0/5) of vector E0771 tumors were rejected. Error bars: All data points in this figure were presented as mean+/- s.e.m. Asterisks: * p<0.05,  p<0.01, * p<0.001.

FIGS. 17A-17C illustrate concepts for two modes of multiplexed vaccination with endogenous gene activation using the CRISPRa system. FIG. 17A is a schematic illustrating mutated antigen presentation and T cell recognition in the unvaccinated tumor microenvironment. FIG. 17B is a schematic illustrating augmentation of the immune response by CRISPRa amplification of mutated endogenous genes in cancer cells. FIG. 17C is a schematic illustrating augmentation of the immune response by CRISPRa amplification of genes encoding antigen-presentation machinery in cancer cells.

Figure 18:
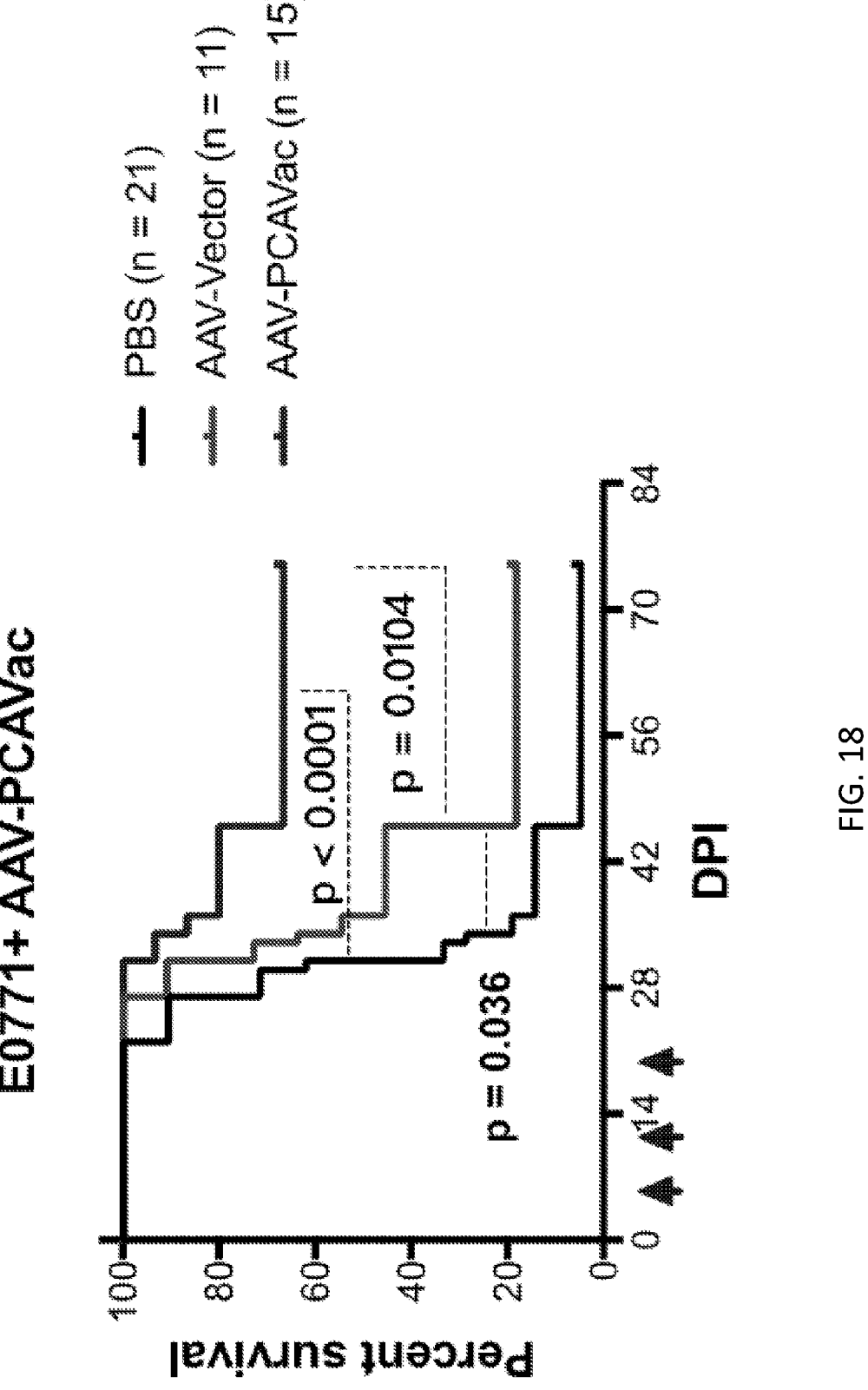

FIG. 18 illustrates the Precision ("Personalized") AAV-PCAVac system as a therapeutic vaccine against triple-negative breast cancer (TNBC). Efficacy of AAV-PCAVac multiplexed endogeneous gene activation is demonstrated in a syngeneic orthotopic model in C57BL/6J host. Shown is a survival curve of E0771 TNBC engrafted in the mammary fatpad of C57BL/6J female mice, treated with PBS, AAV-Vector, or AAV-PCAVac library, which targets a set of most highly mutated genes in E0771 cells as compared to normal mammary fatpad of C57BL/6J female mice. Efficacy is seen in both AAV-Vector and AAV-PCAVac, where AAV-PCAVac has stronger anti-tumor effect. Log-rank test p values were shown for comparison of survival curves.

FIG. 19 is a table showing a summary of treatment responses of PBS, AAV-Vector, and AAV-PCAVac in E0771 TNBC syngeneic orthotopic model in C57BL/6J host.

FIG. 20 is a table showing a summary of treatment responses of PBS, AAV-Vector, and AAV-PCAVac in a two-side tumor induction E0771 TNBC syngeneic orthotopic model in C57BL/6J host.

FIG. 21 is a table showing a summary of E0771 tumor re-challenge after complete regression of first E0771 tumor with AAV-treatment in a syngeneic orthotopic TNBC model in C57BL/6J host.

FIG. 22 illustrates the Precision ("Personalized") AAV-PCAVac system as a therapeutic vaccine against TNBC. Efficacy of AAV-PCAVac multiplexed endogenous gene activation was demonstrated in a syngeneic orthotopic model in C57BL/6J host. Survival curve of E0771 TNBC engrafted in the mammary fatpad of C57BL/6J female mice, treated with PBS, AAV-Vector, AAV-Emut11 library or AAV-PCAVac library. The Emut11 library targets a set of top 11 mutated genes in E0771 cells. Efficacy is seen in both AAV-Vector, AAV-Emut11 and AAV-PCAVac, where AAV-PCAVac has strongest anti-tumor effect. Log-rank test p values were shown for comparison of tumor growth curves to PBS group. * p<0.05;  p<0.01; * p<0.001.

Figures 23, 24:
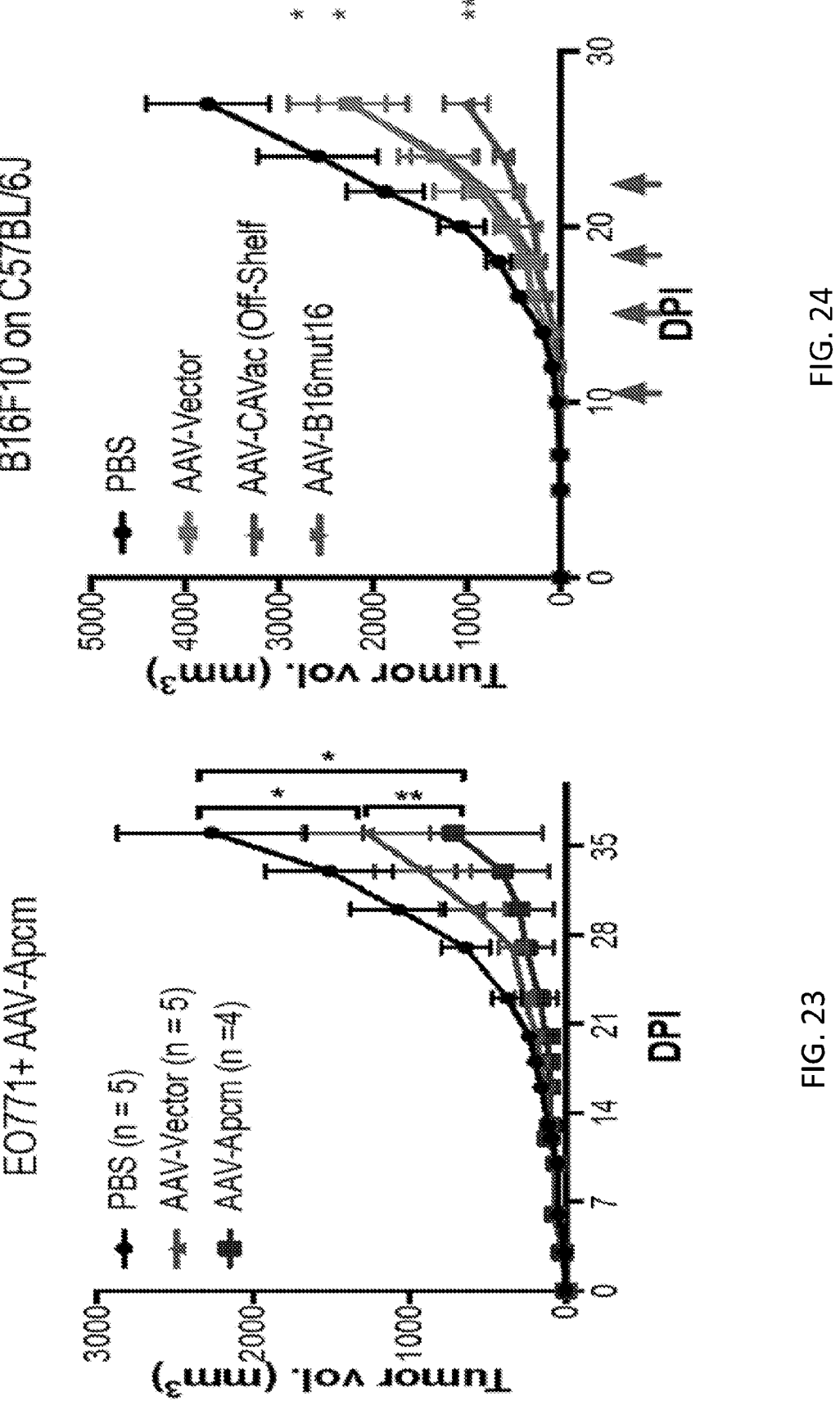

FIG. 23 illustrates an off-the-shelf AAV-APCM system as a therapeutic vaccine. Efficacy of AAV-APCM multiplexed endogenous gene activation is demonstrated in a syngeneic orthotopic model in C57BL/6J host. Shown is a tumor growth curve of E0771 TNBC engrafted in the mammary fatpad of C57BL/6J female mice, treated with PBS, AAV-Vector, or AAV-Apcm library, which targets a small set of genes chosen to elicit immune response (36 genes, 107 sgRNAs). Efficacy is seen in both AAV-Vector and AAV-Apcm, where AAV-Apcm has stronger anti-tumor effect Log-rank test, * p<0.05; ** p<0.01.

FIG. 24 illustrates an off-the-shelf whole-genome AAV-CAVac system as a therapeutic vaccine against melanoma. Therapeutic efficacy of whole-genome gene activation AAV-CAVac (i.e. AAV-SAM) against established orthotopic syngeneic B16F10 tumors by intratumoral administration is demonstrated. Growth curves of orthotopic transplanted B16F10 tumors in C57BL/6J mice treated with PBS and AAV-CAVac at indicated times (arrows) are shown. Log-rank test, * p<0.05; ** p<0.01.

Figures 25, 26:
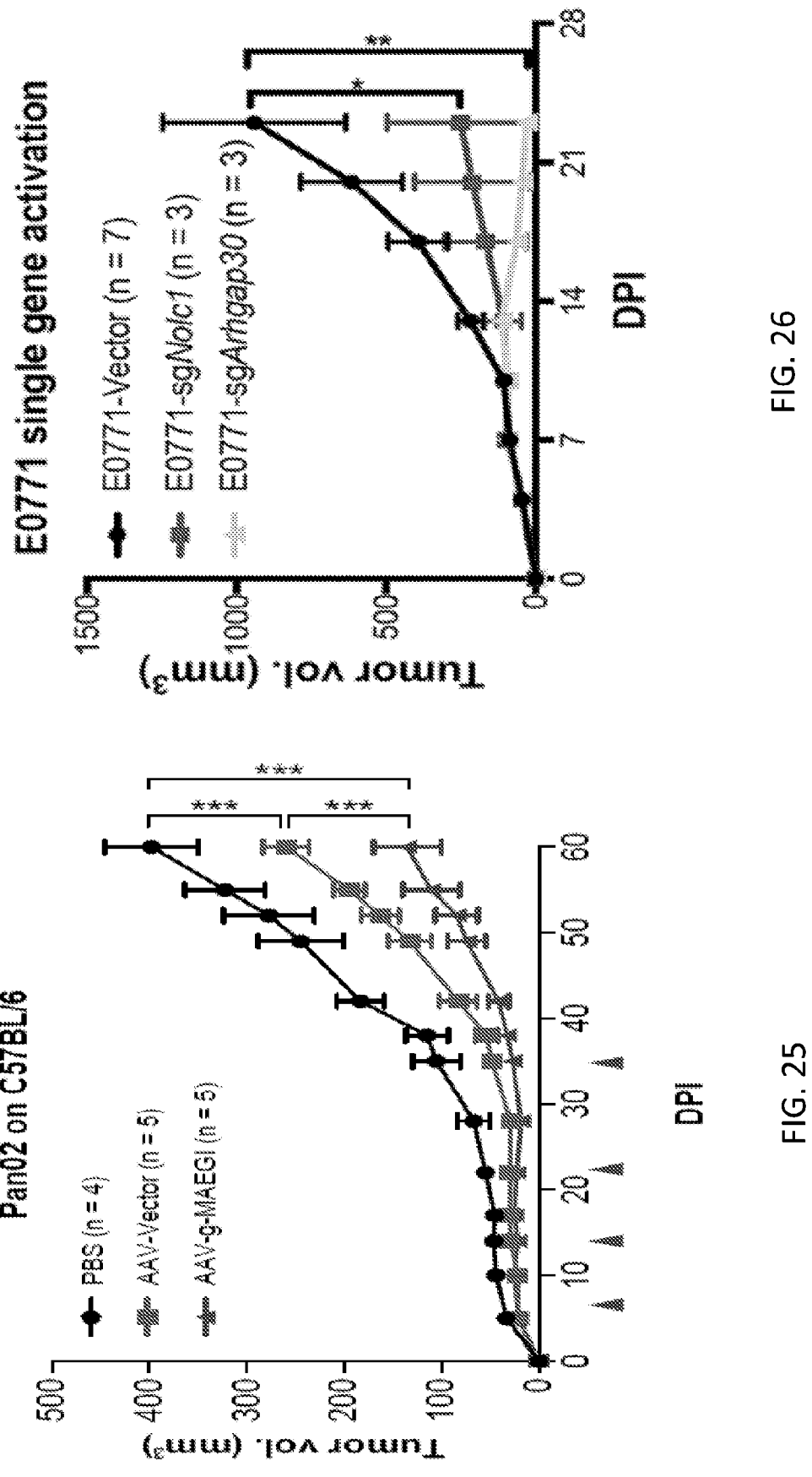

FIG. 25 illustrates an off-the-shelf whole-genome AAV-CAVac system as a therapeutic vaccine against pancreatic cancer. Therapeutic efficacy of whole-genome gene activation AAV-CAVac (also referred to as AAV-g-MAEGI) against established orthotopic syngeneic Pan02 tumors by intratumoral administration is demonstrated. Growth curves of subcutaneous transplanted Pan02 tumors in C57BL/6J mice treated with PBS, AAV-Vector and AAV-CAVac (AAV-g-MAEGI) at indicated times (arrows) are shown. (PBS treated mice, n=4; AAV-vector treated mice, n=5; AAV-g-MAEGI treated mice, n=5). Two-way ANOVA: AAV-Vector vs. PBS, p<0.0001; AAV-g-MAEGI vs. PBS, p<0.0001; AAV-g-MAEGI vs. AAV-Vector, p<0.0001. Asterisks:* p<0.05;  p<0.01, * p<0.001.

FIG. 26 illustrates an off-the-shelf AAV-SingleCAVac system as a prophylatic vaccine. Efficacy of AAV-Single-CAVac endogenous gene activation in a syngeneic orthotopic model in C57BL/6J host is demonstrated. Shown are growth curves of Arhgap30 or Nolc1 activated E0771 cell induced syngeneic orthotopic tumor. As compared to vector transduced cells, sg-Arhgap30 or sg-Nolc1 transduced E0771 cells generated tumors that grew slower and often got rejected by the C57Bl/6J host. Two-way ANOVA using Tukey's multiple comparisons test for the following comparisons: sg-Arhgap30 vs. vector, p=0.0003 and p<0.0001 for dpi 20 and 23, respectively; sg-Nolc1 vs. vector, p=0.0123 and p=0.0002 for dpi 20 and 23, respectively. Two-sided Kolmogorov-Smirnov (KS) test for the following comparisons: sg-Arhgap30 vs. vector, p=0.003; sg-Nolc1 vs. vector, p=0.02. * p<0.05; ** p<0.01.

FIG. 27 is a table illustrating the sgRNA sequences for an AAV-Apcm library (SEQ ID NOs: 23,779-23,885).

FIGS. 28A-28B are a set of tables illustrating the sgRNA sequences of an AAV-Apch library (SEQ ID NOs: 23,886-24,104).

FIGS. 29A-29D illustrate multiplexed activation of endogenous genes as an immunotherapy (MAEGI) in a cellular formulation. FIG. 29A shows schematics for generating genome-scale CRISPR activation (SAM) sgRNA library-transduced cells and analysis of tumorigenic capacity. FIG. 29B shows tumor growth curves of Vector or SAM transduced E0771-dCas9-VP64-MPH cells (E0771-Vector or E0771-SAM). As compared to vector transduced cells (n=8), orthotopic tumors from E0771-SAM cells (n=50) were robustly rejected by the C57BL/6J host. Two-way ANOVA: p<0.0001. FIG. 29C shows tumor growth curves of E0771-SAM cells in syngeneic immunocompetent mice (C57BL/6J, n=5) and two strains of immunodeficient mice (Nu/Nu, n=4; Rag1$^{-/-}$, n=5). Two-way ANOVA: C57BL/6J vs. Nu/Nu, p<0.0001; C57BL/6J vs. Rag1$^{-/-}$, p<0.0001; Nu/Nu vs. Rag1$^{-/-}$, p<0.0001. FIG. 29D shows tumor growth curves of E0771-SAM cells under T cell depletion. Whereas tumors from E0771-SAM cells (n=11) were quickly rejected in C57BL/6J mice, depletion of T cells by α-CD4 and α-CD8 (n=4) enabled rapid tumor growth. Two-way ANOVA test, untreated vs. α-CD4+α-CD8 treated, p<0.0001.

Figures 30A, 30B, 30C, 30D, 30E:
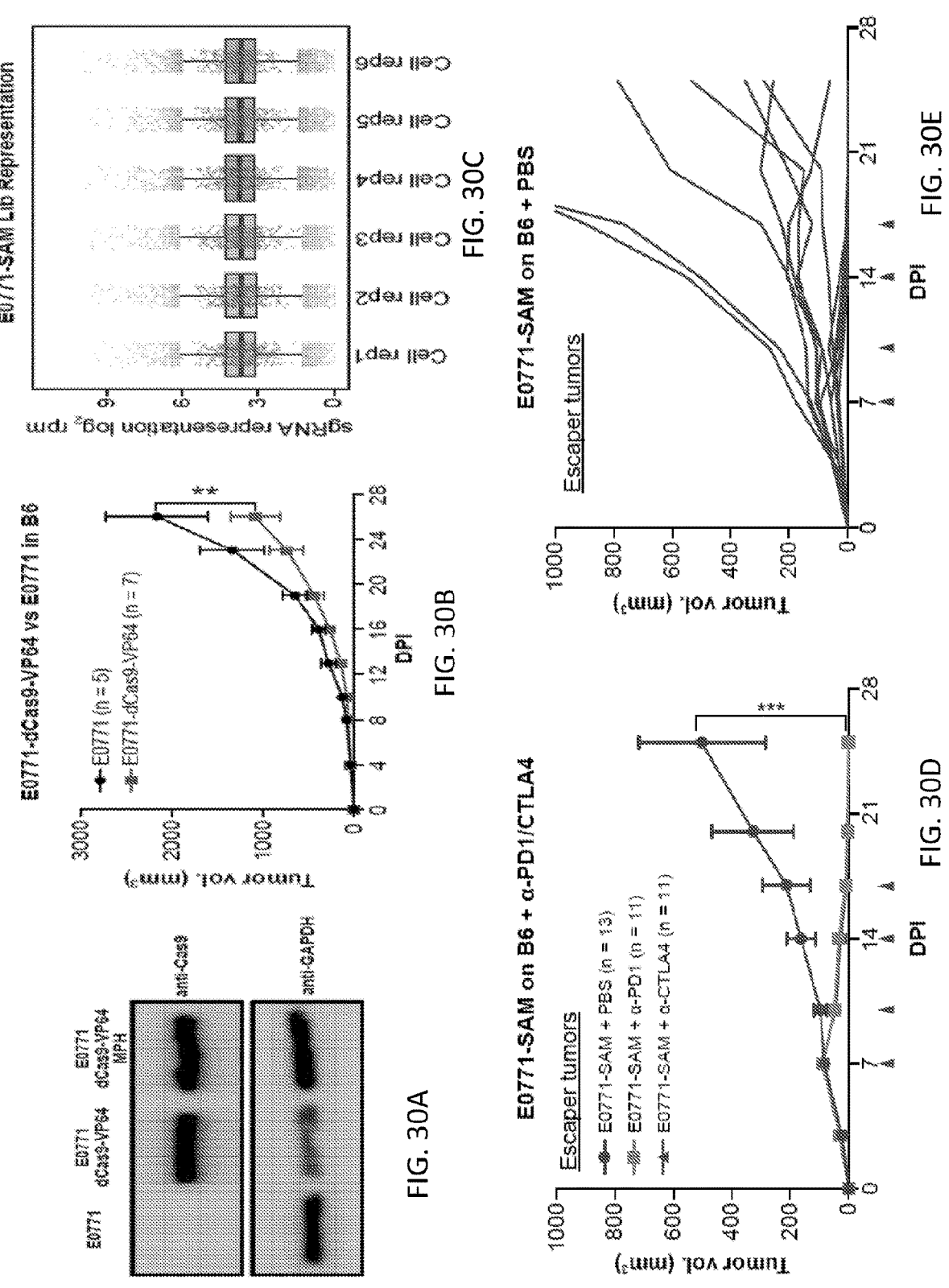
Figures 30F, 30G:
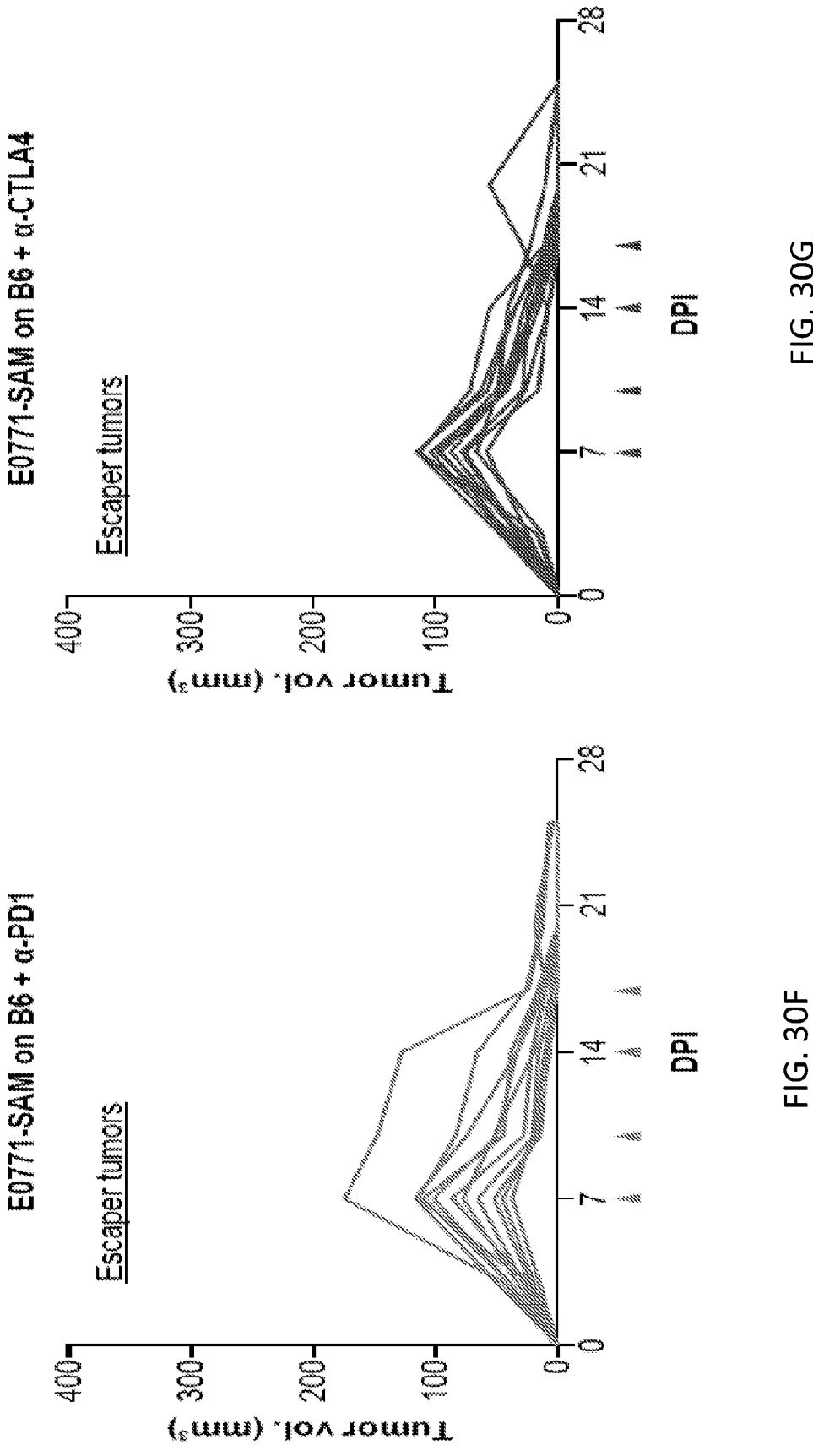

FIGS. 30A-30G illustrate characterization of cells transduced with the CRISPRa system, and escaper tumors formed by CRISPRa library-transduced cells are sensitive to checkpoint antibodies. FIG. 30A shows the expression of dCas9 protein in E0771-dCas9-VP64 and E0771-dCas9-VP64-MPH cell lines confirmed by western blot using a monoclonal antibody against Cas9. Anti-GAPDH was used as an internal control. FIG. 30B shows tumor growth curves of parental E0771 cells compared to E0771 cells transduced to express dCas9-VP64. Two-way ANOVA: p=0.0023. FIG. 30C shows library representation of genome-scale mouse CRISPRa (SAM) library-transduced E0771 cells from 6 infection replicates from two independent experiments. Out of the 66,749 sgRNAs in the library, the six replicates cover from 99.44% to 99.69% of the total sgRNAs. FIG. 30D shows growth curves of E0771-SAM escaper tumors in C57BL/6J mice, either PBS-treated (n=13), or treated by checkpoint blockade antibodies α-PD1 (n=11) or α-CTLA4 (n=11). Arrows indicate time points of treatment. When treated with either α-PD1 (n=11) or α-CTLA4 (n=11), all E0771-SAM transplanted C57BL/6J mice rejected the tumors. Two-way ANOVA: p=0.0003 for PBS vs. α-PD1 or α-CTLA4. (FIGS. 30E-30G) (Related to FIG. 30D) show spider plot growth curves of E0771-SAM escaper tumors in C57BL/6J mice, either (FIG. 30E) PBS-treated (n=13), or treated by checkpoint blockade antibodies (FIG. 30F) α-PD1 (n=11) or (FIG. 30G) α-CTLA4 (n=11). Arrows indicate time points of treatment. Over the duration of study (28 dpi), 5/13 E0771-SAM escaper tumors were eventually rejected by PBS-treated mice, while 8/13 either grew larger or remained sizable tumors. All α-PD1 (11/11) and α-CTLA4 (11/11) treated mice completely rejected E0771-SAM tumors. Error bars: All data points in this figure were presented as mean±s.e.m. Asterisks: * p<0.05,  p<0.01, * p<0.001.

Figures 31A, 31B, 31C:
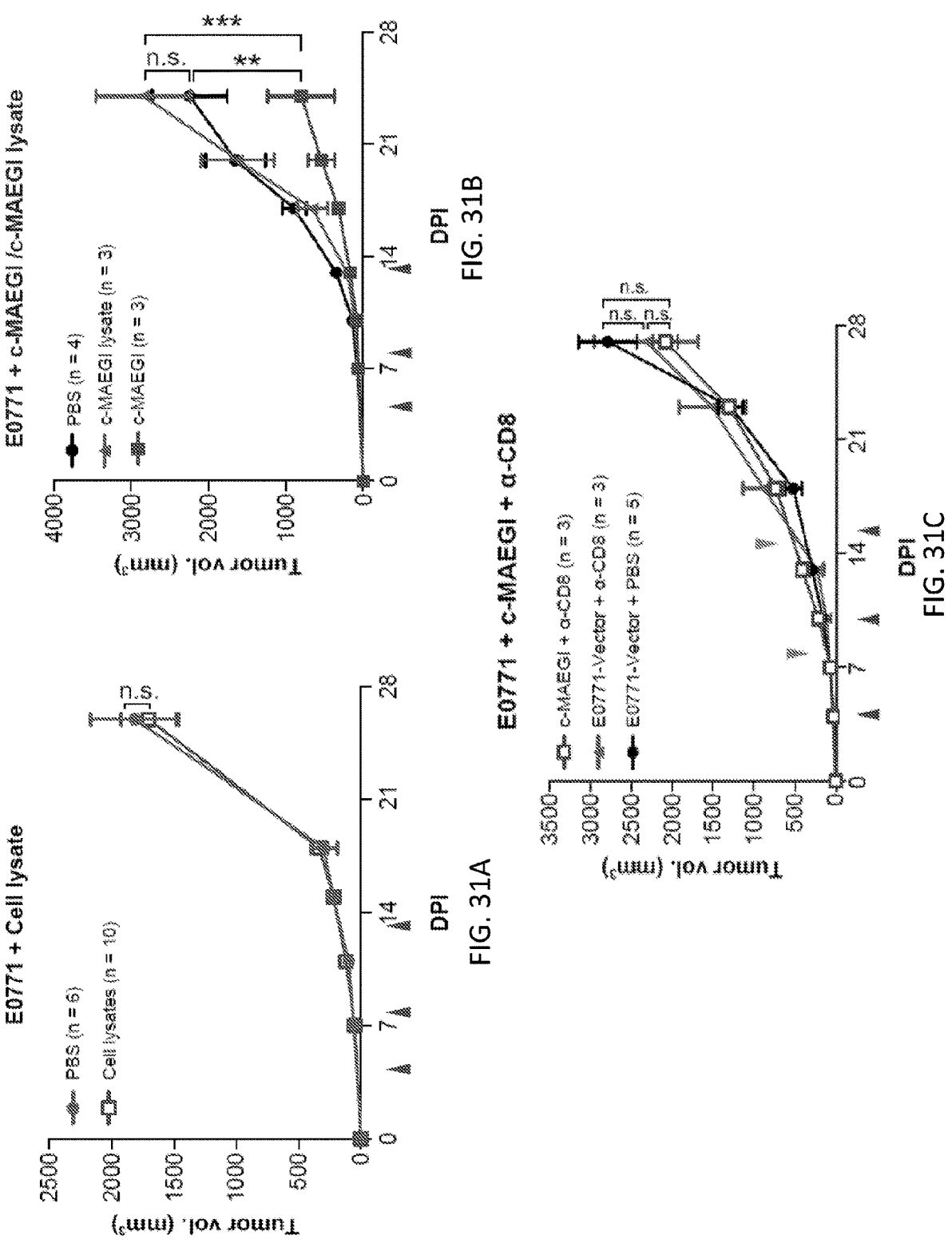
Figure 31D:
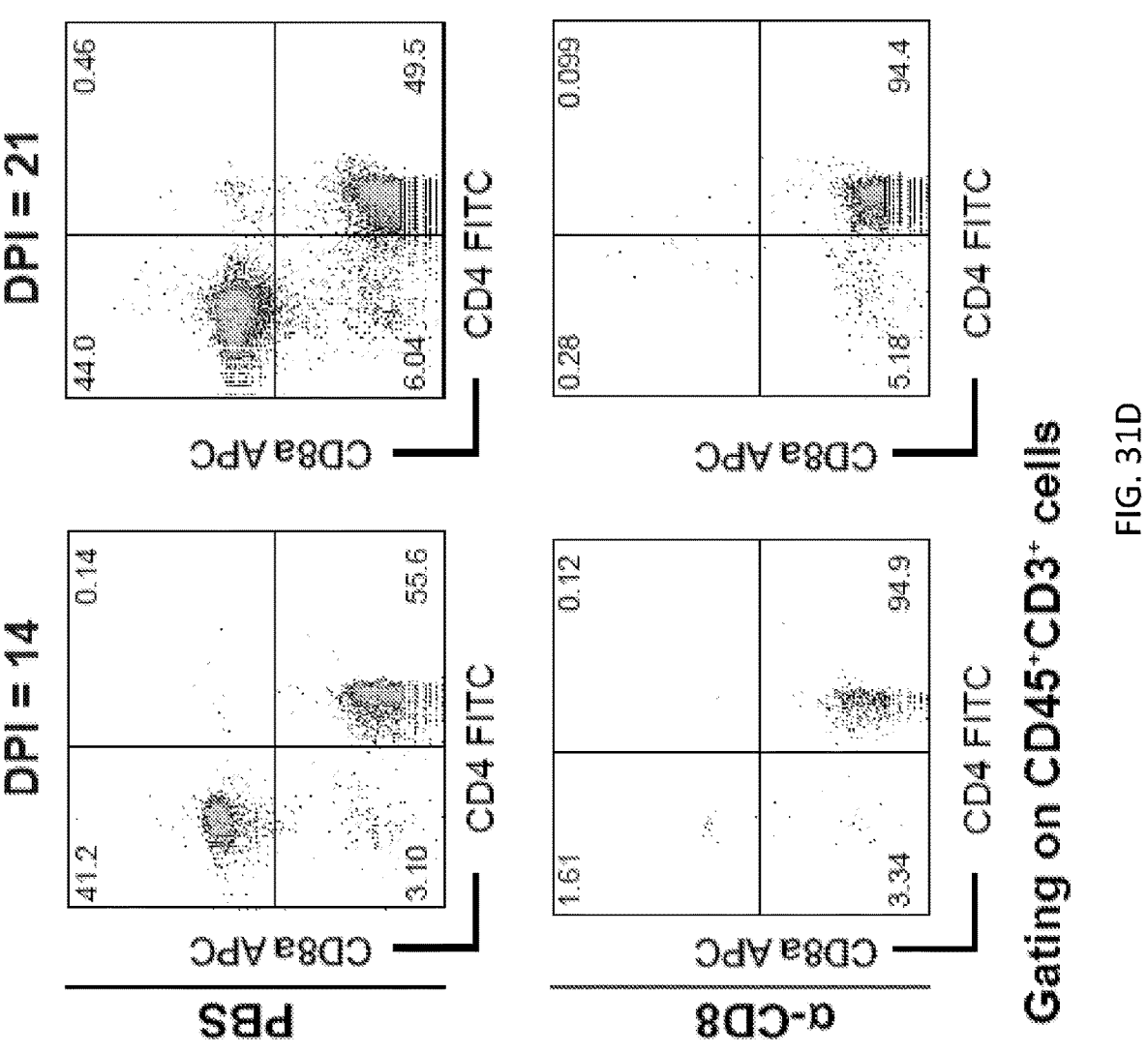
Figures 31E, 31F, 31G:
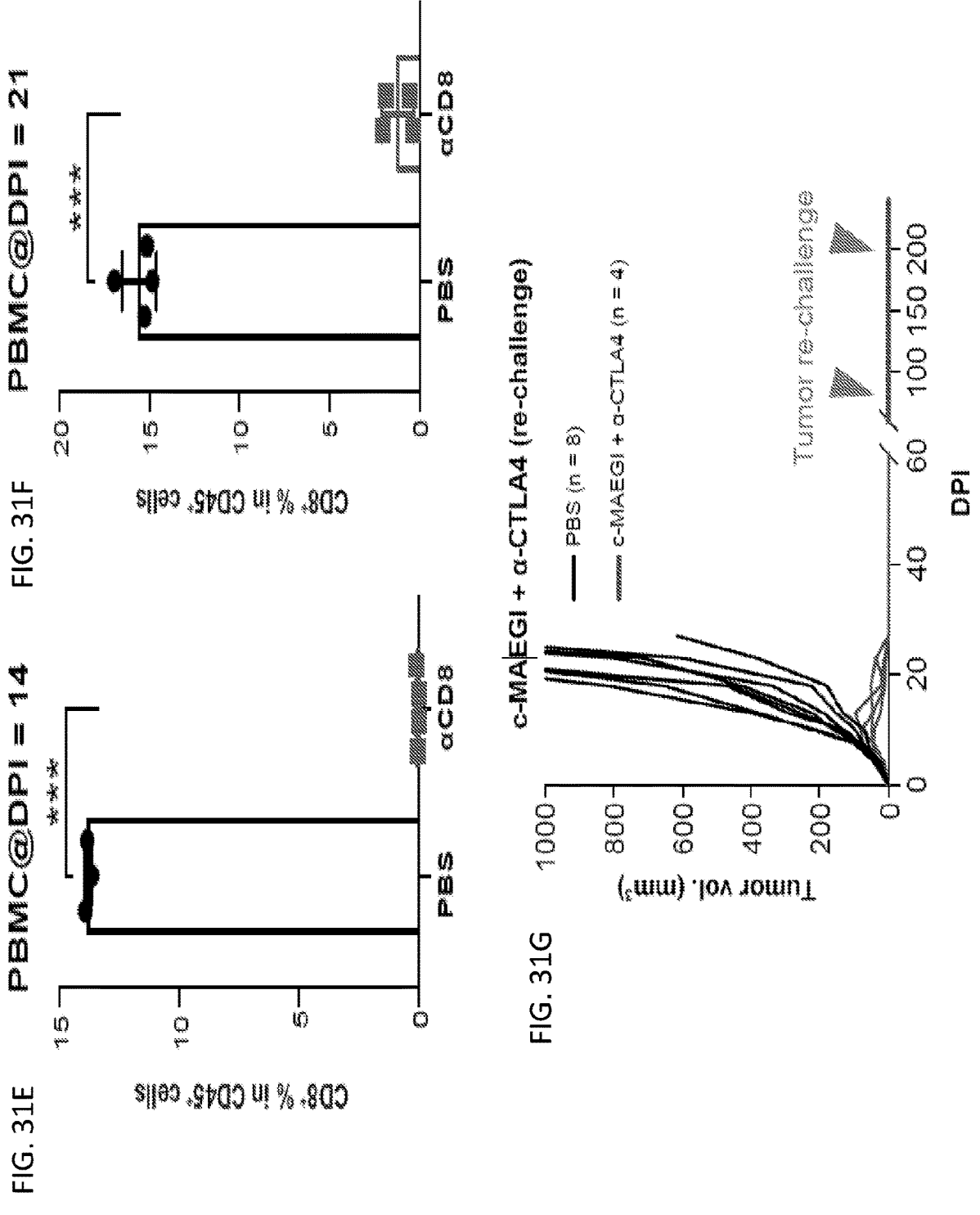

FIGS. 31A-31G illustrate thermally-induced cell lysis or CD8+ T cell depletion abolishes the therapeutic effect of c-MAEGI. FIG. 31A shows results from testing the therapeutic effect of heat-induced cell lysates from non-transduced E0771 against established syngeneic orthotopic E0771 tumors. Tumor-bearing mice were treated with PBS or E0771 lysate at indicated times (arrows). (PBS treated mice, n=6; E0771 lysate, n=10). Two-way ANOVA: p=0.8916. FIG. 31B shows a comparison of the therapeutic effects of c-MAEGI and heat-induced lysates of c-MAEGI against established syngeneic E0771 tumors. Tumor-bearing mice were treated with PBS, c-MAEGI, or c-MAEGI lysates at indicated times (arrows). (PBS treated mice, n=4; c-MAEGI, n=3; c-MAEGI lysates, n=3). Two-way ANOVA: PBS vs. c-MAEGI, p=0.0004; PBS vs. c-MAEGI lysates, p=0.8856; c-MAEGI lysates vs. c-MAEGI, p=0.0007. FIG. 31C shows tumor growth curves of E0771-Vector derived tumors that were treated with PBS, α-CD8, or c-MAEGI+ α-CD8. Dark grey arrows: c-MAEGI treatment; light grey arrows: α-CD8 treatment. CD8+ T cell depletion abolished the effect of c-MAEGI against established syngeneic E0771 tumors. Two-way ANOVA: PBS vs α-CD8, p=0.9744; PBS vs. c-MAEGI+α-CD8, p=0.6037; α-CD8 vs. c-MAEGI+α-CD8, p=0.705. FIG. 31D shows representative peripheral blood flow cytometry analysis of CD8+ T cells after PBS or α-CD8 treatment, gated on CD45+CD3+ cells. Top row, PBS treatment; bottom row, α-CD8 treatment. Left column, DPI=14; right column, DPI=21. X-axis of scatterplots, CD4; Y-axis of scatterplots, CD8a. Percentages are noted in each quadrant. Over 50,000 PBMCs were analyzed for each sample. FIG. 31E is a bar plot detailing the % of CD8+ T cells among CD45+ PBMCs, 14 days after PBS or α-CD8 treatment. Two-tailed unpaired t-test: PBS vs. α-CD8, p<0.0001. FIG. 31F is a bar plot detailing the % of CD8+ T cells among CD45+ PBMCs, 21 days after PBS or α-CD8 treatment. Two-tailed unpaired t-test: PBS vs. α-CD8, p<0.0001. FIG. 31G is a spider plot of tumor growth curves of syngeneic orthotopic E0771 tumors in C57BL/6J mice, evaluating the combination of c-MAEGI and CTLA4 blockade with extended follow-up and tumor re-challenges. Arrowheads indicate time points of tumor re-challenge, indicating that the anti-tumor responses induced by combining c-MAEGI and α-CTLA4 were long-lasting. Error bars: All data in this figure are presented as mean±s.e.m., with individual data points shown. Asterisks: * p<0.05,  p<0.01, * p<0.001.

Figures 32A, 32B, 32C:
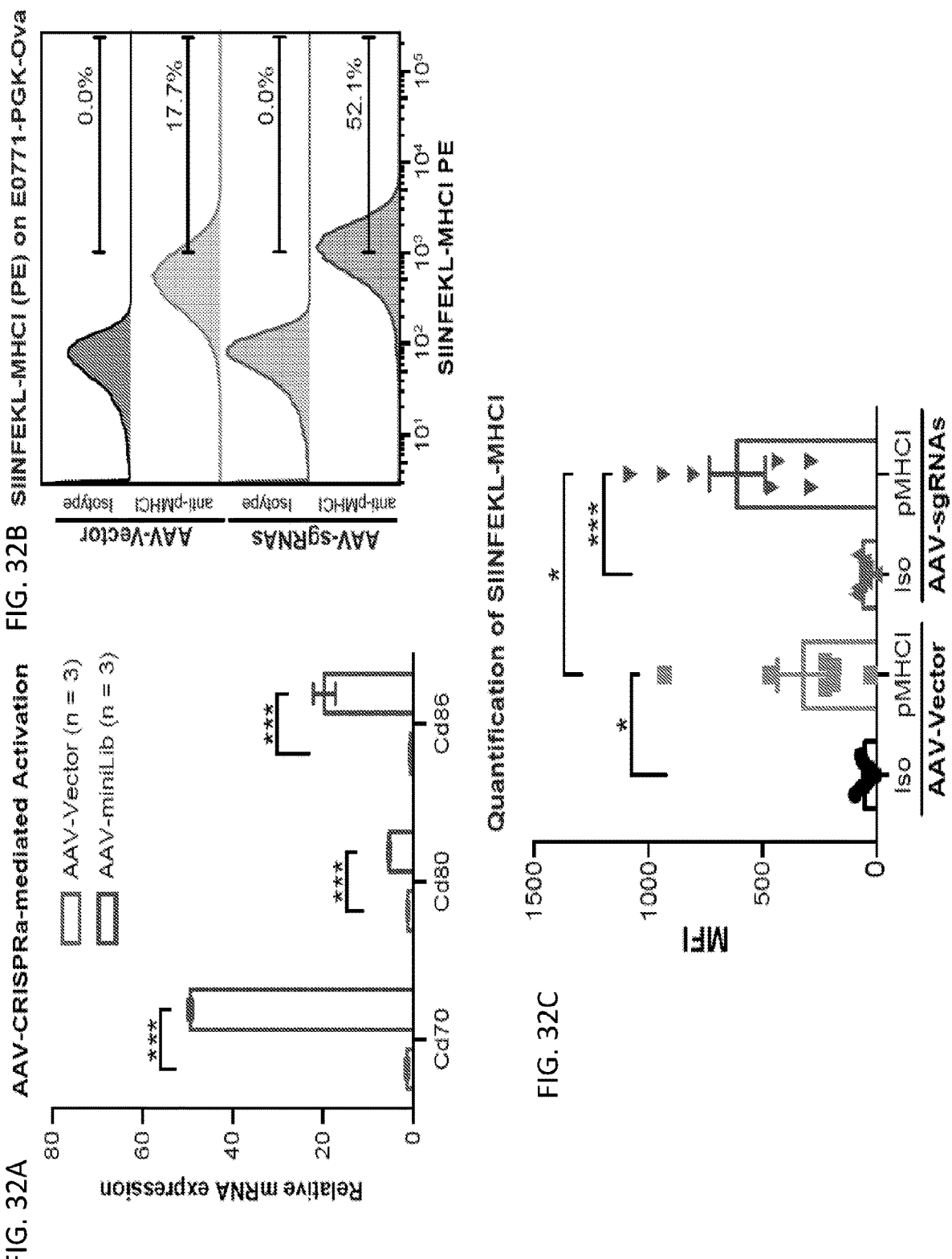

FIGS. 32A-32C illustrate the finding that AAV-CRISPRa system specifically enhances gene expression and cell surface presentation of antigens. FIG. 32A shows AAV-CRISPRa activation of multiple endogenous genes in a pooled manner. The transcript levels of Cd70, Cd80, Cd86 were quantified by qRT-PCR after transducing E0771-dCas9-VP64 cells with either AAV-Vector or AAV-sgRNA-mini-Lib. Two-sided unpaired t-test for sgRNAs vs. vector: Cd70, p<0.0001; Cd80, p=0.0005; Cd86, p<0.0001. FIGS. 32B-32C show AAV-CRISPRa specifically enhances the cell surface presentation of a model antigen in the form of peptide-MHC-I complexes. In cells transduced with lentivirus to express ovalbumin (Ova) under a PGK promoter, AAV-CRISPRa targeted to the PGK promoter augments the presentation of Ova-derived SIINFEKL-MHC-I complex on cell surface. FIG. 32B shows representative flow cytometry analysis of surface staining for SIINFEKL-H-2K$^b$ complex on cells treated with AAV-Vector or AAV-sgRNAs. FIG. 32C shows quantitative analysis of mean fluorescence intensity (MFI) of PE-SIINFEKL-H-2K$^b$ on cells treated with AAV-Vector or AAV-sgRNAs with data from 4 independent experiments. Two sided Mann-Whitney test: SIINFEKL-H-2K$^b$ staining vs. isotype in AAV-Vector, p=0.0146; SIINFEKL-H-2K$^b$ staining vs. isotype in AAV-sgRNAs, p=0.0006; SIINFEKL-H-2K$^b$ staining in AAV-sgRNAs vs. AAV-Vector, p=0.0484.

Figure 33A:
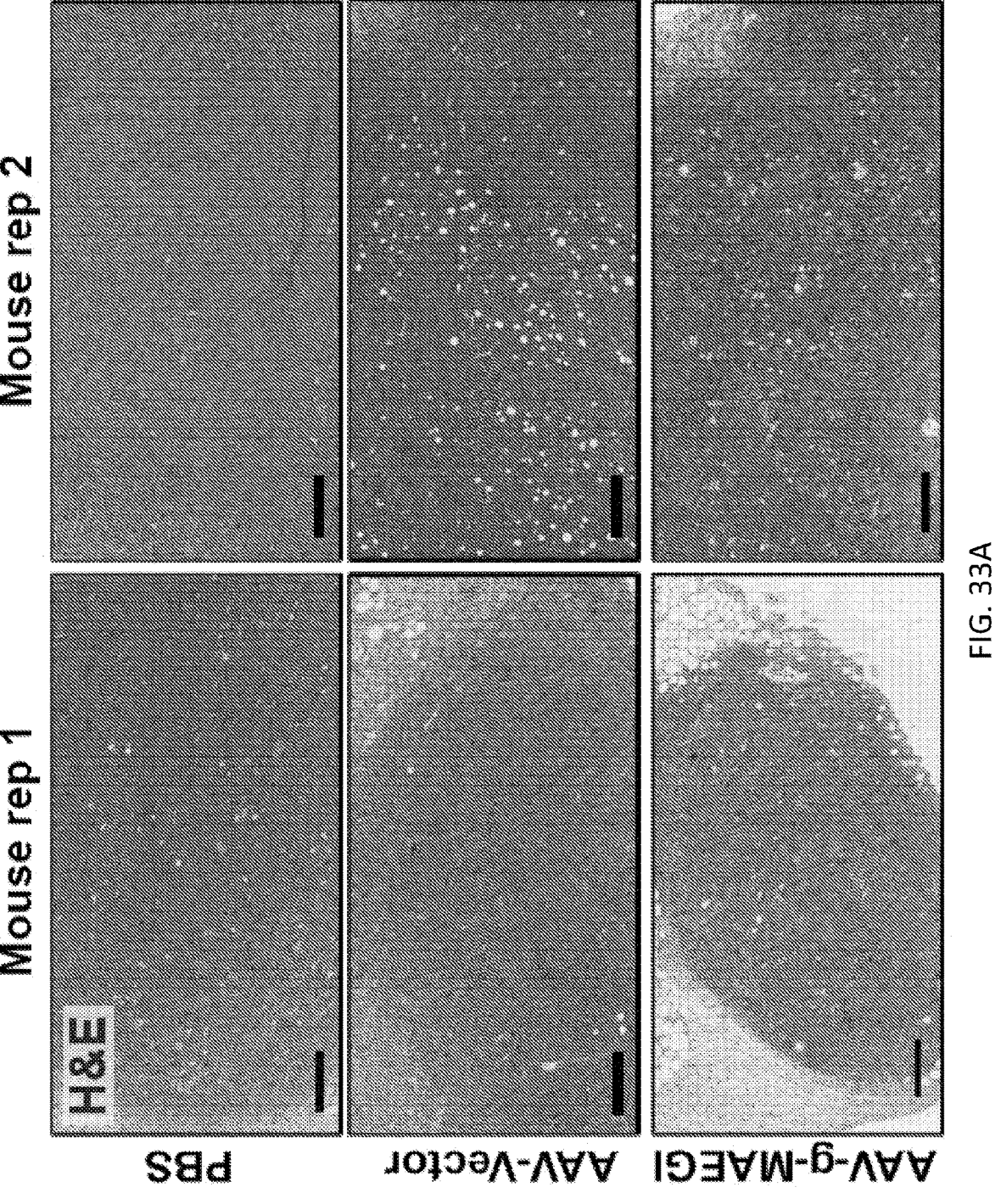
Figure 33B:
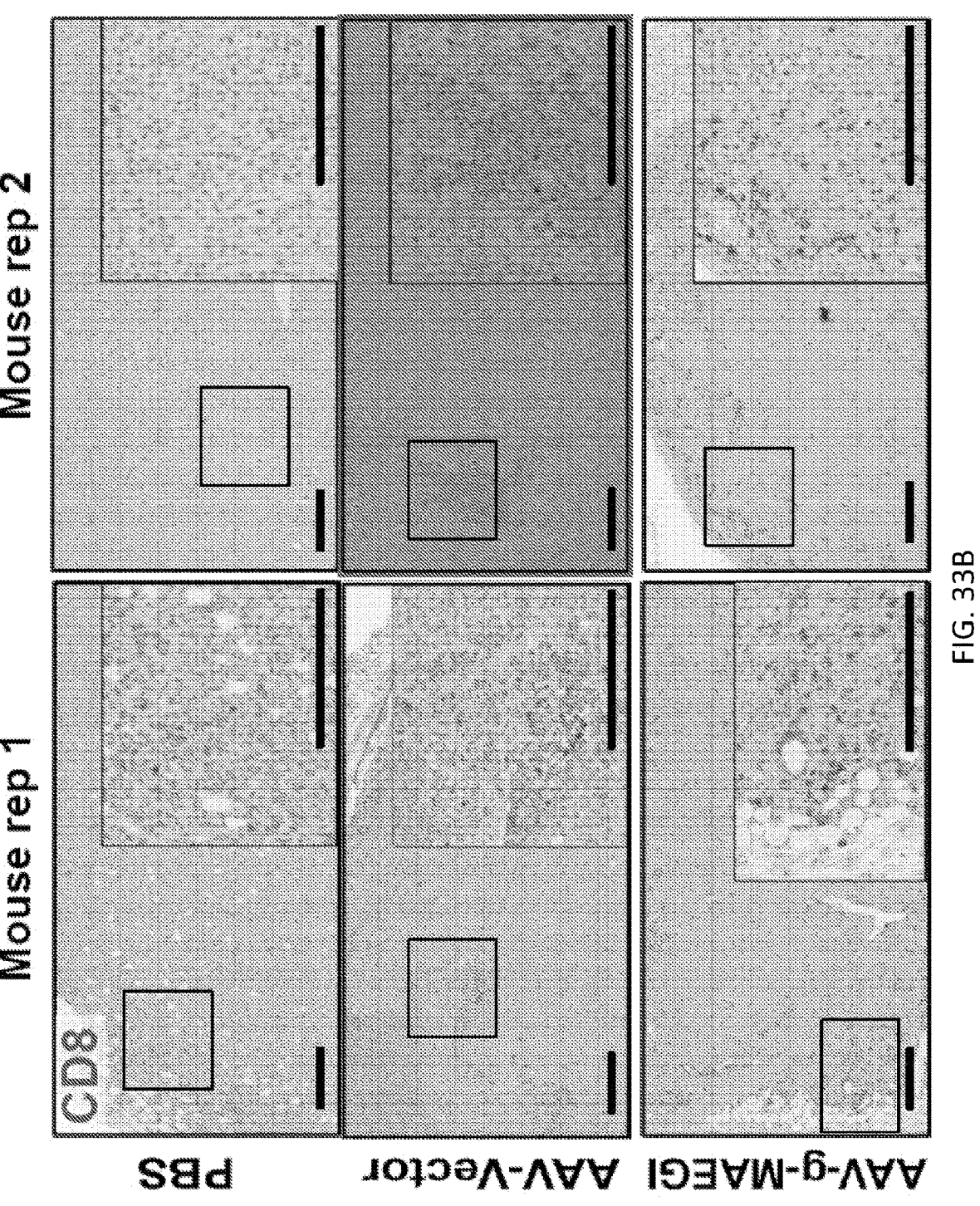
Figures 33C, 33D:
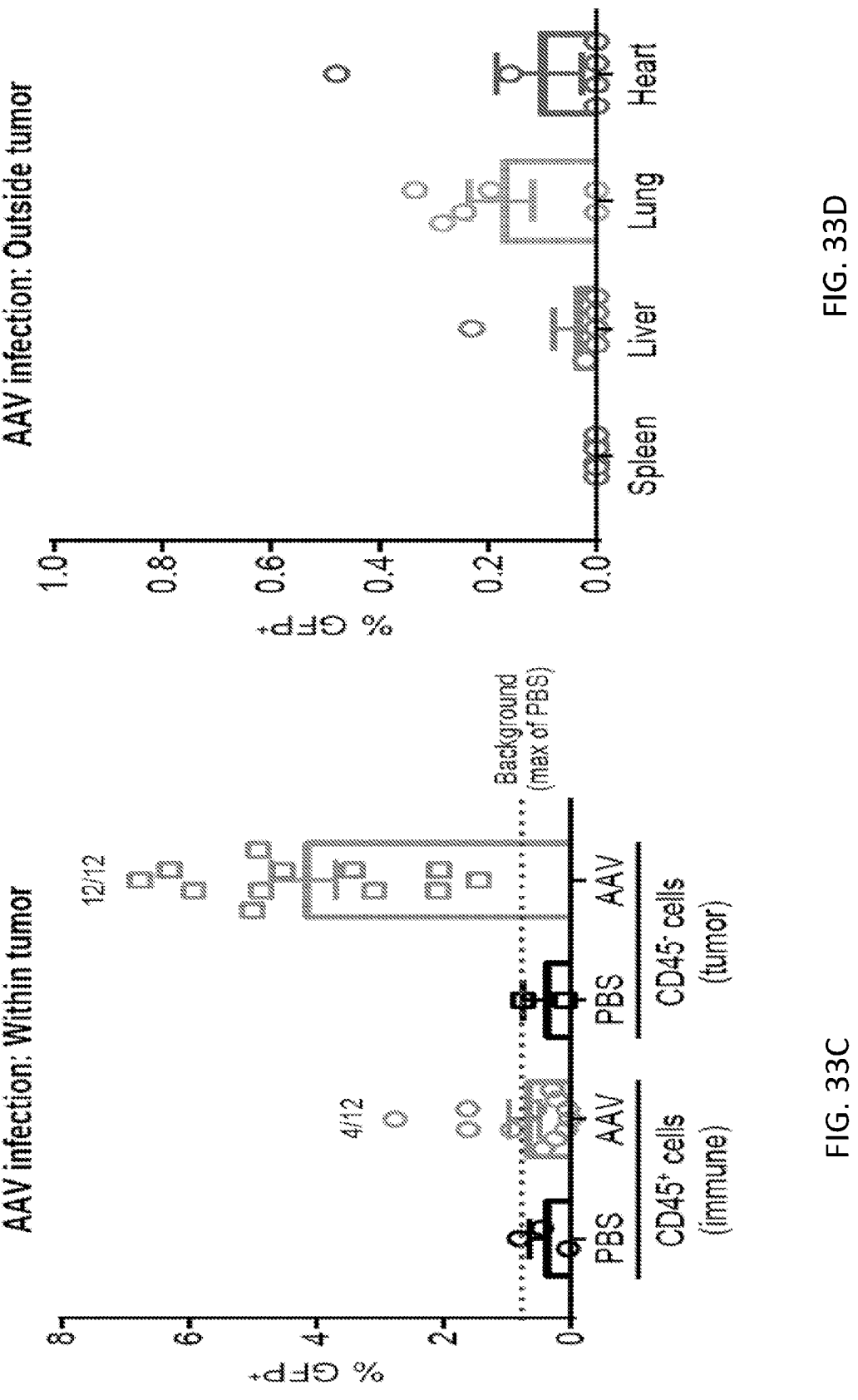

FIGS. 33A-33D illustrate additional characterization of AAV-MAEGI. FIGS. 33A-33B show H&E (FIG. 33A) or CD8 (FIG. 33B) staining of E0771 tumors in mice treated with PBS, AAV-Vector, or AAV-g-MAEGI. (Tumor harvest dpi=31). Scale bars of zoomed-out images and insets=200 μm. FIGS. 33C-33D show AAV infection efficiency assessed by intratumoral delivery of GFP-expressing AAVs and flow cytometry analysis. FIG. 33C shows percentages of GFP+ cells within tumors from mice 4 days after intratumoral injection of PBS (n=3) or AAV-GFP (n=12), grouped by CD45+ and CD45− cells. The background GFP fluorescence was set as the maximum % GFP positivity in PBS samples, denoted by a dashed line. Fractions above AAV conditions denote the number of samples with % GFP positivity above background in the indicated cell population. FIG. 33D shows percentages of GFP+ cells in various organs after intratumoral injection of AAV-GFP (n=6). Error bars: All data in this figure are presented as mean±s.e.m., with individual data points shown. Asterisks: * p<0.05,  p<0.01, * p<0.001.

Figure 34A:
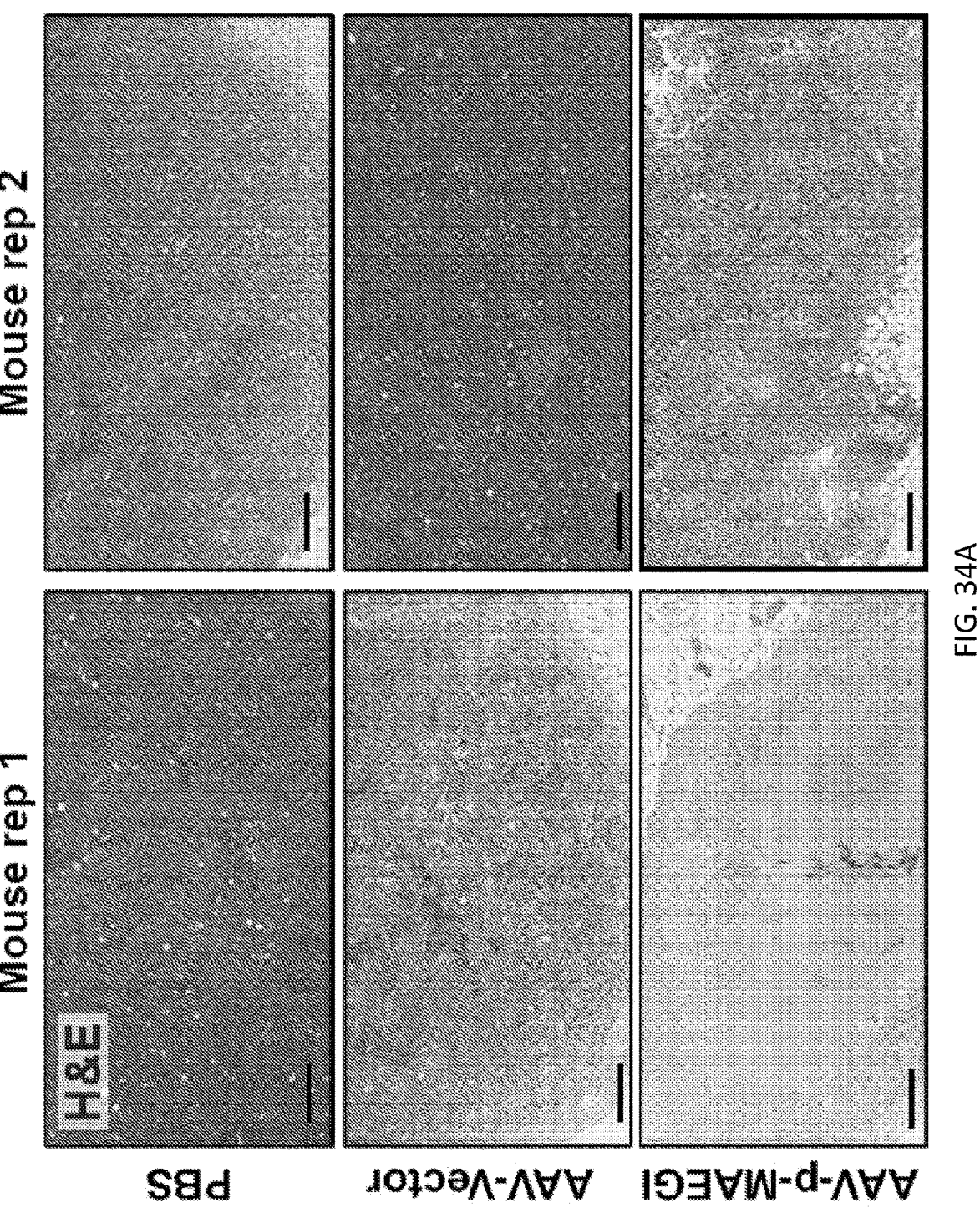
Figure 34B:
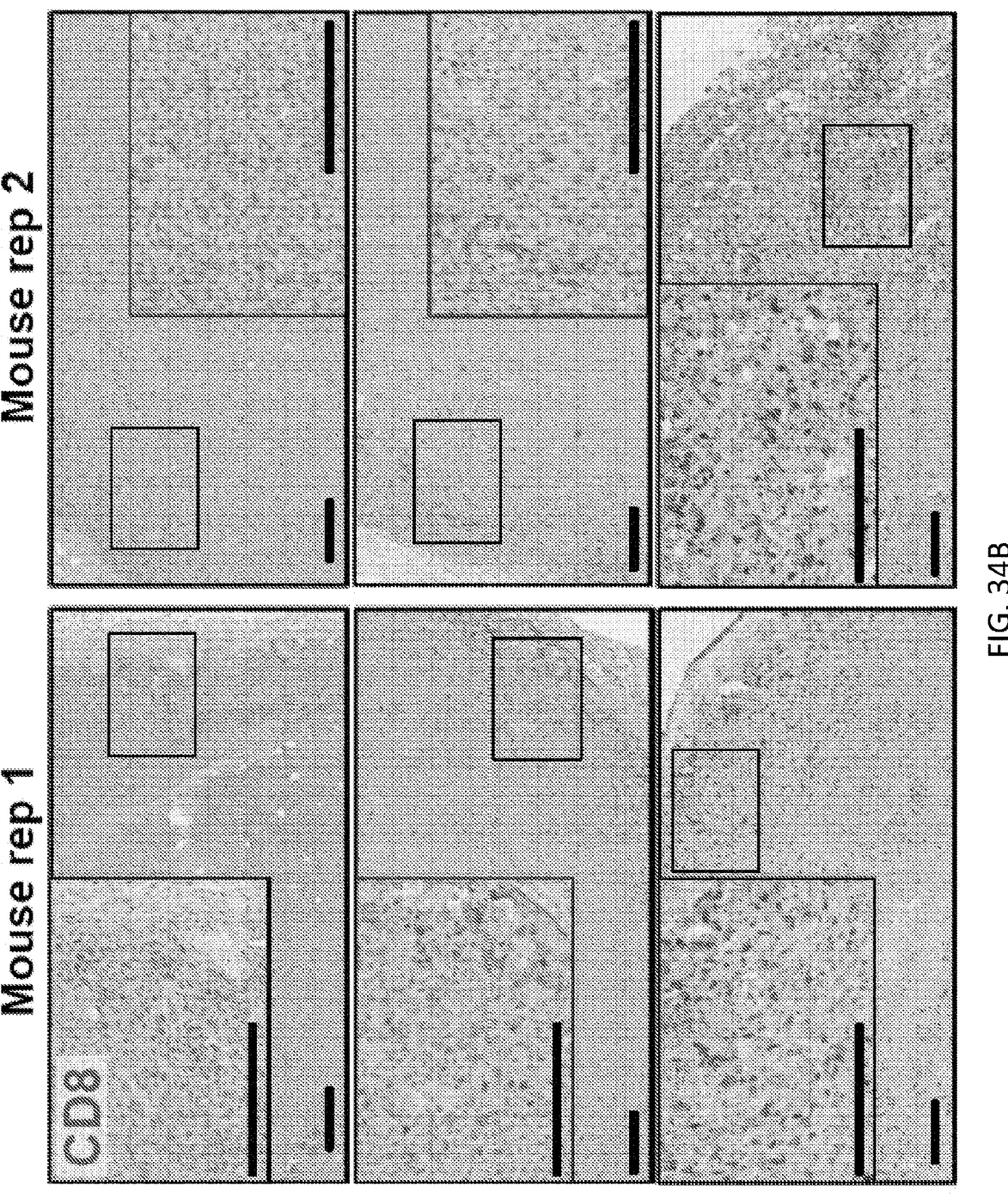
Figure 34C:
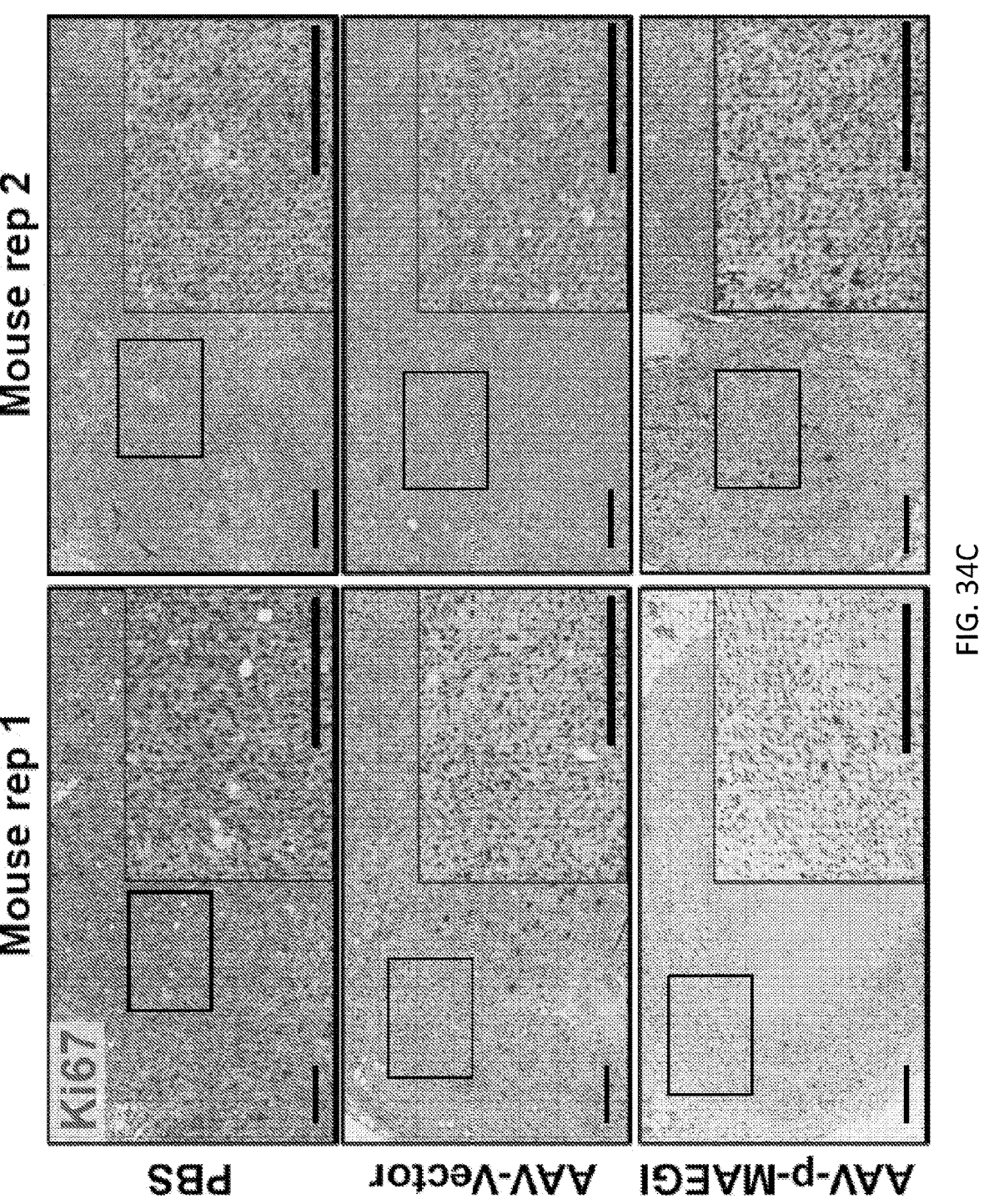
Figure 34D:
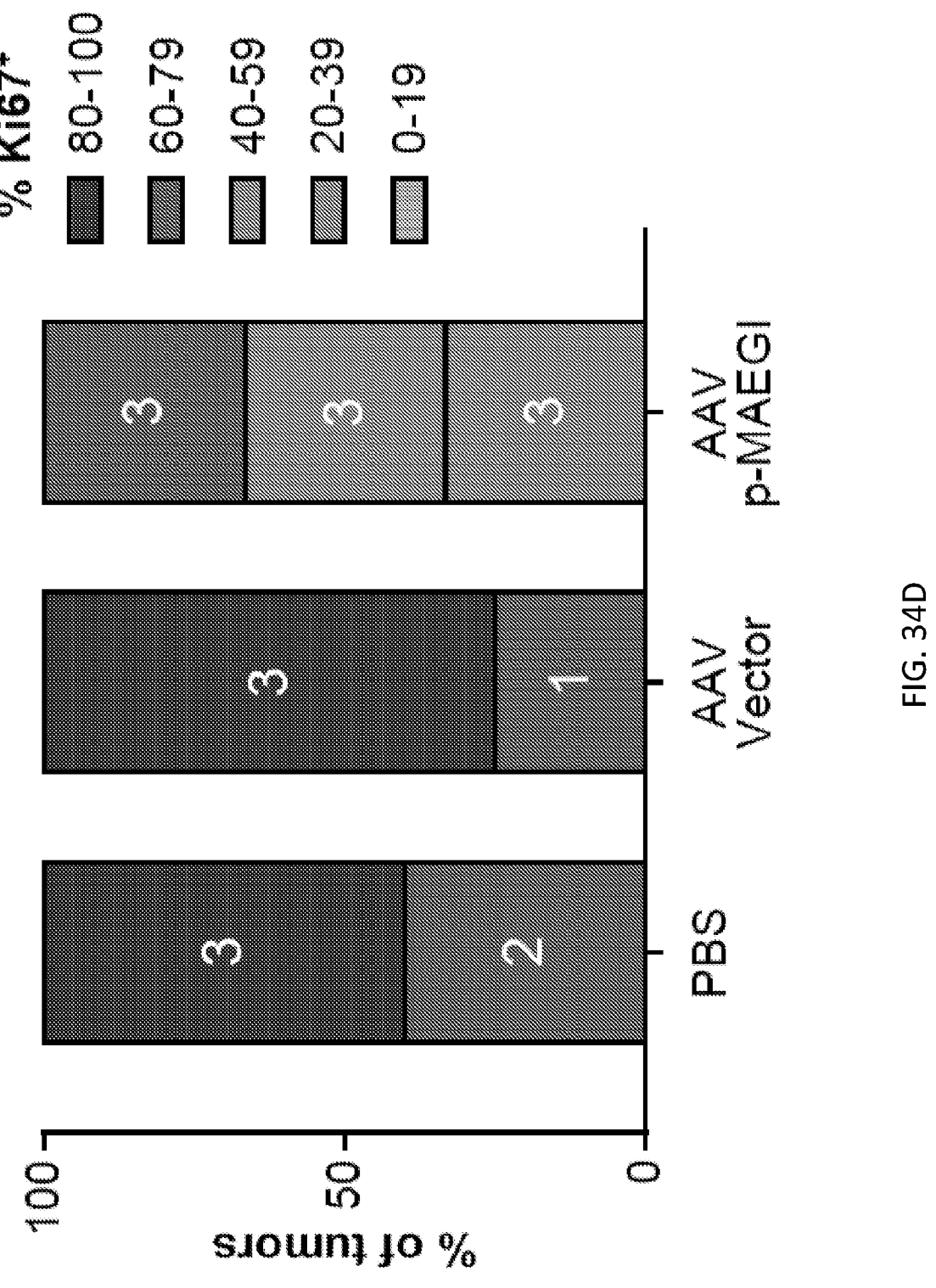

FIGS. 34A-34D illustrate histological characterization of E0771 tumors treated with AAV-p-MAEGI. FIGS. 34A-34C show H&E (FIG. 34A), CD8 (FIG. 34B), or Ki67 (FIG. 34C), staining of E0771 tumors collected from mice treated with PBS, AAV-Vector, or AAV-p-MAEGI. (Tumor harvest dpi=36). FIG. 34D illustrates quantification of % Ki67 positivity in E0771 tumors collected from mice treated with PBS, AAV-Vector, or AAV-p-MAEGI. Scale bars of zoomed-out images and insets=200 m.

Figures 35A, 35B:
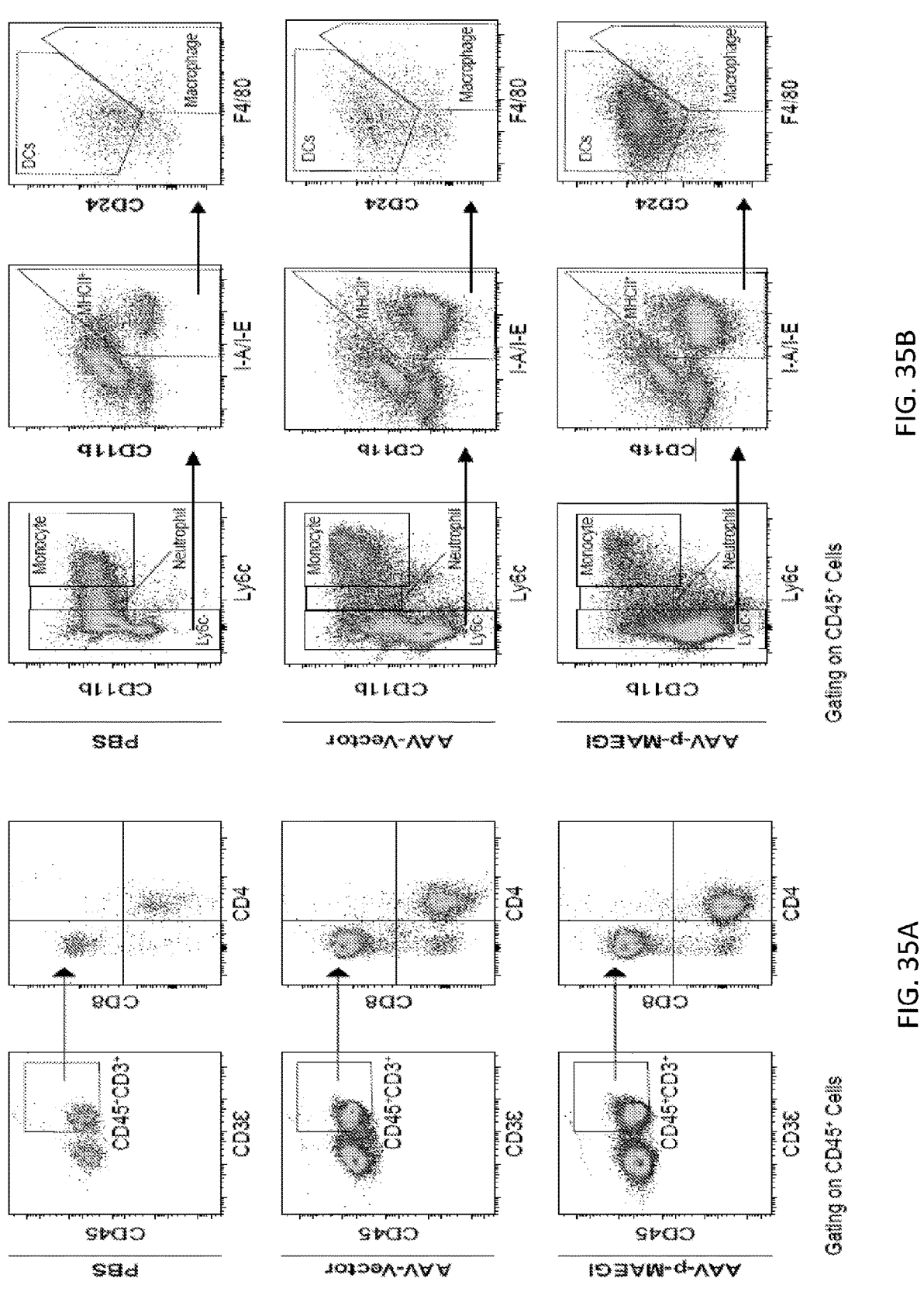

FIGS. 35A-35C illustrate representative flow cytometry gating and CDR3 amino acid sequences from major tumor-infiltrating T cell clones. FIG. 35A shows representative flow cytometry gating of CD45+, CD3+, CD4+, and CD8+ cell populations within tumors from mice treated with PBS, AAV-Vector or AAV-p-MAEGI. FIG. 35B shows representative flow cytometry gating of monocytes, neutrophils, MHCII+ cells, dendritic cells, and macrophages in tumors from mice treated with PBS, AAV-Vector, or AAV-p-MAEGI, 19 days after tumor induction. FIG. 35C shows CDR3 amino acid sequences from major (top 3) clones in three example TIL samples from PBS, AAV-Vector, AAV-g-MAEGI, and AAV-p-MAEGI treated mice.

Figures 36H, 36I:
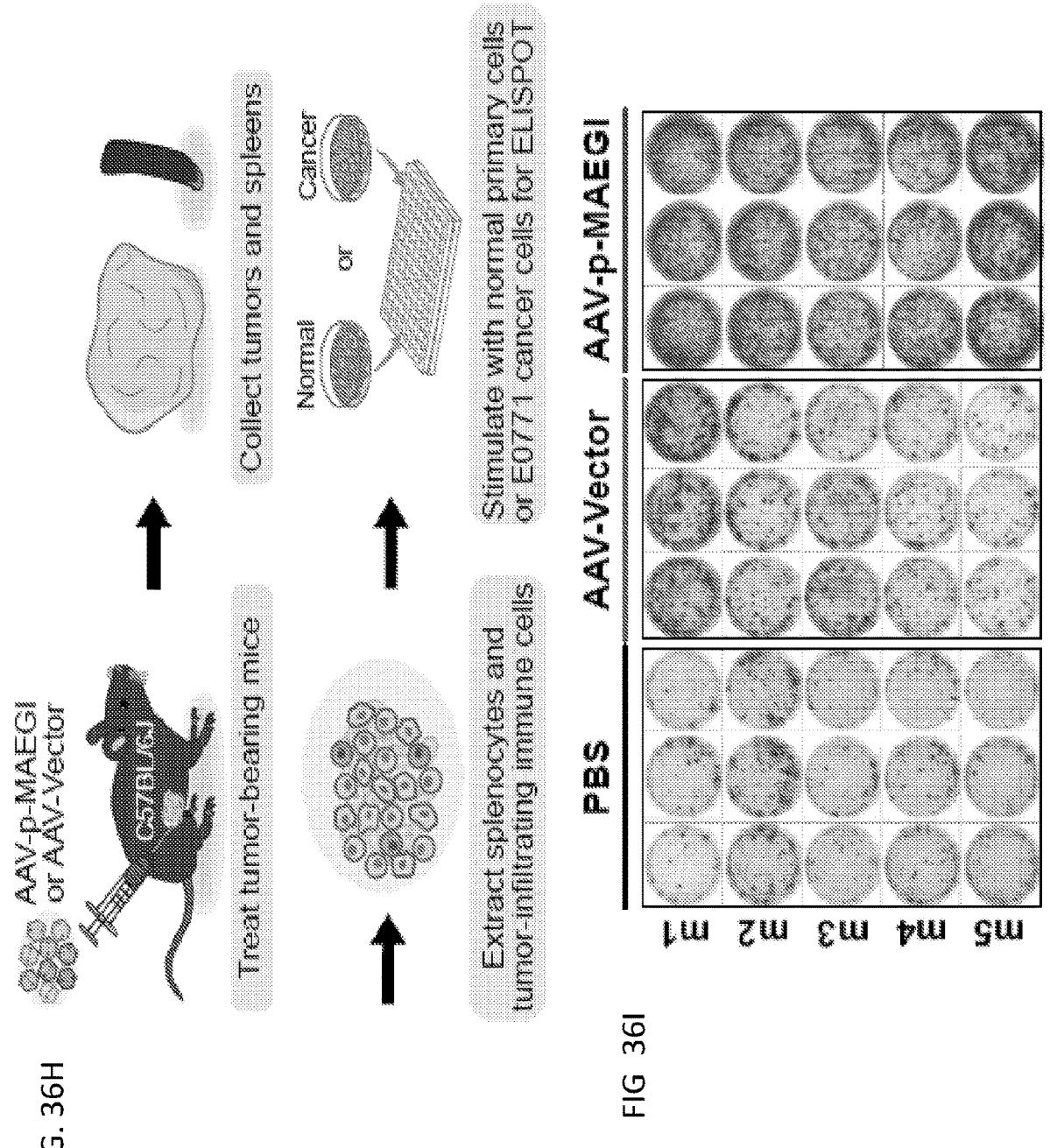

FIGS. 36A-36N illustrate the finding that AAV-p-MAEGI treatment promotes infiltration of tumor-reactive immune populations. FIG. 36A shows AAV-p-MAEGI treatment is associated with increased CD4$^+$ T cell abundance in the tumor microenvironment. Flow cytometry time-course quantification of CD4$^+$ T cells out of total tumor cells from mice treated with PBS, AAV-Vector, or AAV-p-MAEGI. Two-tailed Mann-Whitney test: AAV-p-MAEGI vs. PBS at dpi 9 (p=0.6857), dpi 19 (p=0.0047), dpi 29 (p=0.0048), and dpi 36 (p=0.0015); AAV-p-MAEGI vs. AAV-Vector at dpi 9 (p=0.2000), dpi 19 (p=0.2569), dpi 29 (p=0.0159), and dpi 36 (p=0.0422); FIG. 36B shows AAV-p-MAEGI treatment is associated with increased CD8$^+$ T cell abundance in the tumor microenvironment. Flow cytometry time-course quantification of CD8$^+$ T cells out of total tumor cells from mice treated with PBS, AAV-Vector, or AAV-p-MAEGI. Two-tailed Mann-Whitney test: AAV-p-MAEGI vs. PBS at dpi 9 (p=0.6857), dpi 19 (p=0.0047), dpi 29 (p=0.0005), and dpi 36 (p=0.0014); AAV-p-MAEGI vs. AAV-Vector at dpi 9 (p=0.4857), dpi 19 (p=0.2569), dpi 29 (p=0.0064), and dpi 36 (p=0.0200). FIG. 36C shows percentage of CD45$^+$MHC-II$^+$ antigen presenting cells in tumors from mice treated with PBS, AAV-Vector, or AAV-PCAVac. Two-tailed Mann-Whitney test: AAV-Vector vs. PBS, p=0.0225; AAV-PCAVac vs. PBS, p=0.0001; AAV-PCAVac vs. AAV-Vector, p=0.0147. FIG. 36D shows percentage of dendritic cells in tumors from mice treated with PBS, AAV-Vector, or AAV-PCAVac. Two-tailed Mann-Whitney test: AAV-Vector vs. PBS, p=0.0075; AAV-PCAVac vs. PBS, p=0.0008; AAV-PCAVac vs. AAV-Vector, p=0.0692. FIG. 36E shows percentage of macrophages in tumors from mice treated with PBS, AAV-Vector, or AAV-PCAVac. Two-tailed Mann-Whitney test: AAV-Vector vs. PBS, p=0.6353; AAV-PCAVac vs. PBS, p=0.5532; AAV-PCAVac vs. AAV-Vector, p=0.9229. FIG. 36F shows percentage of monocytes in tumors from mice treated with PBS, AAV-Vector, or AAV-PCAVac. Two-tailed Mann-Whitney test: AAV-Vector vs. PBS, p=0.1471; AAV-PCAVac vs. PBS, p=0.5533; AAV-PCAVac vs. AAV-Vector, p=0.0426. FIG. 36G shows percentage of neutrophils in tumor from mice treated with PBS, AAV-Vector, or AAV-PCAVac. Two-tailed Mann-Whitney test: AAV-Vector vs. PBS, p=0.0559; AAV-PCAVac vs. PBS, p=0.6165; AAV-PCAVac vs. AAV-Vector, p=0.4176. FIG. 36H is a schematic of an experimental design to assess anti-tumor specificity of the immune response elicited by AAV-p-MAEGI. FIG. 36I shows representative images of IRNγ ELISPOTs on splenocytes obtained from five E0771 tumor-bearing mice for each treatment group (PBS, AAV-Vector, and AAV-p-MAEGI). FIG. 36J shows quantification of IFN7 ELISPOTs on splenocytes from PBS (n=7), AAV-Vector (n=6) and AAV-g-MAEGI (n=9) treated mice bearing E0771 tumors. Two sided unpaired t-test: AAV-Vector vs. PBS, p=0.1499; AAV-g-MAEGI vs. PBS, p=0.0006; AAV-g-MAEGI vs. AAV-Vector, p=0.0011. Results shown are from the aggregation of 2 independent experiments. FIG. 36K shows representative images of IFNγ ELISPOTs on splenocytes from AAV-Vector or AAV-p-MAEGI treated mice bearing E0771 tumors, stimulated with either normal primary cells from wildtype C57BL/6J fat pad tissue (Normal) or E0771 cells (Cancer). FIG. 36L shows quantification of IFNγ ELISPOTs on splenocytes from AAV-Vector (n=9) or AAV-p-MAEGI (n=9) treated mice bearing E0771 tumors that were stimulated with primary C57BL/6J normal cells or cancer cells. Two sided unpaired t-test: AAV-p-MAEGI vs. AAV-Vector stimulated by normal cells, p=0.1667; AAV-p-MAEGI vs. AAV- Vector stimulated by E0771 cancer cells, p=0.0057; Cancer vs. Normal cells stimulation within AAV-Vector group, p=0.0004; Cancer vs. Normal cells stimulation within AAV-p-MAEGI group, p=0.0002. Results shown are aggregated from 2 independent experiments. FIG. 36M shows representative images of IFNγ ELISPOTs on tumor-infiltrating immune cells (TIICs) from AAV-Vector or AAV-p-MAEGI treated mice bearing E0771 tumors, stimulated with either primary cells from wildtype C57BL/6J fat pad tissue (Normal) or E0771 cells (Cancer). FIG. 36N shows quantification of IFNγ ELISPOTs for TIICs from AAV-Vector (n=6) or AAV-p-MAEGI (n=6) treated mice bearing E0771 tumors that were stimulated with primary C57BL/6J normal cells or cancer cells. Two-sided unpaired t-test: AAV-p-MAEGI vs. AAV-Vector stimulated by Normal cells, p=0.0577; AAV-p-MAEGI vs. AAV-Vector stimulated by cancer cells, p<0.0001; Cancer vs. Normal cells stimulation for AAV-Vector group, p=0.0175; Cancer vs. Normal cells stimulation for AAV-p-MAEGI group, p<0.0001. Error bars: All data points in this figure are presented as mean±s.e.m. Asterisks: * p<0.05,  p<0.01, * p<0.001.

Figure 37A:
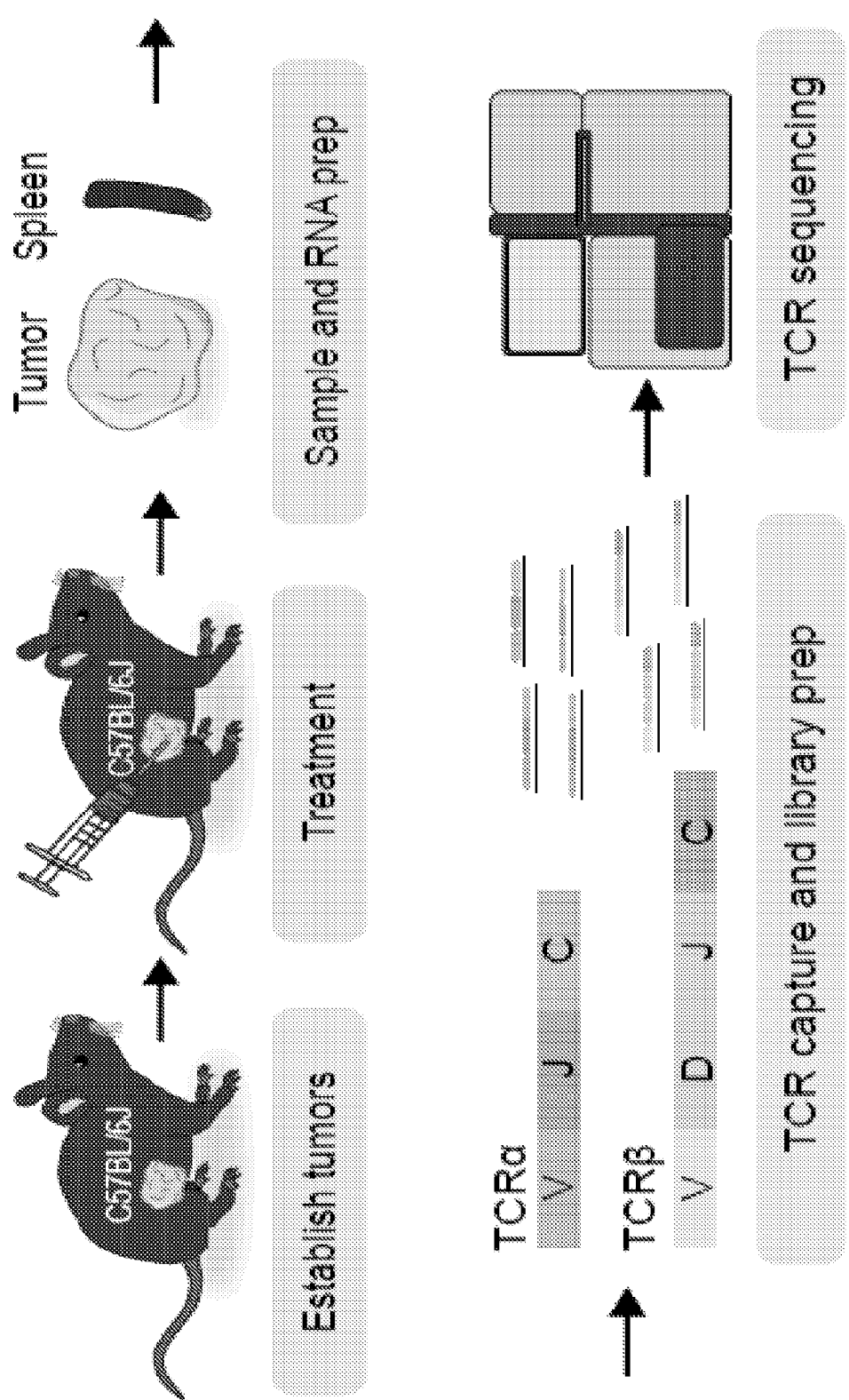
Figure 37B:
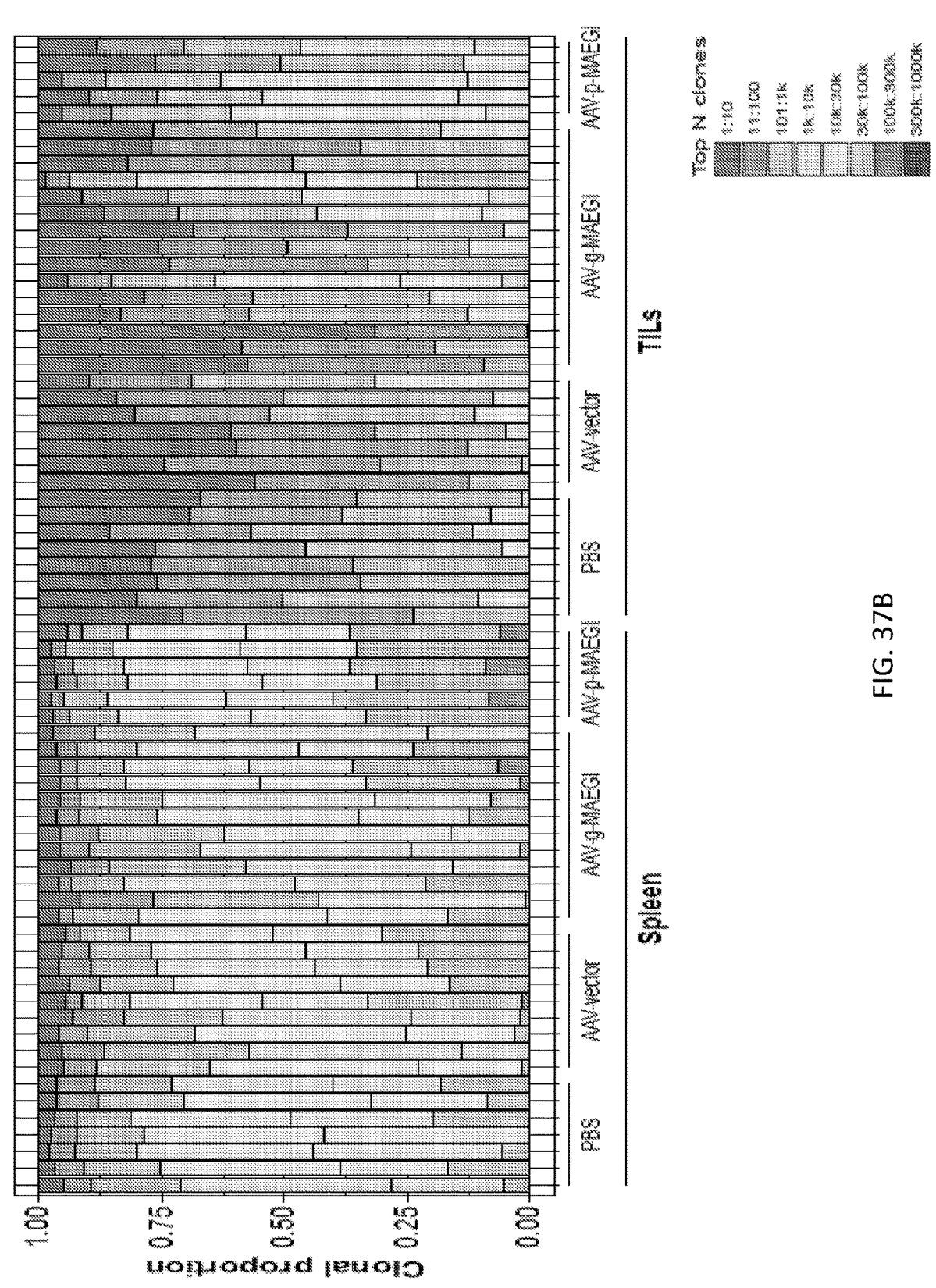

FIGS. 37A-37F illustrate interrogation of the T cell repertoire in MAEGI-treated mice by TCR sequencing. FIG. 37A is a schematic of a TCR-seq experiment design. Mice bearing E0771 tumors were treated with PBS, AAV-Vector, AAV-g-MAEGI (genome-wide), or AAV-p-MAEGI (exome-guided). Spleens and tumors were harvested from mice for genomic DNA extraction, and subjected to RT-based TCRα/TCRβ capture followed by Illumina sequencing. FIG. 37B is a global clonal proportion plot showing the relative frequencies of the top N clones. FIG. 37C is a boxplot of Chao1 indices (TCR diversity) for each sample. Statistical significance was assessed by unpaired two-tailed Mann-Whitney test. FIG. 37D is a boxplot of Gini-Simpson indices (TCR evenness) for each sample. Statistical significance was assessed by unpaired two-tailed Mann-Whitney test. FIGS. 37E-37F are dot plots of the number of unique clonotypes identified (TCR richness) in each spleen sample (FIG. 37E) or TIL sample (FIG. 37F), compared across treatment conditions. Statistical significance was assessed by unpaired two-tailed t-test.

Figures 38A, 38B, 38C:
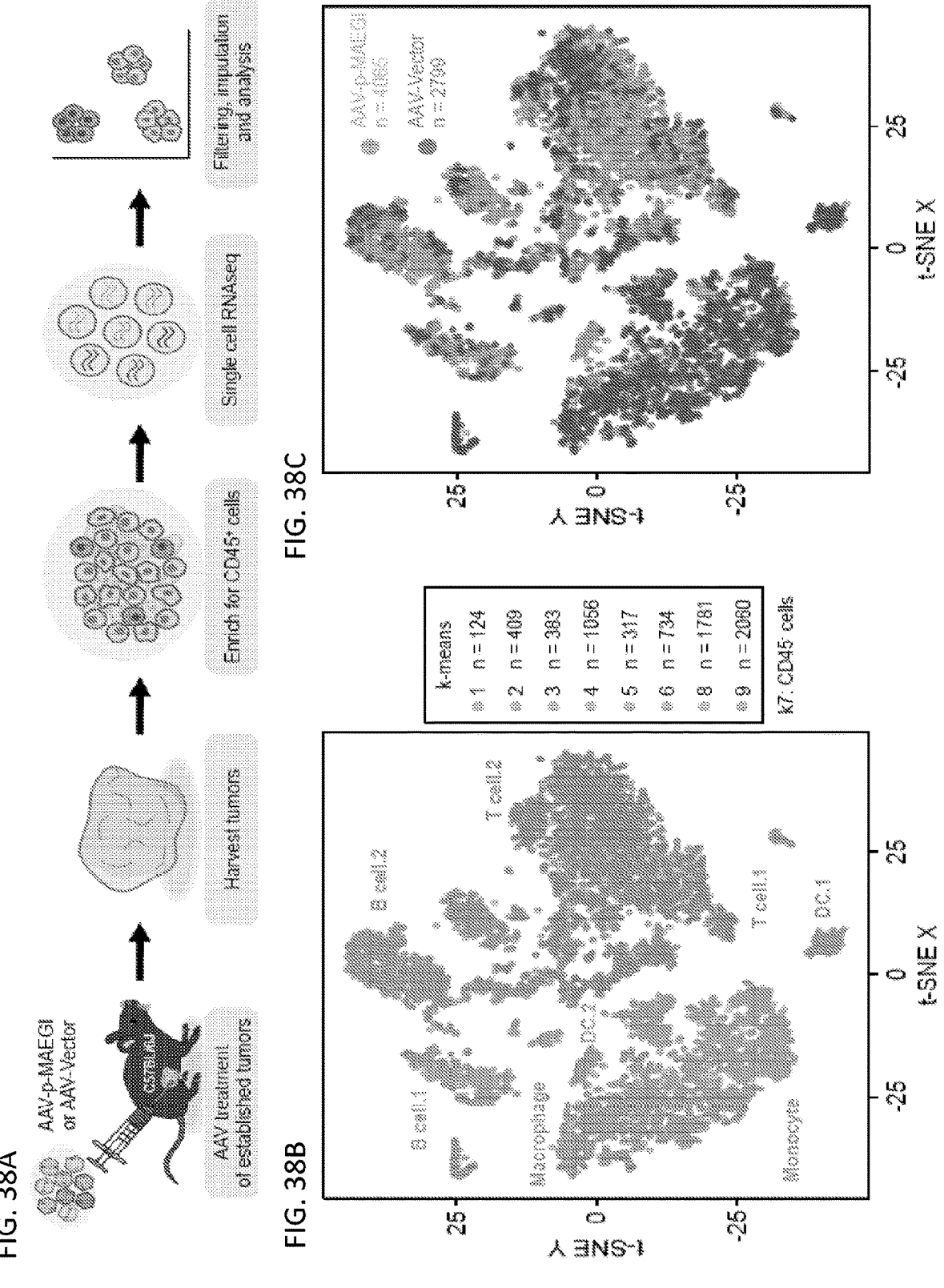
Figures 38D, 38E, 38F:
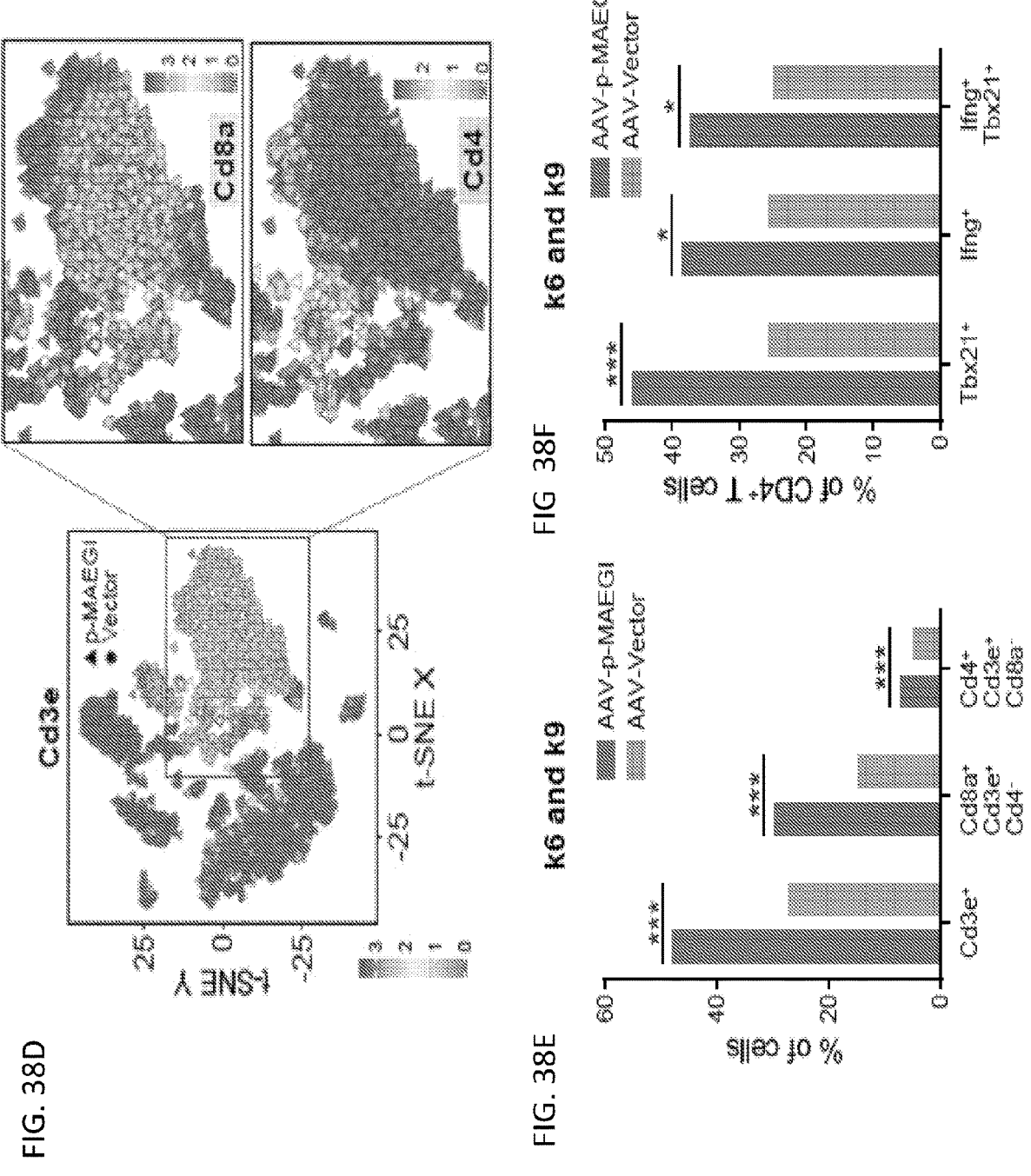

FIGS. 38A-38F illustrate single cell RNAseq profiling of immune populations in the tumor microenvironment. FIG. 38A is a schematic of an experimental design for single cell RNAseq (scRNAseq) analysis of immune populations in AAV-Vector (n=3) or AAV-p-MAEGI treated mice (n=3). Cells from replicate mice were pooled together for scRNAseq library preparation. FIG. 38B is a scatter plot of t-SNE dimensional reduction, with cells colored by k-means cluster. Putative cell types associated with each cluster are annotated on the plot. Cluster 7 (k7) is composed of CD45$^-$ cells and was excluded from further analyses (see FIGS. 39A-39F). The number of cells in each cluster is noted to the right. FIG. 38C is a scatter plot of t-SNE dimensional reduction as in (FIG. 38B) but colored by treatment group. scRNAseq cell numbers after preprocessing: AAV-p-MAEGI, n=4,065 cells; AAV-Vector, n=2,799 cells. FIG. 38D shows identification of T cell populations from scRNAseq. Left, t-SNE dimensional reduction, with cells colored by Cd3e expression. Right, zoomed-in view of clusters k6 and k9, colored by Cd8a expression (top) or Cd4 expression (bottom). Triangles correspond to cells from AAV-p-MAEGI, while circles correspond to cells from AAV-Vector. FIG. 38E shows quantification of T cell populations in k6 and k9. AAV-p-MAEGI mice have a higher proportion of CD3$^+$ T cells, CD8$^+$ T cells, and CD4$^+$ T cells out of total TIICs. Two-sided Fisher's exact test, AAV-p-MAEGI vs AAV-Vector: $p<0.0001$ for CD3e$^+$ T cells, CD8$^+$ T cells, and CD4$^+$ T cells. FIG. 38F shows quantification of CD4$^+$ T cell subpopulations in k6 and k9. AAV-p-MAEGI mice have a higher proportion of Tbx21$^+$ cells, Ifng$^+$ cells, and Thx21$^+$ Ifng$^+$ cells out of total CD4$^+$ T cells. Two-sided Fisher's exact test, AAV-p-MAEGI vs AAV-Vector: $p<0.0001$ for Tbx21$^+$ cells, $p=0.0111$ for Ifng$^+$ cells, and $p=0.0109$ for Thx21$^+$Ifng$^+$ cells. Error bars: All data points in this figure are presented as mean±s.e.m. Asterisks: * $p<0.05$,  $p<0.01$, * $p<0.001$.

Figures 39A, 39B:
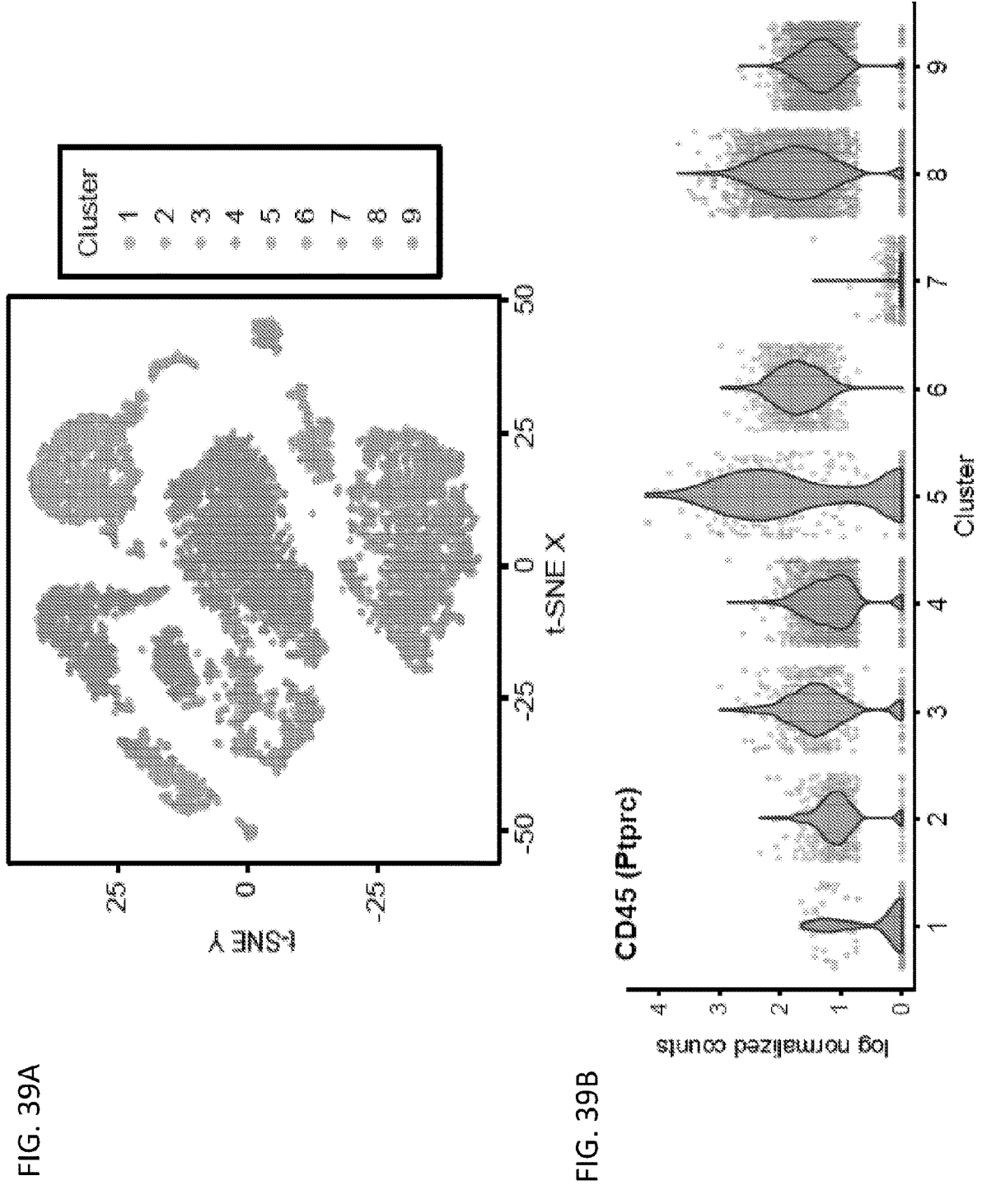
Figures 39C, 39D:
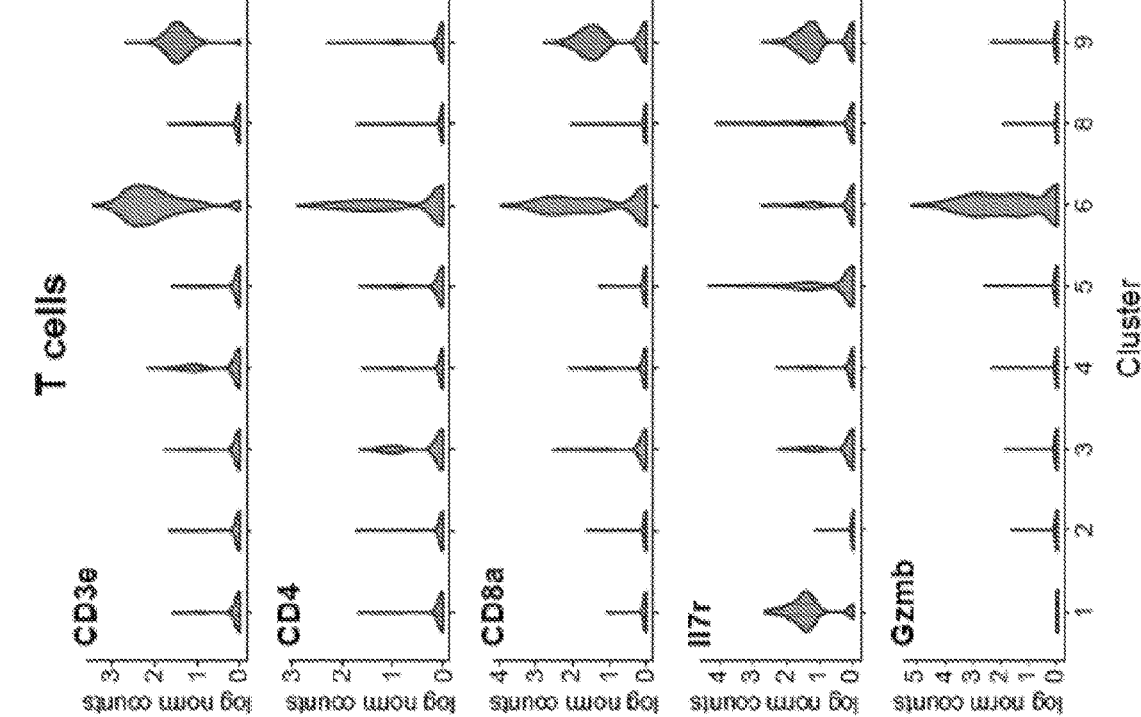
Figure 39E:
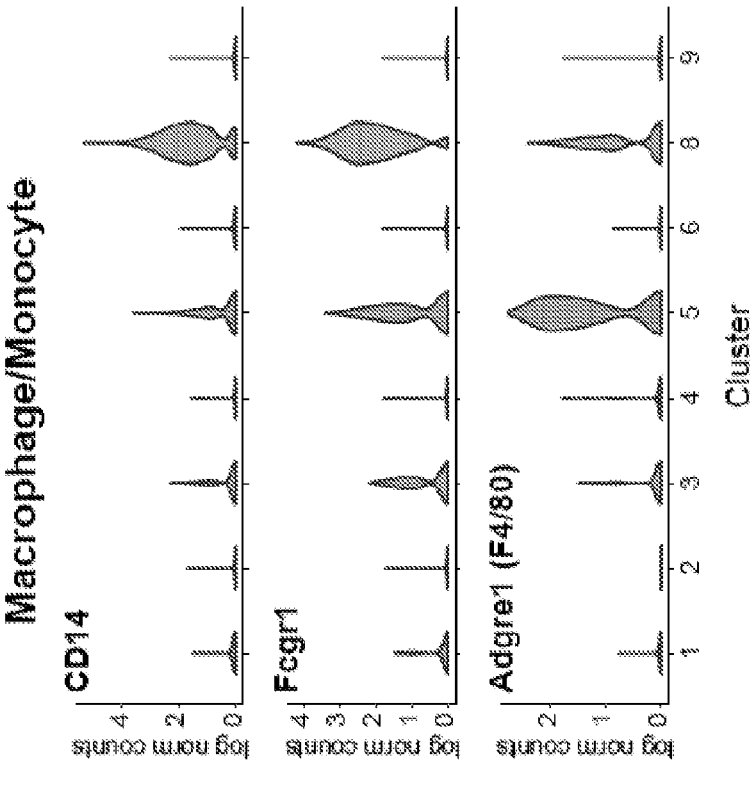
Figure 39F:
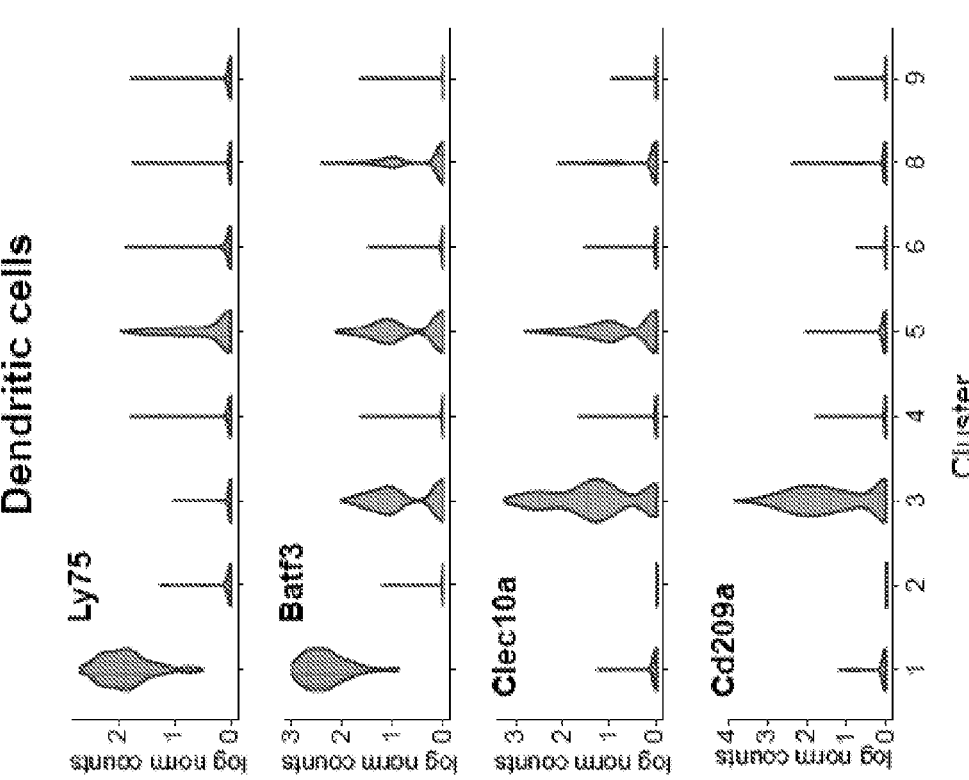

FIGS. 39A-39F illustrate processing of scRNAseq data to exclude CD45$^-$ cells and characteristic markers of each scRNAseq cluster. FIG. 39A shows t-SNE of all single cells passing the filtering criteria, colored by k-means clustering. FIG. 39B shows Violin plots of Ptprc (encoding CD45) expression, grouped k-means cluster. Cluster 7 is largely absent for Ptprc expression. FIG. 39C shows Violin plots of Cd3e, Cd4, CD8a, Il7r, and Gzmb expression, defining different T cells. FIG. 39D show Violin plots of Cd19, Cd20, Par5, Jchain, and Ly6d expression, defining different B cells. FIG. 39E shows Violin plots of Ly75, Batf3, Clec10a, and CD209a expression, defining different dendritic cells. FIG. 39F shows Violin plots of Cd14, Fcgr1, and Adgre1 (encoding F4/80) expression, defining macrophages and monocytes.

FIGS. 40A-40D illustrate the finding that AAV-p-MAEGI treatment is associated with transcriptional changes in tumor-infiltrating T cells. FIGS. 40A-40C show in the top panel, volcano plots of CD8$^+$ T cells in k6 (FIG. 40A), CD8$^+$ T cells in k9 (FIG. 40B), and CD4$^+$ T cells in k6 and k9 (FIG. 40C), comparing AAV-p-MAEGI to AAV-Vector. Bottom panel shows gene ontology enrichment analysis of upregulated genes in T cells from AAV-p-MAEGI mice. FIG. 40D shows a simplified model of action for multiplexed activation of endogenous genes as an immunotherapy (MAEGI). Left panel: the untreated tumor microenvironment. In a setting of low neoantigen expression, CD8$^+$ T cells detect rare mutant peptides presented on MHC-I by tumor cells and initiate weak tumor killing. Right panel: the MAEGI-treated tumor microenvironment. Using CRISPRa, mutated genes in tumor cells are overexpressed from endogenous loci, leading to amplified production and presentation of neoantigens to CD8$^+$ T cells, thereby resulting in a robust anti-tumor response.

Figure 4A:
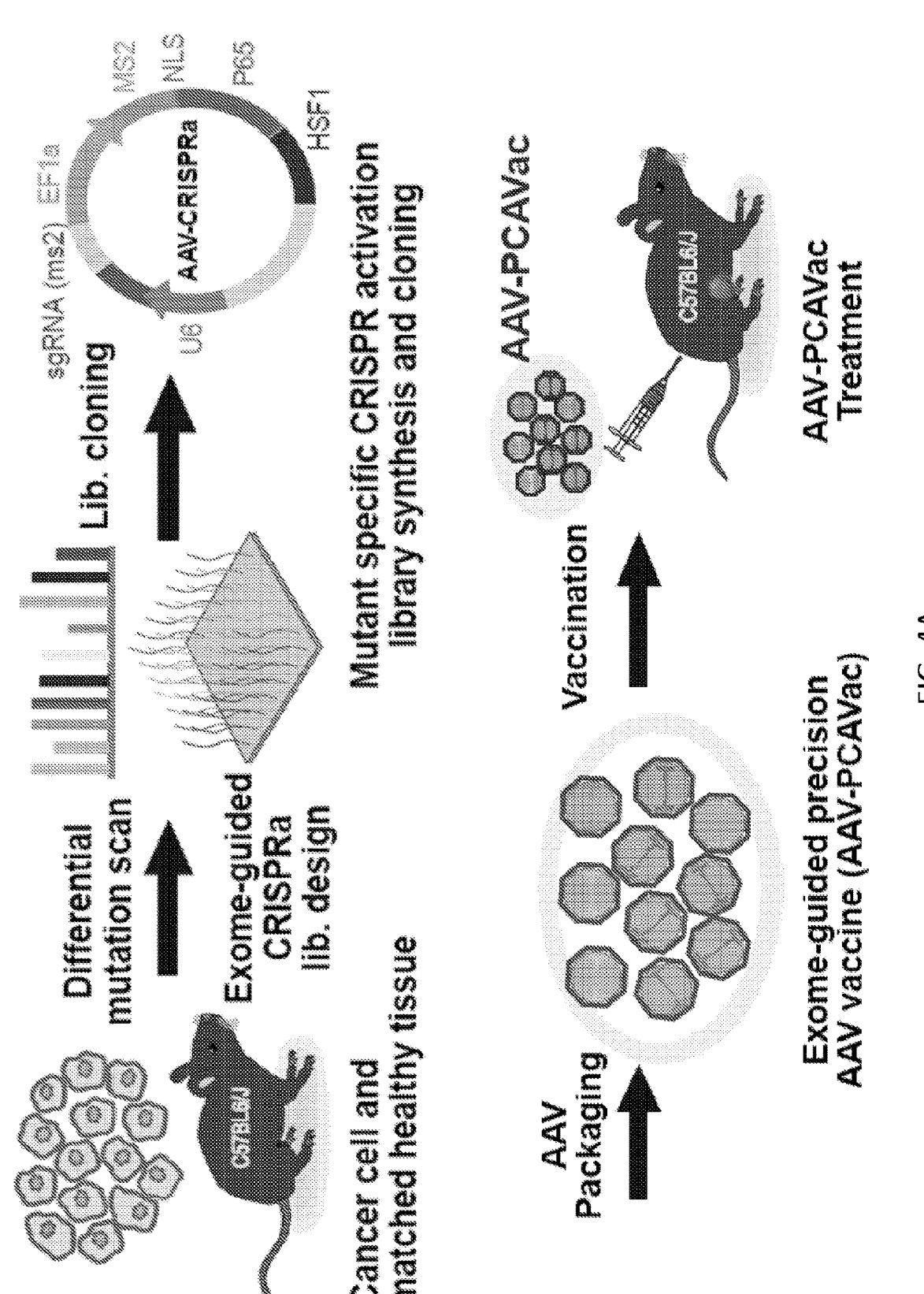
Figure 4B:
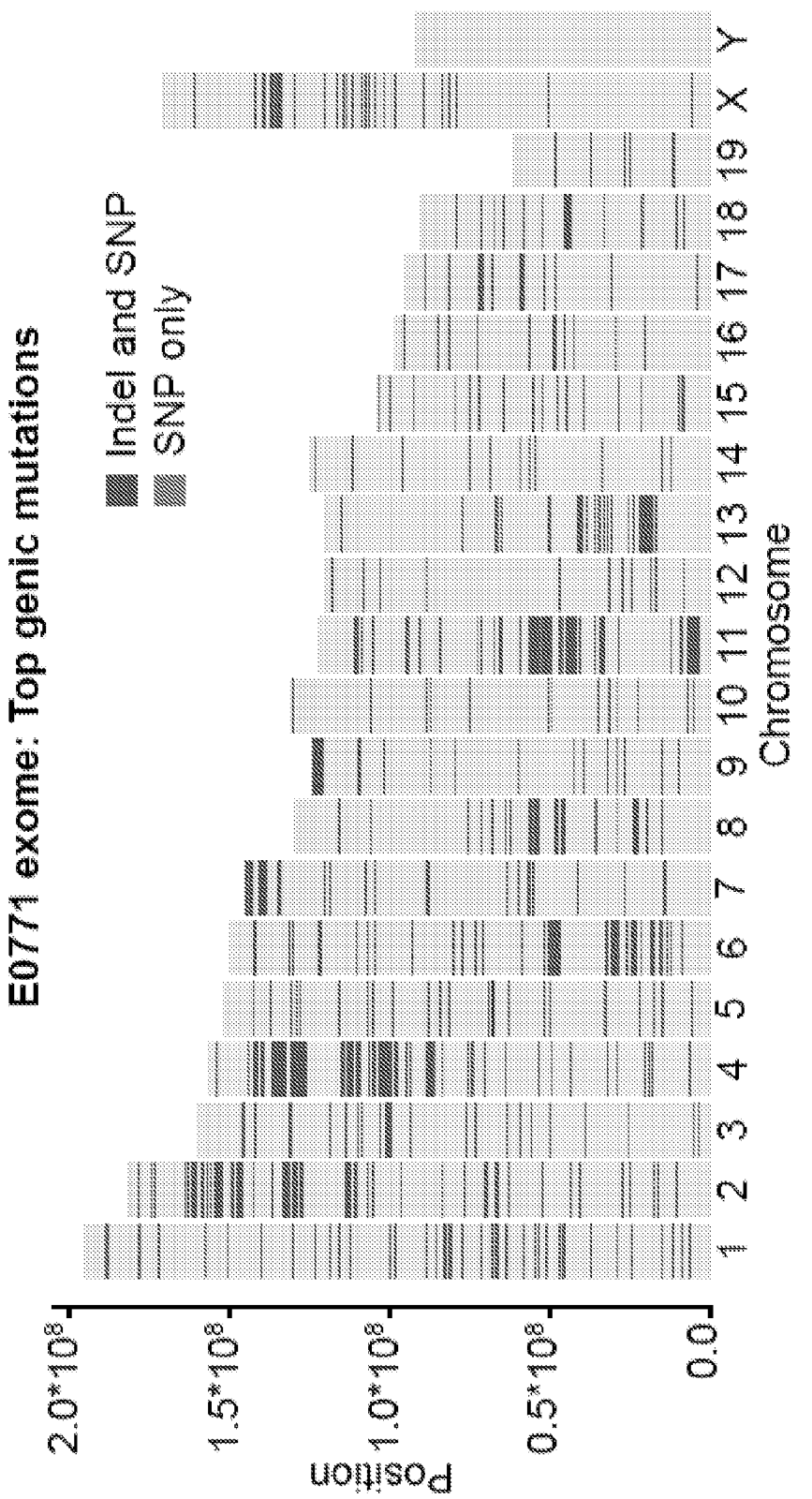
FIG. 4B shows whole-exome sequencing identified top genomic mutations in E0771 cells, as shown over their positions in the mouse genome. Genes were colored by the presence or absence of SNPs and/or indels.
Figure 4C:
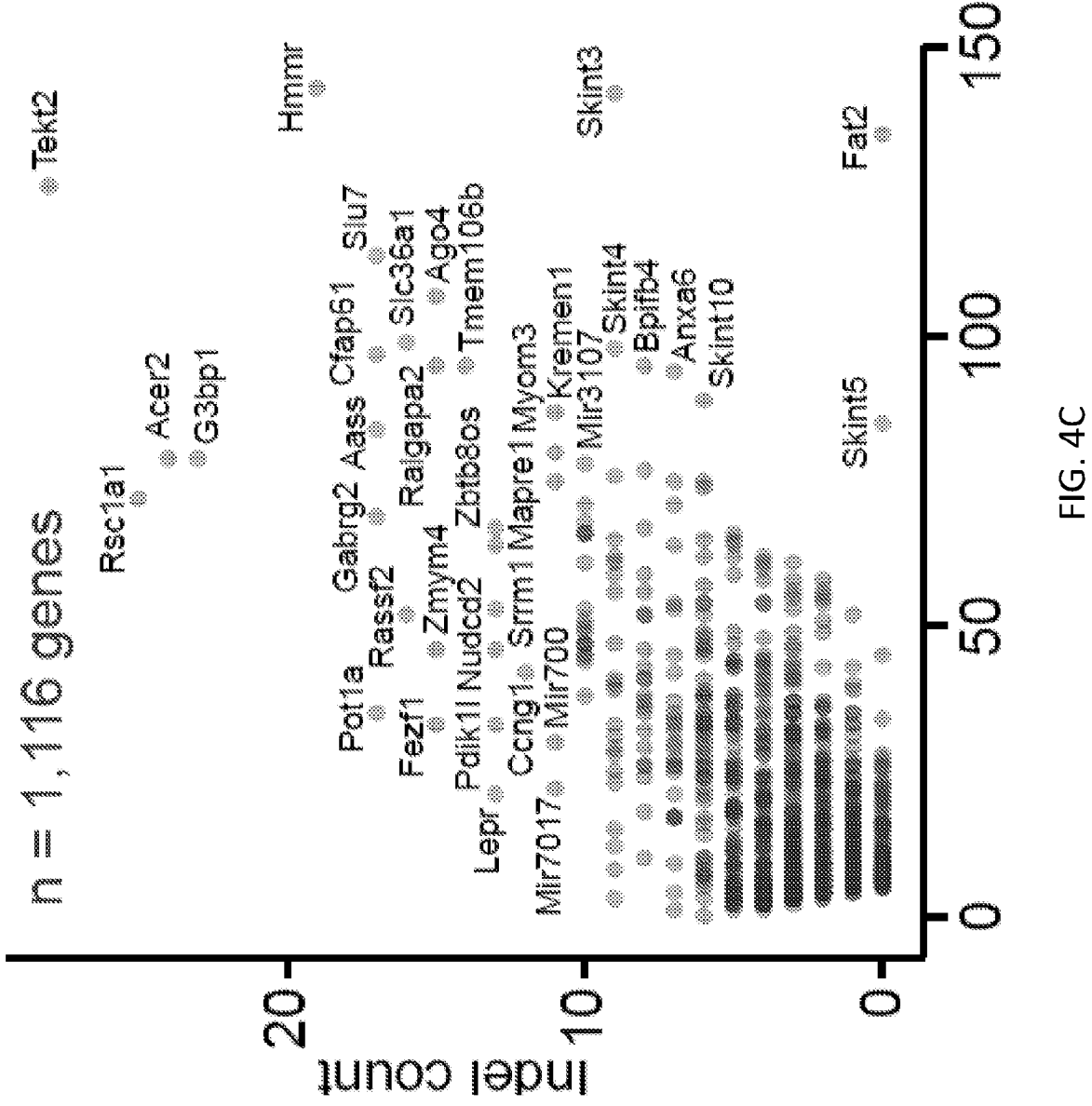
FIG. 4C is a scatter plot showing the number of mutations as SNPs or indels per gene. Genes were filtered by a minimum number of total mutations in E0771 cells compared to wildtype mammary fatpad. Examples of most highly mutated genes are Tekt2, Hmmr, Acer2, G3bp1, Rsc1a1, Slu7, and Skint3. A total of 1,116 genes were used in customized library design.
Figures 4D, 4E, 4F:
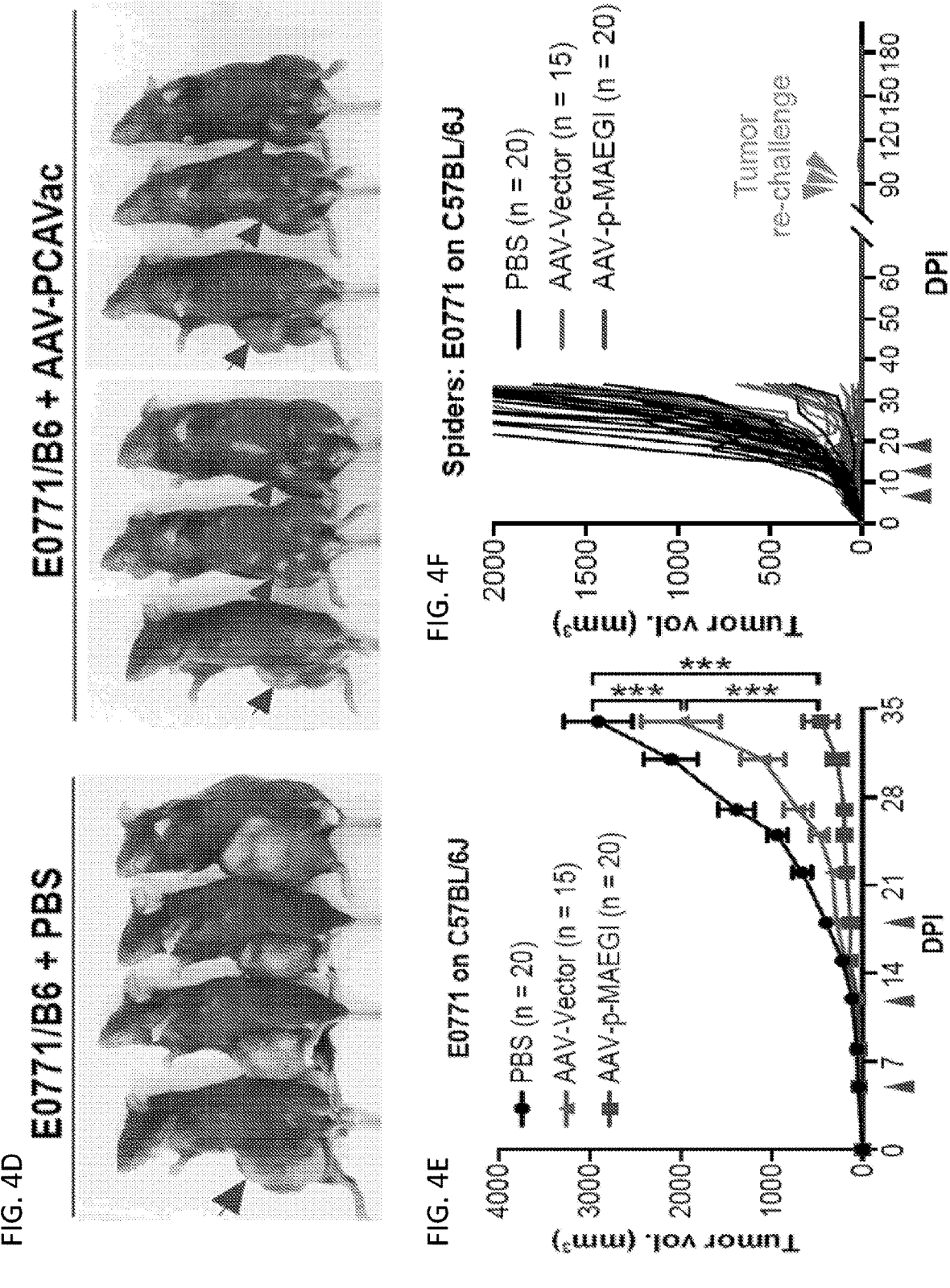
FIG. 4D shows representative images of mice at treatment end-point from PBS and AAV-PCAVac groups in the E0771 syngeneic tumor model.
FIG. 4E illustrates the therapeutic efficacy of AAV-PCAVac against established E0771 syngeneic tumors by intratumoral administration at indicated times (arrows). PBS treated mice, n=20; AAV-Vector treated mice, n=15; AAV-PCAVac (AAV-p-MAEGI) treated mice, n=20. Tumor growth curves of E0771 syngeneic tumors in mice treated by PBS, AAV-Vector, or AAV-PCAVac. Two-way ANOVA: AAV-Vector vs. PBS, p<0.0001; AAV-p-MAEGI vs. PBS, p<0.0001; AAV-PCAVac (AAV-p-MAEGI) vs. AAV-Vector, p<0.0001.
FIG. 4F is a spider plot of tumor growth curves of E0771 syngeneic tumors treated by PBS, AAV-Vector, or AAV-PCAVac (AAV-p-MAEGI). Mice whose tumors had undergone complete response by AAV-PCAVac (AAV-p-MAEGI)(n=9) were subjected to tumor re-challenges (arrows). No tumors grew with re-challenge, indicating that AAV-p-MAEGI induced long-term anti-tumor effects in mice. Treatment days are indicated by arrows.
Figure 41:
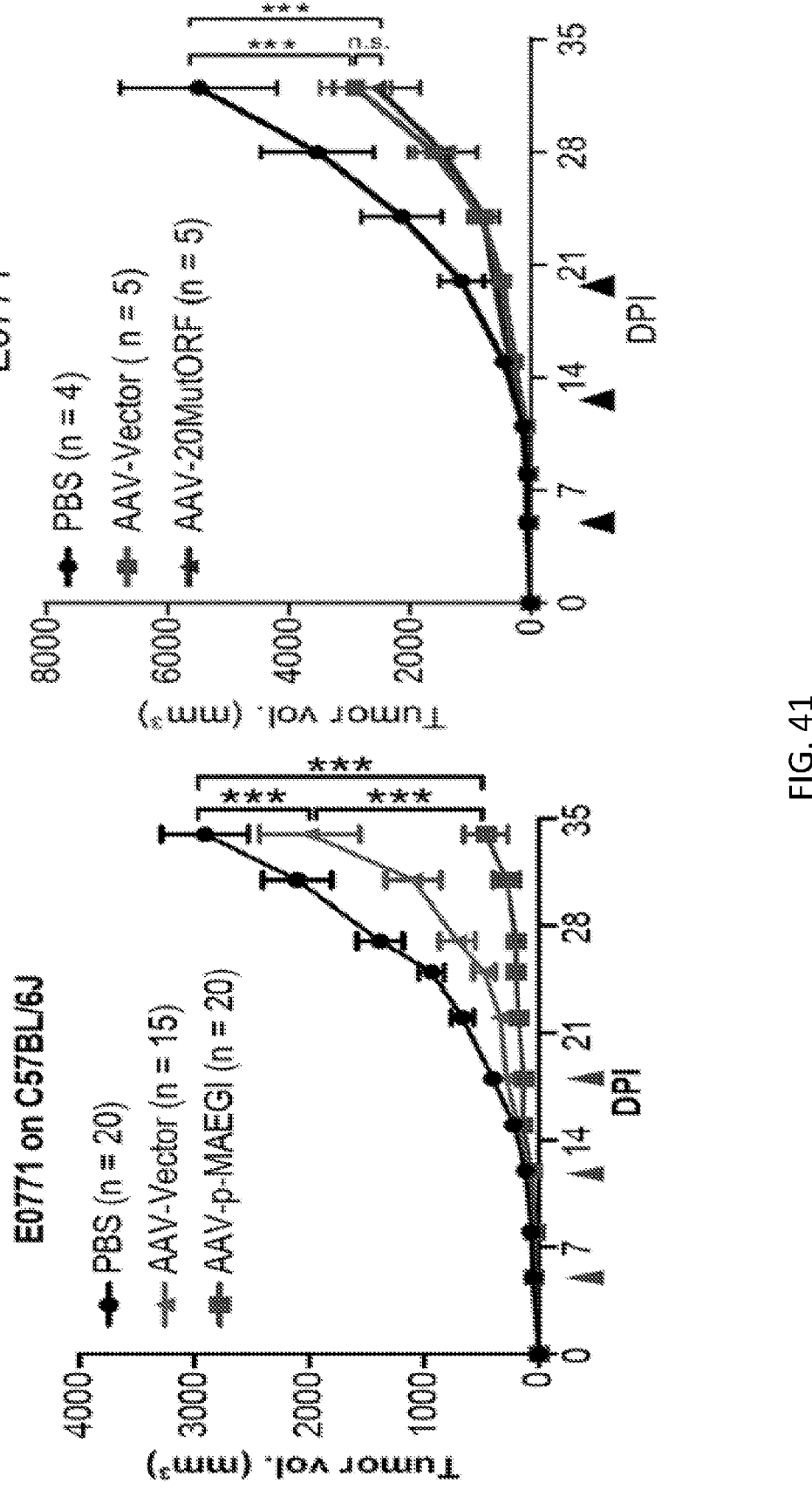

FIG. 41 illustrates that while AAV-MAEGI is highly efficacious (left panel), intratumoral delivery of the predicted top 20 mutant mini-ORFs by AAV (AAV-20MutORF) is not more effective than AAV-Vector alone (left, same as FIG. 4E). Right panel: treatment of E0771 tumor on C57BL/6 mice with PBS, AAV-Vector, or AAV-20MutORF, where the top 20 predicted most antigenic neoantigens were selected based on their mutational profile in E0771 cells and concatenated as an ORF to be expressed in AAV as a transgene.

Figure 42:
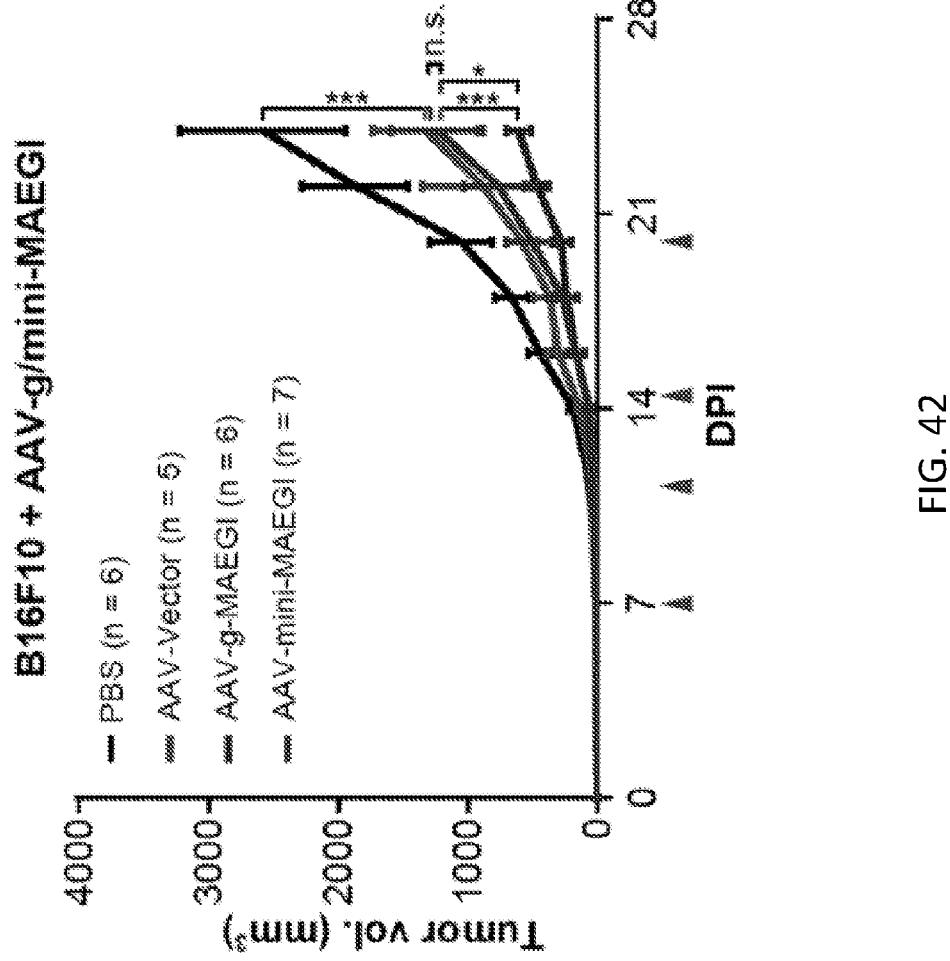

FIG. 42 illustrates data from treatment of B16F10 tumors on C57BL/6 mice with PBS, AAV-Vector, AAV-g-MAEGI (genome-wide library) or AAV-mini-MAEGI, where the 15 genes were selected based on their ranking of the mutational profile in B16F10 cells.

Figure 43:
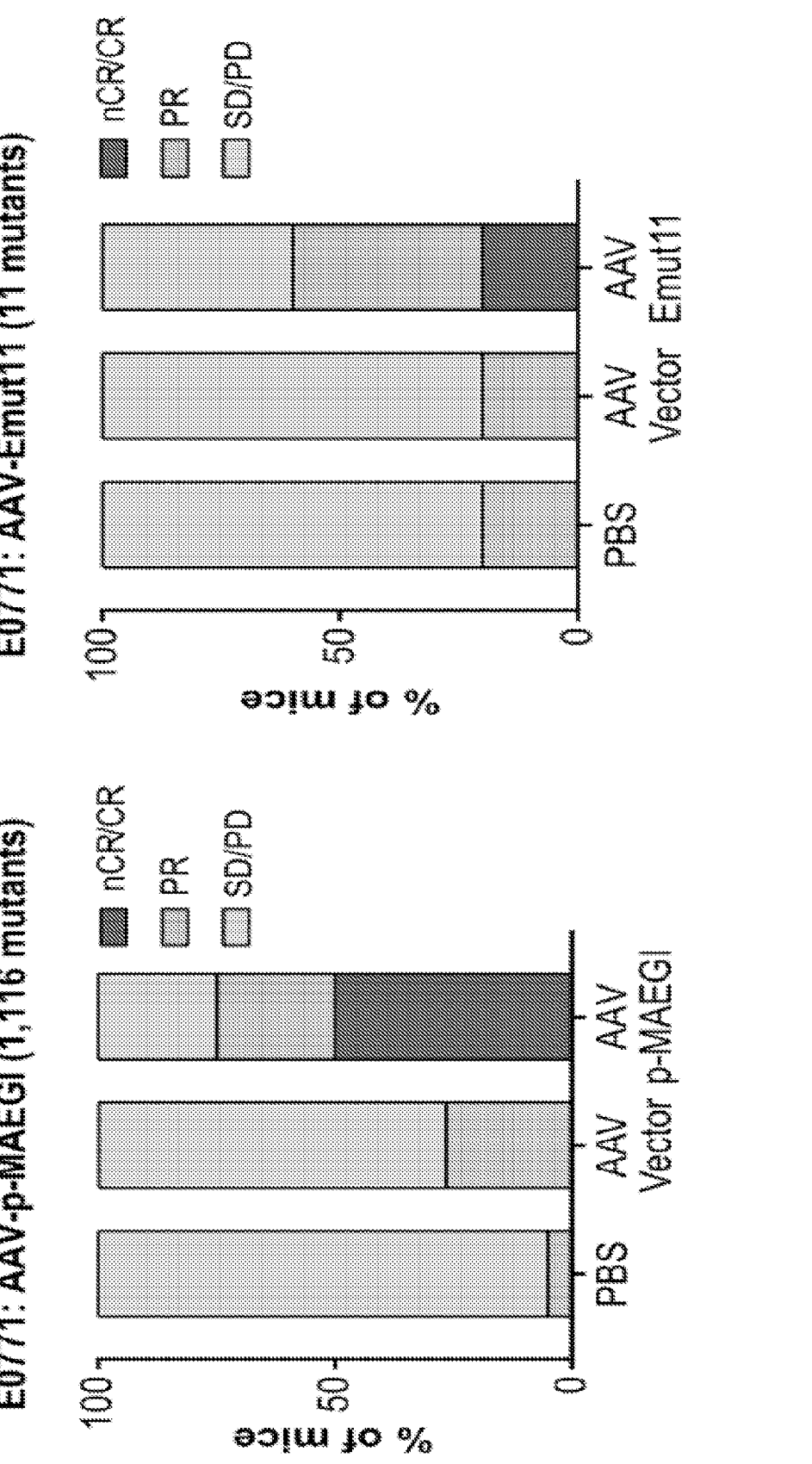

FIG. 43 illustrates reduced efficacy with Emut11, as compared to strong efficacy with E0771-p-MAEGI carrying an sgRNA library targeting 1,116 mutant genes. Left panel: same as FIG. 4M). Right panel: treatment of E0771 tumor on C57BL/6 mice with PBS, AAV-Vector, or AAV-Emut11, where the top 11 genes were selected based on their ranking of the mutational profile in E0771 cells, and their activation was driven by a small sgRNA library targeting the promoter of these genes.

Figures 44A, 44B, 45:
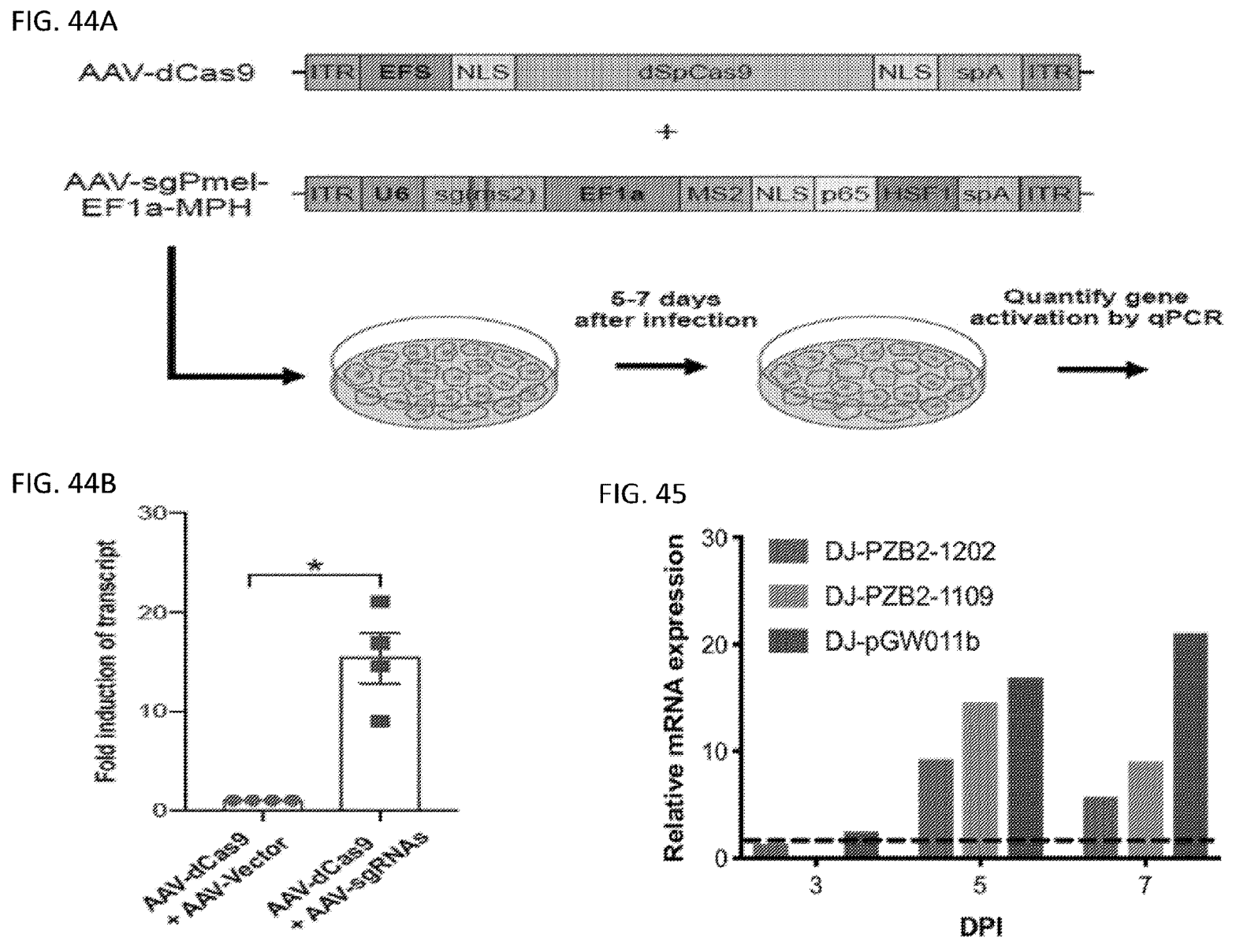

FIGS. 44A-44B illustrate dual AAV delivery for activation of an endogenous gene in E0771 cells using AAV-dCas9 and AAV-sgRNA, both packaged in AAV9. FIG. 44A is a schematic of dual AAV delivery. FIG. 44B shows dual AAV activation of PmeI.

FIG. 45 illustrates Dual AAV delivery for activation of an endogenous gene in E0771 cells using AAV-dCas9 (either PZB2 (SEQ ID NO: X) or pGW011b vector) and AAV-sgRNA, both packaged in AAV-DJ.

FIG. 46 illustrates dual-AAV delivery of a personalized library (AAV-PCAVac, i.e. AAV-p-MAEGI) into fully un-modified parental E0771 cells can mediate anti-tumor activity in vivo in C57BL/6 mice. Top panel: schematic of dual-AAV delivery of personalized library (AAV-PCAVac, i.e. AAV-p-MAEGI) into fully un-modified parental E0771 cells. Bottom panel: tumor growth curves showing Vector or MAEGI mediated anti-tumor activity in vivo on C57BL/6 mice. , $p<0.01$, *, $p<0.001$ by two-way ANOVA.

Figures 47, 48:
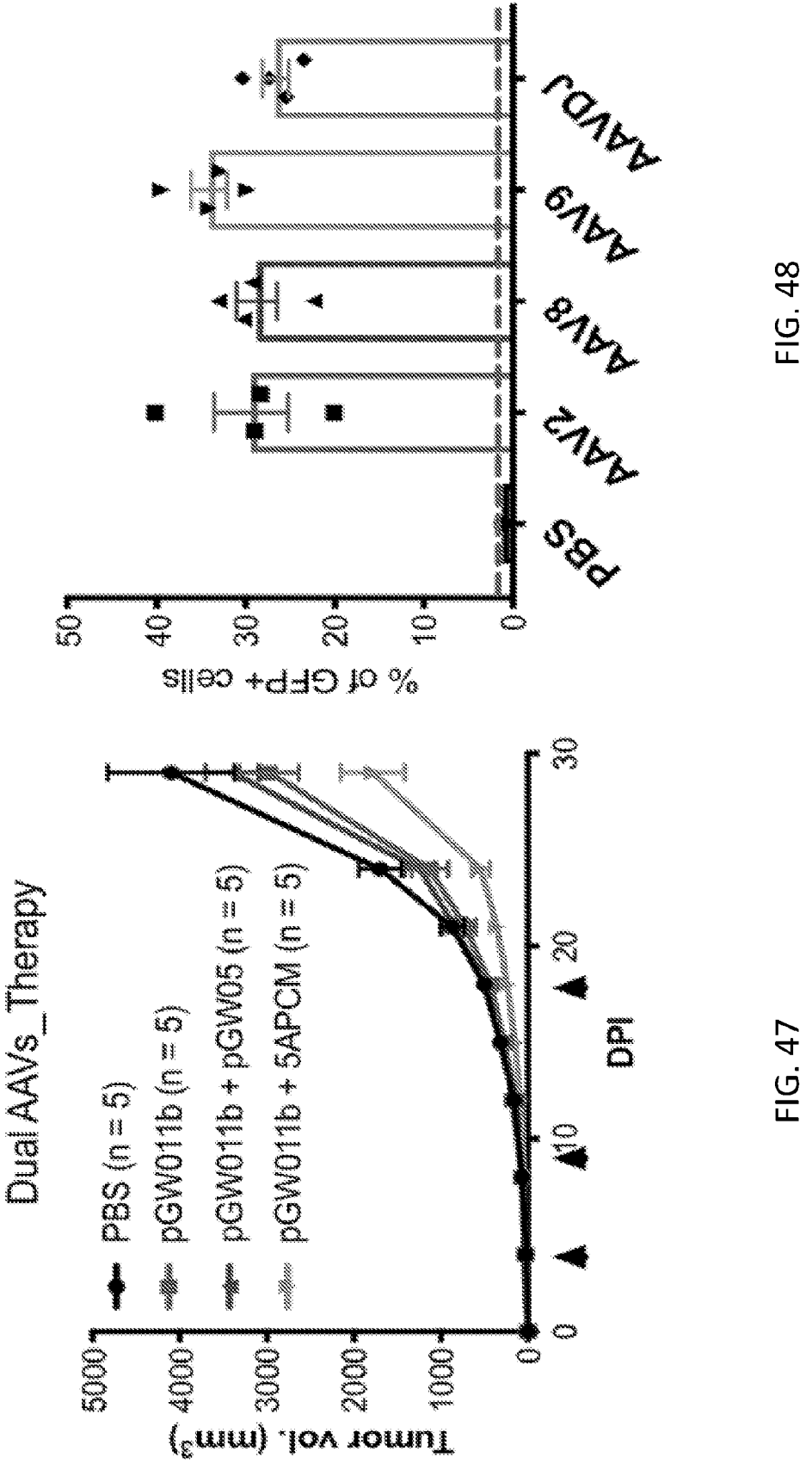

FIG. 47 illustrates tumor growth curves showing dual AAV delivery of an APCM library into fully un-modified parental E0771 cells mediates anti-tumor activity in vivo in C57BL/6 mice. pGW011b+5APCM group (APCM treated mice) vs pGW011b+pGW05 group (vector treated mice), two-way ANOVA $p=0.003$.

FIG. 48 illustrates AAV infection efficiency across serotypes assessed by intratumoral delivery of GFP-expressing AAVs and flow cytometry analysis. Percentage of GFP$^+$ cells within tumors from mice 4 days after intratumoral injection of PBS (n=3) or AAV-GFP (n=12) grouped by CD45$^+$ and CD45$^-$ cells. The background GFP fluorescence was set as the maximum % GFP positivity in PBS samples, denoted by a dashed line. Fractions above AAV conditions denote the number of samples with % GFP positivity above background in the indicated cell population.

DETAILED DESCRIPTION

Definitions

Unless defined otherwise, all technical and scientific terms used herein have the same meaning as commonly understood by one of ordinary skill in the art to which the invention pertains. Although any methods and materials similar or equivalent to those described herein can be used in the practice for testing of the present invention, the preferred materials and methods are described herein. In describing and claiming the present invention, the following terminology will be used.

It is also to be understood that the terminology used herein is for the purpose of describing particular embodiments only, and is not intended to be limiting.

The articles "a" and "an" are used herein to refer to one or to more than one (i.e., to at least one) of the grammatical object of the article. By way of example, "an element" means one element or more than one element.

"About" as used herein when referring to a measurable value such as an amount, a temporal duration, and the like, is meant to encompass variations of ±20% or ±10%, more preferably ±5%, even more preferably ±1%, and still more preferably ±0.1% from the As used herein, the term "autologous" is meant to refer to any material derived from the same individual to which it is later to be re-introduced into the individual.

"Allogeneic" refers to any material derived from a different animal of the same species.

As used herein, the term "bp" refers to base pair.

The term "complementary" refers to the degree of anti-parallel alignment between two nucleic acid strands. Complete complementarity requires that each nucleotide be across from its opposite. No complementarity requires that each nucleotide is not across from its opposite. The degree of complementarity determines the stability of the sequences to be together or anneal/hybridize. Furthermore various DNA repair functions as well as regulatory functions are based on base pair complementarity.

The term "CRISPR/Cas" or "clustered regularly inter-spaced short palindromic repeats" or "CRISPR" refers to DNA loci containing short repetitions of base sequences followed by short segments of spacer DNA from previous exposures to a virus or plasmid. Bacteria and archaea have evolved adaptive immune defenses termed CRISPR/CRISPR-associated (Cas) systems that use short RNA to direct degradation of foreign nucleic acids. In bacteria, the CRISPR system provides acquired immunity against invading foreign DNA via RNA-guided DNA cleavage.

The "CRISPR/Cas9" system or "CRISPR/Cas9-mediated gene editing" refers to a type II CRISPR/Cas system that has been modified for genome editing/engineering. It is typically comprised of a "guide" RNA (gRNA) and a non-specific CRISPR-associated endonuclease (Cas9). "Guide RNA (gRNA)" is used interchangeably herein with "short guide RNA (sgRNA)" or "single guide RNA (sgRNA). The sgRNA is a short synthetic RNA composed of a "scaffold" sequence necessary for Cas9-binding and a user-defined ~20 nucleotide "spacer" or "targeting" sequence which defines the genomic target to be modified. The genomic target of Cas9 can be changed by changing the targeting sequence present in the sgRNA.

"CRISPRa" system refers to a modification of the CRISPR-Cas9 system that functions to activate or increase gene expression. In certain embodiments, the CRISPRa system is comprised of a catalytically dead RNA/DNA guided endonuclease, such as dCas9, dCas12a/dCpf1, dCas12b/dC2c1, dCas12c/dC2c3, dCas12d/dCasY, dCas12e/dCasX, dCas13a/dC2c2, dCas13b, dCas13c, dead Cascade complex, or others; at least one transcriptional activator; and at least one sgRNA that functions to increase expression of at least one gene of interest. The term "activation" as used herein refers to an increase in gene expression of one or more genes.

"dCas9" as used herein refers to a catalytically dead Cas9 protein that lacks endonuclease activity. A "disease" is a state of health of an animal wherein the animal cannot maintain homeostasis, and wherein if the disease is not ameliorated then the animal's health continues to deteriorate. In contrast, a "disorder" in an animal is a state of health in which the animal is able to maintain homeostasis, but in which the animal's state of health is less favorable than it would be in the absence of the disorder. Left untreated, a disorder does not necessarily cause a further decrease in the animal's state of health.

The term "downregulation" as used herein refers to the decrease or elimination of gene expression of one or more genes.

"Effective amount" or "therapeutically effective amount" are used interchangeably herein, and refer to an amount of a compound, formulation, material, or composition, as described herein effective to achieve a particular biological result or provides a therapeutic or prophylactic benefit. Such results may include, but are not limited to, anti-tumor activity as determined by any means suitable in the art.

"Encoding" refers to the inherent property of specific sequences of nucleotides in a polynucleotide, such as a gene, a cDNA, or an mRNA, to serve as templates for synthesis of other polymers and macromolecules in biological processes having either a defined sequence of nucleotides (i.e., rRNA, tRNA and mRNA) or a defined sequence of amino acids and the biological properties resulting therefrom. Thus, a gene encodes a protein if transcription and translation of mRNA corresponding to that gene produces the protein in a cell or other biological system. Both the coding strand, the nucleotide sequence of which is identical to the mRNA sequence and is usually provided in sequence listings, and the non-coding strand, used as the template for transcription of a gene or cDNA, can be referred to as encoding the protein or other product of that gene or cDNA.

As used herein "endogenous" refers to any material from or produced inside an organism, cell, tissue or system.

As used herein, the term "exogenous" refers to any material introduced from or produced outside an organism, cell, tissue or system.

The term "expression" as used herein is defined as the transcription and/or translation of a particular nucleotide sequence driven by its promoter.

"Expression vector" refers to a vector comprising a recombinant polynucleotide comprising expression control sequences operatively linked to a nucleotide sequence to be expressed. An expression vector comprises sufficient cis-acting elements for expression; other elements for expression can be supplied by the host cell or in an in vitro expression system. Expression vectors include all those known in the art, such as cosmids, plasmids (e.g., naked or contained in liposomes) and viruses (e.g., Sendai viruses, lentiviruses, retroviruses, adenoviruses, and adeno-associated viruses) that incorporate the recombinant polynucleotide.

"Homologous" as used herein, refers to the subunit sequence identity between two polymeric molecules, e.g., between two nucleic acid molecules, such as, two DNA molecules or two RNA molecules, or between two polypeptide molecules. When a subunit position in both of the two molecules is occupied by the same monomeric subunit; e.g., if a position in each of two DNA molecules is occupied by adenine, then they are homologous at that position. The homology between two sequences is a direct function of the number of matching or homologous positions; e.g., if half (e.g., five positions in a polymer ten subunits in length) of the positions in two sequences are homologous, the two sequences are 50% homologous; if 90% of the positions (e.g., 9 of 10), are matched or homologous, the two sequences are 90% homologous.

"Identity" as used herein refers to the subunit sequence identity between two polymeric molecules particularly between two amino acid molecules, such as, between two polypeptide molecules. When two amino acid sequences have the same residues at the same positions; e.g., if a position in each of two polypeptide molecules is occupied by an Arginine, then they are identical at that position. The identity or extent to which two amino acid sequences have the same residues at the same positions in an alignment is often expressed as a percentage. The identity between two amino acid sequences is a direct function of the number of matching or identical positions; e.g., if half (e.g., five positions in a polymer ten amino acids in length) of the positions in two sequences are identical, the two sequences are 50% identical; if 90% of the positions (e.g., 9 of 10), are matched or identical, the two amino acids sequences are 90%/c identical.

As used herein, an "instructional material" includes a publication, a recording, a diagram, or any other medium of expression which can be used to communicate the usefulness of the compositions and methods of the invention. The instructional material of the kit of the invention may, for example, be affixed to a container which contains the nucleic acid, peptide, and/or composition of the invention or be shipped together with a container which contains the nucleic acid, peptide, and/or composition. Alternatively, the instructional material may be shipped separately from the container with the intention that the instructional material and the compound be used cooperatively by the recipient.

"Isolated" means altered or removed from the natural state. For example, a nucleic acid or a peptide naturally present in a living animal is not "isolated," but the same nucleic acid or peptide partially or completely separated from the coexisting materials of its natural state is "isolated." An isolated nucleic acid or protein can exist in substantially purified form, or can exist in a non-native environment such as, for example, a host cell.

The term "knockdown" as used herein refers to a decrease in gene expression of one or more genes.

The term "knockout" as used herein refers to the ablation of gene expression of one or more genes.

A "lentivirus" as used herein refers to a genus of the Retroviridae family. Lentiviruses are unique among the retroviruses in being able to infect non-dividing cells; they can deliver a significant amount of genetic information into the DNA of the host cell, so they are one of the most efficient vectors for gene delivery. HIV, SIV, and FIV are all examples of lentiviruses. Vectors derived from lentiviruses offer the means to achieve significant levels of gene transfer in vivo.

By the term "modified" as used herein, is meant a changed state or structure of a molecule or cell of the invention. Molecules may be modified in many ways, including chemically, structurally, and functionally. Cells may be modified through the introduction of nucleic acids.

By the term "modulating," as used herein, is meant mediating a detectable increase or decrease in the level of a response in a subject compared with the level of a response in the subject in the absence of a treatment or compound, and/or compared with the level of a response in an otherwise identical but untreated subject. The term encompasses perturbing and/or affecting a native signal or response thereby mediating a beneficial therapeutic response in a subject, preferably, a human.

A "mutation" as used herein is a change in a DNA sequence resulting in an alteration from a given reference sequence (which may be, for example, an earlier collected DNA sample from the same subject). The mutation can comprise deletion and/or insertion and/or duplication and/or substitution of at least one deoxyribonucleic acid base such as a purine (adenine and/or thymine) and/or a pyrimidine (guanine and/or cytosine). Mutations may or may not produce discernible changes in the observable characteristics (phenotype) of an organism (subject).

By "nucleic acid" is meant any nucleic acid, whether composed of deoxyribonucleosides or ribonucleosides, and whether composed of phosphodiester linkages or modified linkages such as phosphotriester, phosphoramidate, siloxane, carbonate, carboxymethylester, acetamidate, carbamate, thioether, bridged phosphoramidate, bridged methylene phosphonate, phosphorothioate, methylphosphonate, phosphorodithioate, bridged phosphorothioate or sulfone linkages, and combinations of such linkages. The term nucleic acid also specifically includes nucleic acids composed of bases other than the five biologically occurring bases (adenine, guanine, thymine, cytosine and uracil). In the context of the present invention, the following abbreviations for the commonly occurring nucleic acid bases are used. "A" refers to adenosine, "C" refers to cytosine, "G" refers to guanosine, "T" refers to thymidine, and "U" refers to uridine.

Unless otherwise specified, a "nucleotide sequence encoding an amino acid sequence" includes all nucleotide sequences that are degenerate versions of each other and that encode the same amino acid sequence. The phrase nucleotide sequence that encodes a protein or an RNA may also include introns to the extent that the nucleotide sequence encoding the protein may in some version contain an intron(s).

The term "oligonucleotide" typically refers to short polynucleotides, generally no greater than about 60 nucleotides. It will be understood that when a nucleotide sequence is represented by a DNA sequence (i.e., A, T, G, C), this also includes an RNA sequence (i.e., A, U, G, C) in which "U" replaces "T".

As used herein, the terms "peptide," "polypeptide," and "protein" are used interchangeably, and refer to a compound comprised of amino acid residues covalently linked by peptide bonds. A protein or peptide must contain at least two amino acids, and no limitation is placed on the maximum number of amino acids that can comprise a protein's or peptide's sequence. Polypeptides include any peptide or protein comprising two or more amino acids joined to each other by peptide bonds. As used herein, the term refers to both short chains, which also commonly are referred to in the art as peptides, oligopeptides and oligomers, for example, and to longer chains, which generally are referred to in the art as proteins, of which there are many types. "Polypeptides" include, for example, biologically active fragments, substantially homologous polypeptides, oligopeptides, homodimers, heterodimers, variants of polypeptides, modified polypeptides, derivatives, analogs, fusion proteins, among others. The polypeptides include natural peptides, recombinant peptides, synthetic peptides, or a combination thereof.

"Parenteral" administration of an immunogenic composition includes, e.g., subcutaneous (s.c.), intravenous (i.v.), intramuscular (i.m.), or intrasternal injection, or infusion techniques.

As used herein, the terms "peptide," "polypeptide," and "protein" are used interchangeably, and refer to a compound comprised of amino acid residues covalently linked by peptide bonds. A protein or peptide must contain at least two amino acids, and no limitation is placed on the maximum number of amino acids that can comprise a protein's or peptide's sequence. Polypeptides include any peptide or protein comprising two or more amino acids joined to each other by peptide bonds. As used herein, the term refers to both short chains, which also commonly are referred to in the art as peptides, oligopeptides and oligomers, for example, and to longer chains, which generally are referred to in the art as proteins, of which there are many types. "Polypeptides" include, for example, biologically active fragments, substantially homologous polypeptides, oligopeptides, homodimers, heterodimers, variants of polypeptides, modified polypeptides, derivatives, analogs, fusion proteins, among others. The polypeptides include natural peptides, recombinant peptides, synthetic peptides, or a combination thereof.

The term "polynucleotide" as used herein is defined as a chain of nucleotides. Furthermore, nucleic acids are polymers of nucleotides. Thus, nucleic acids and polynucleotides as used herein are interchangeable. One skilled in the art has the general knowledge that nucleic acids are polynucleotides, which can be hydrolyzed into the monomeric "nucleotides." The monomeric nucleotides can be hydrolyzed into nucleosides. As used herein polynucleotides include, but are not limited to, all nucleic acid sequences which are obtained by any means available in the art, including, without limitation, recombinant means, i.e., the cloning of nucleic acid sequences from a recombinant library or a cell genome, using ordinary cloning technology and PCR™, and the like, and by synthetic means. Conventional notation is used herein to describe polynucleotide sequences: the left-hand end of a single-stranded polynucleotide sequence is the 5'-end; the left-hand direction of a double-stranded polynucleotide sequence is referred to as the 5'-direction.

A "sample" or "biological sample" as used herein means a biological material from a subject, including but is not limited to organ, tissue, exosome, blood, plasma, saliva, urine and other body fluid. A sample can be any source of material obtained from a subject.

The term "subject" is intended to include living organisms in which an immune response can be elicited (e.g., mammals). A "subject" or "patient," as used therein, may be a human or non-human mammal. Non-human mammals include, for example, livestock and pets, such as ovine, bovine, porcine, canine, feline and murine mammals. Preferably, the subject is human.

As used herein, a "substantially purified" cell is a cell that is essentially free of other cell types. A substantially purified cell also refers to a cell which has been separated from other cell types with which it is normally associated in its naturally occurring state. In some instances, a population of substantially purified cells refers to a homogenous population of cells. In other instances, this term refers simply to cell that have been separated from the cells with which they are naturally associated in their natural state. In some embodiments, the cells are cultured in vitro. In other embodiments, the cells are not cultured in vitro.

A "target site" or "target sequence" refers to a genomic nucleic acid sequence that defines a portion of a nucleic acid to which a binding molecule may specifically bind under conditions sufficient for binding to occur.

The term "therapeutic" as used herein means a treatment and/or prophylaxis. A therapeutic effect is obtained by suppression, remission, or eradication of a disease state.

The term "transfected" or "transformed" or "transduced" as used herein refers to a process by which exogenous nucleic acid is transferred or introduced into the host cell. A "transfected" or "transformed" or "transduced" cell is one which has been transfected, transformed or transduced with exogenous nucleic acid. The cell includes the primary subject cell and its progeny.

To "treat" a disease as the term is used herein, means to reduce the frequency or severity of at least one sign or symptom of a disease or disorder experienced by a subject.

As used herein, "vaccinating" means administering a substance to a subject that induces an immune response against a disease.

A "vector" is a composition of matter which comprises an isolated nucleic acid and which can be used to deliver the isolated nucleic acid to the interior of a cell. Numerous vectors are known in the art including, but not limited to, linear polynucleotides, polynucleotides associated with ionic or amphiphilic compounds, plasmids, and viruses. Thus, the term "vector" includes an autonomously replicating plasmid or a virus. The term should also be construed to include non-plasmid and non-viral compounds which facilitate transfer of nucleic acid into cells, such as, for example, polylysine compounds, liposomes, and the like. Examples of viral vectors include, but are not limited to, Sendai viral vectors, adenoviral vectors, adeno-associated virus vectors, retroviral vectors, lentiviral vectors, and the like.

Ranges: throughout this disclosure, various aspects of the invention can be presented in a range format. It should be understood that the description in range format is merely for convenience and brevity and should not be construed as an inflexible limitation on the scope of the invention. Accordingly, the description of a range should be considered to have specifically disclosed all the possible subranges as well as individual numerical values within that range. For example, description of a range such as from 1 to 6 should be considered to have specifically disclosed subranges such as from 1 to 3, from 1 to 4, from 1 to 5, from 2 to 4, from 2 to 6, from 3 to 6 etc., as well as individual numbers within that range, for example, 1, 2, 2.7, 3, 4, 5, 5.3, and 6. This applies regardless of the breadth of the range.

DESCRIPTION

The present invention includes compositions and methods for treating or preventing cancer. In certain embodiments, the invention includes methods for treating or preventing cancer using a cell-based or an AAV-based composition that utilizes the CRISPR activation (CRISPRa) system to activate endogenous genes.

It was discovered herein that direct activation of endogenous genes is an effective means to amplify tumor-associated antigens to enhance anti-tumor immune responses. Highly multiplexed and customizable endogenous neoantigen activation has not yet been demonstrated prior to this disclosure. The present invention demonstrates the feasibility of using CRISPR technologies with RNA-guided precise genetic manipulations. The CRISPR activation (CRISPRa) system, based on dead Cas9 without nuclease activity (dCas9) (Qi et al. (20131) Cell 152, 1173-1183), enables simple and flexible regulation of gene expression with dCas9—transcriptional activation domain fusion (Gilbert et al. (2013) Cell 154, 442-451), which is further augmented by the recruitment of synergistic activation mediators (SAM) (Konermann, et al. (2015)Nature 517, 583-588; Chavez, et al. (2015) Nat Methods 12, 326-328; Tanenbaum, et al. (2014) Cell 159, 635-646). Herein, the CRISPRa system was harnessed to manipulate endogenous gene expression to magnify anti-tumor immune responses. The approach was developed into multiplexed tumor vaccination strategies.

Another aspect of the invention includes compositions and methods of both off-the-shelf and customizable endogenous gene vaccination cancer vaccines. The off-the-shelf versions have fixed components, which can have multiple forms, including single component or multi-component vaccines. The customizable versions have variable forms, which are generally multi-component vaccines in which the components are based on mutated genes in a cancer, particularly a patients' mutated genes. The compositions of these forms of cancer vaccines and their pre-clinical efficacy showed that they can be an effective means of prophylactic and therapeutic agents.

CRISPR Activation (CRISPRa) System

The CRISPR activation (CRISPRa) system is comprised of a catalytically inactive RNA-guided endonuclease or other endonucleases, such as but not limited to dCas9, dCas12a/dCpf1, dCas12b/dC2c1, dCas12c/dC2c3, dCas12d/dCasY, dCas12e/dCasX, dCas13a/dC2c2, dCas13b, dCas13c, dead Cascade complex, or others, The CRISPRa system also comprises at least one transcriptional activator, and at least one sgRNA that functions to increase expression of at least one gene of interest. Like a standard CRISPR-Cas9 system, CRISPRa systems rely on sgRNAs to guide Cas9 to intended targets. However, while a standard CRISPR-Cas9 system creates breaks in DNA through the endonuclease activity of Cas9 and then manipulates DNA repair mechanisms for gene editing, CRISPRa systems are modified and employ transcriptional activators to increase expression of genes of interest.

"dCas9" refers to a catalytically dead Cas9 protein that lacks endonuclease activity. This can be accomplished by introducing point mutations in the two catalytic residues (D10A and H840A) of the gene encoding Cas9. In doing so, dCas9 is unable to cleave dsDNA but retains the ability to target and bind DNA. This alone is often enough to attenuate if not outright block transcription of the targeted gene if the gRNA positions dCas9 in a way that prevents transcriptional factors and RNA polymerase from accessing the DNA. However, this ability to bind DNA can also be exploited for activation since dCas9 has modifiable regions, typically the N and C terminus of the protein, that can be used to attach transcriptional activators.

Targeting specificity is determined by complementary base-pairing of a small guide RNA (sgRNA) to the genomic loci. sgRNA is a chimeric noncoding RNA that can be subdivided into three regions: a base-pairing sequence, a dCas9-binding hairpin and a terminator. When designing a synthetic sgRNA, only the base-pairing sequence is modified. Secondary variables must also be considered: off-target effects (for which a simple BLAST run of the base-pairing sequence is required), maintenance of the dCas9-binding hairpin structure, and ensuring that no restriction sites are present in the modified sgRNA, as this may pose a problem in downstream cloning steps. Due to the simplicity of sgRNA design, this technology is amenable to genome-wide scaling. dCas9 can be derived, for example, from *S. pyogenes, S. aureus, N. meningiditis, S. thermopilus, F. novicida C. jejuni, B. laterosporus*, or from other species.

Transcriptional activators are protein domains or whole proteins that can be linked to dCas9 or sgRNAs and assist in the recruitment of important co-factors as well as RNA Polymerase for transcription of the gene(s) targeted by the system. Transcriptional activators have a DNA binding domain and a domain for activation of transcription. The activation domain can recruit general transcription factors or RNA polymerase to the gene sequence. Activation domains can also function by facilitating transcription by stalled RNA polymerases, and in eukaryotes can act to move nucleosomes on the DNA or modify histones to increase gene expression. These activators can be introduced into the system through attachment to dCas9 or to the sgRNA. Transcriptional activators can be either mammalian cellular endogenous proteins that have activator function, activators from other species such as viruses, microbials or plants, their partial or mutant variants, engineered activators, or other forms of activators that can increase gene expression. A list of applicable viral activators include but are not limited to: VP16, VP32, VP64, VP160, HBx, NS proteins, and VMW65. A list of applicable microbial activators include but are not limited to: Lac operons and GAL4. A list of applicable mammalian cellular transcriptional activators include but are not limited to: CAP, ACTN1, ACTN2, ACTN2, ACTN4, ACTN4, ANKRD1, APEX1, ARID5B, ARL2BP, ASCC1, ASXL1, ATN1, ATXN7L3, ATXN7L3, ATXN7L3, BCL9, BCL9L, BCL10, BCL10, BICRA, BIRC2, BRCA1, BRD7, CALCOCO1, CALCOCO1, CAL-COCO1, CALCOCO1, CARM1, CARM1, CARM1, CBFB, CCAR1, CCAR1, CCAR1, CCAR1, CCAR2, CCDC62, CEBPA, CENPJ, CITED1, CITED1, CITED2, CITED2, CITED2, CITED2, CITED2, CITED4, CITED4, CITED4, COPS5, CREBBP, CREBBP, CREBBP, CTBP2, CTNNB1, CTNNB1, CTNNB1, CTNNB1, CTNNB1, DAXX, DAXX, DCAF6, DCC, DDX17, DHX9, DR1, DYRK1B, EDF1, ELF3, ELOB, ENY2, ENY2, ENY2, EP300, EP300, EP300, FAM129B, FGF2, FHL5, FOXC1, GATA3, GATA3, GATA3, GATA4, GM20517, GMEB1, GMEB2, GPS2, GPS2, GTF2A2, GTF2A2, HAND1, HCFC1, HCFC1, HELZ2, HIF3A, HINFP, HIPK2, HMGA1, HMGA1, HMGA1B, HMGB2, HYAL2, ING4, ISL1, JADE1, JMJD6, JMY, JMY, JUN, JUN, JUNB, JUND, JUP, JUP, KAT2A, KAT2B, KAT2B, KAT5, KAT5, KAT6A, KDM1A, KDM5A, KMT2C, KMT2D, LPIN1, LPIN1, LPIN2, LPIN2, LPIN3, MAGED1, MAK, MAML1, MAML1, MAML1, MAML1, MAML2, MAML2, MAML3, MAML3, MAML3, MCIDAS, MED1, MED1, MED1, MED1, MED1, MED1, MED6, MED12, MED12, MED12, MED12L, MED13, MED14, MED16, MED17, MED17, MED20, MED21, MED24, MED27, MED31, MEF2A, MMS19, MRTFA, MRTFB, MRTFB, MTA1, MTA1, MTA1, MTA1, MTA2, MTA3, MTDH, MYCBP, MYOCD, MYOD1, MYSM1, MYT1L, NACA, NCOA1, NCOA1, NCOA1, NCOA1, NCOA1, NCOA2, NCOA2, NCOA2, NCOA2, NCOA2, NCOA2, NCOA3, NCOA3, NCOA3, NCOA3, NCOA3, NCOA6, NCOA6, NCOA7, NEUROD1, NEUROG3, NFE2L1, NKX2-2, NME2, NPAT, NPM1, NR1D1, NR1D2, NR1H2, NR1H3, NR1H3, NR1H4, NR1H5, NR1I2, NR1I3, NR3C1, NRBF2, NRIP1, NRIP1, NRIP1, NRL, NSD3, NUP98, NUPR1, PARK7, PCBD1, PDLIM1, PER2, PHF2, PKN1, PMF1, PMF1, PML, PML, PML, POU2AF1, POU3F, POU3F2, POU3F2, POU4F1, POU4F2, POU5F1, PPARA, PPARD, PPARD, PPARG, PPARG, PPARG, PPARGC1A, PPARGC1A, PPARGC1A, PPARGC1A, PPARGC1A, PPARGC1A, PPARGC1B, PPARGC1B, PPRC1, PRDM16, PRKCB, PRMT2, PRPF6, PRRX1, PSIP1, PSMC3IP, PSMC3IP, PSMD9, PSMD9, PUS1, RAP2C, RARA, RARA, RARB, RARG, RBM14, RBM14, RBM39, RBPMS, RERE, REXO4, RNF20, RRP1B, RUVBL1, RXRB, SCAND1, SERTAD2, SETD3, SFR1, SFR1, SIX3, SLC30A9, SLC30A9, SMARCA2, SMARCA4, SMARCB1, SMARCB1, SMARCD3, SNW1, SNW1, SOX4, SOX11, SOX11, SOX12, SOX17, SP4, SRA1, SRA1, SRA1, SRA1, SRA1, SRA1, SS18, SS18, SS18L1, SS18L2, SUB1, SUB1, SUPT3, SUPT7L, TADA1, TADA1, TADA2A, TADA2B, TADA3, TADA3, TADA3, TAF1, TAF5L, TAF6L, TAF6L, TAF7, TAF7, TAF7L, TAF9, TAF11, TAF11, TAF12, TCF3, TDRD3, TFAP2A, TFAP2A, TFAP2A, TFAP2B, TFAP2B, TFAP2B, TGFB1I1, THRA, THRAP3, THRAP3, THRAP3, THRB, TRIM24, TRIM24, TRIM28, TRIP4, TRIP4, TRRAP, TSG101, UBE2L3, UBE3A, USP16, USP21, USP22, USP22, UTF1, UTF1, VDR, VGLL2, WBP2, WBP2, WBP2NL, WDR77, WNT3A, WWC1, WWOX, WWTR1, WWTR1, YAF2, YAP1, YAP1, ZBTB18, ZCCHC12, ZCCHC2, ZCCHC18, ZMIZ2.

Applicable CRISPRa systems demonstrated to be capable of activating transcription in mammalian species include but are not limited to: VP64-p65-Rta (VPR), Synergistic Activation Mediator (SAM), Suntag, p300, and VP160.

One example of a transcriptional activator (or transactivator domain) is VP64. VP64 is made up of four copies of VP16, a viral protein sequence of 16 amino acids that is used for transcriptional activation. Embodiments of the invention include various forms of VP64, for example a nucleic acid comprising dCas9 and/or VP64, or plasmids or vectors that encode the dCas9 and/or VP64 genes. One non-limiting example includes pcDNA-dCas9-VP64 (Plasmid #47107, from Addgene). Additional elements can be present in the nucleic acid encoding dCas9 and/or VP64, as in for example lenti vector EF1a-NLS-dCas9(N863)-VP64-2A-Blast-WPRE (Plasmid #61425 from Addgene), which additionally encodes a 2A Blast resistance marker. Another non-limiting example includes plasmid pLV hUbC-VP64 dCas9 VP64-T2A-GFP (Plasmid #59791 from Addgene) that co-expresses human optimized *S. pyogenes* dCas9 fused to two copies of VP64 and GFP.

Certain embodiments of the invention utilize the VP64-p65-Rta, or VPR, in which a VP64 transcriptional activator is joined to the C terminus of dCas9. In the dCas9-VPR protein, the transcription factors p65 and Rta are added to the C terminus of dCas9-VP64. Therefore, all three transcription factors are targeted to the same gene. The use of three transcription factors, as opposed to solely VP64, results in increased expression of targeted genes. dCas9-VPR can be used to increase expression of multiple genes within the same cell by putting multiple sgRNAs into the same cell.

In certain embodiments, the invention utilizes the Synergistic Activation Mediator (SAM) system. SAM makes use of not only VP64 but also sgRNA 2.0, which contains a sequence to recruit a viral protein fused to even more effectors (p65-hsf1). In one embodiment the SAM complex comprises dCas9-VP64, sgRNA, MS2-p65HSF-1. In one embodiment, the CRISPRa system comprises a nucleic acid encoding dCas9-VP64, a nucleic acid encoding MS2-p65-HSF1, and a genome-scale lentiviral SAM CRISPRa sgRNA library. Administering this type of CRISPRa system to a plurality of cells results in a highly diverse population of cells encompassing the entire sgRNA library.

The invention should be construed to work with any alternative activator, such as VP16, VP160, p65AD, p300 or any other transcriptional activator.

The invention should also be construed to work with any dCas9/CRISPRa system or any other adaptor system known in the art, including but not limited to: 1) RNA Scaffolds, which also utilizes sgRNA 2.0 and recruits 3 viral proteins fused to VP64.2) Suntag, which sports a protruding chain of 10 peptide epitopes that are recognized by an entourage of antibodies fused to VP64.3) The epigenetic editor p300, which deposits activating H3K27ac. 4) VP160, which is also known as CRISPR-on and has ten times the VPs of VP16. 5) VP64-dCas9-BFP-VP64, which makes use of that much neglected N-terminus.

Methods of Treatment

A. Cell-Based:

The present invention includes methods for treating or preventing cancer in a subject comprising administering to the subject a cell that has been modified by the CRISPR activation (CRISPRa) system to induce expression of endogenous genes. This type of cell-based vaccine/composition can be utilized as a prophylactic treatment, a therapeutic treatment, a personalized, subject-specific treatment, and/or a method of turning 'cold' tumor into a 'hot' tumor, thus making it more susceptible to immunotherapy.

In one aspect, the invention includes a method of preventing cancer in a subject comprising contacting a cell with a composition comprising a CRISPR activation (CRISPRa) system, wherein the CRISPRa system increases expression of a plurality of endogenous genes. A therapeutically effective amount of a composition comprising the cell is administered to the subject, thus preventing cancer in the subject. This method is considered a type of prophylactic cancer treatment, or a method of protecting a subject from developing cancer, or a method of preventing the development of cancer in a subject, or a method of generating an anti-tumor response in a subject.

In another aspect, the invention includes a method of treating cancer in a subject in need thereof. The method comprises contacting a cell with a composition comprising a CRISPRa system, wherein the CRISPRa system increases expression of a plurality of endogenous genes, and administering a therapeutically effective amount of a composition comprising the cell to the subject, thus treating the cancer in the subject.

Another aspect of the invention includes a method of treating cancer in a subject in need thereof. The method comprises obtaining a first cancer cell from the subject and determining at least one mutated endogenous gene, then designing a CRISPRa system comprising an sgRNA library specific for the mutated endogenous gene. A second cancer cell from the subject is then contacted with a composition comprising the CRISPRa system, wherein the CRISPRa system increases expression of the mutated endogenous gene. A therapeutically effective amount of a composition comprising the cell is administered to the subject, thus treating the cancer in the subject. In certain embodiments, the cell comprises a plurality of mutated endogenous genes, and the activation system comprises an sgRNA library specific for the plurality of mutated endogenous genes, and increases expression of the plurality of mutated endogenous genes. In certain embodiments, the sgRNA library comprises at least one sequence selected from the group consisting of SEQ ID NOs. 1-37. In certain embodiments, the sgRNA library comprises at least one sequence selected from the group consisting of SEQ ID NOs. 51-259. In certain embodiments, the sgRNA library comprises at least one sequence selected from the group consisting of SEQ ID NOs. 260-348. In certain embodiments, the sgRNA library comprises at least one sequence selected from the group consisting of SEQ ID NOs. 349-4,187. In certain embodiments, the sgRNA library comprises at least one sequence selected from the group consisting of SEQ ID NOs. 4,188-7,980. In certain embodiments, the sgRNA library comprises at least one sequence selected from the group consisting of SEQ ID NOs. 7,981-11,808. In certain embodiments, the sgRNA library comprises at least one sequence selected from the group consisting of SEQ ID NOs. 11,809-23,776. In certain embodiments, the sgRNA library comprises at least one sequence selected from the group consisting of SEQ ID NOs. 23,779-23,885. In certain embodiments, the sgRNA library comprises at least one sequence selected from the group consisting of SEQ ID NOs. 23,886-24,104.

With regard to any and all sgRNA libraries disclosed herein, it should be understood by one of ordinary skill in the art that when it is stated that the library comprises at least one sgRNA, it should be construed that the library can comprise one or more sgRNAs, all sgRNAs in the library, and and all integer values and numerical ranges of sgRNAs there between. For example, an sgRNA library comprising a total of 219 sgRNAs (e.g. SEQ ID NOs. 23,886-24,104) can comprise one sgRNA, all 219 sgRNAs, or and any and all integer values between 1 and 219. In other words, the library could include 1, 10, 20, 50, 100, 150, 200, or 219 sgRNAs and any and all values in between.

B. Vector-Based:

The invention also includes a vector-based vaccine/composition useful for treating or preventing cancer. The vector comprises the CRISPR activation (CRISPRa) system used to induce expression of endogenous genes and the vector provides a delivery vehicle for administration to a subject. This type of vector-based vaccine/composition can be utilized as a prophylactic treatment, a therapeutic treatment, a personalized, subject-specific treatment, and a method of turning 'cold' tumor into a 'hot' tumor, thus making it more susceptible to immunotherapy.

One aspect of the invention includes a method of treating cancer in a subject in need thereof comprising administering to the subject a therapeutically effective amount of a composition comprising a vector comprising a CRISPRa system, wherein the CRISPRa system increases expression of at least one endogenous gene, thus treating the cancer in the subject.

The vector can be any vector that can carry the gene, including but not limited to, standard viral vectors, chimeric viral vectors, other viral vectors, bacterial vectors, yeast vectors, DNA vectors, mRNA, protein carriers, nanomaterials, or other delivery vehicles. Applicable standard viral vectors for delivery include the vectors from the following types of viruses: dsDNA viruses (e.g. Adenoviruses, Herpesviruses, Poxviruses), ssDNA viruses (+ strand or "sense") DNA (e.g. Parvoviruses), dsRNA viruses (e.g. Reoviruses), (+)ssRNA viruses (+ strand or sense) RNA (e.g. Picornaviruses, Togaviruses), (–)ssRNA viruses (– strand or antisense) RNA (e.g. Orthomyxoviruses, Rhabdoviruses), ssRNA-RT viruses (+ strand or sense) RNA with DNA intermediate in life-cycle (e.g. Retroviruses), and dsDNA-RT viruses DNA with RNA intermediate in life-cycle (e.g. Hepadnaviruses).

In certain embodiments of the invention, the cells are packaged into an AAV vector. Applicable AAV serotypes include, but are not limited to, AAV1, AAV2, AAV3, AAV4, AAV5, AAV6, AAV7, AAV8, AAV9, AAV10, AAV11, AAV12, artificial variants such as AAV.rhlO, AAV.rh32/33, AAV.rh43, AAV.rh64R1, rAAV2-retro, AAV-DJ, AAV-PHP.B, AAV-PHP.S, AAV-PHP.eB, or other engineered versions of AAV. In one embodiment, the AAV vector is AAV9. In one embodiment, the CRISPRa system is cloned into an AAV vector.

In certain embodiments of the invention, the CRISPRa system comprises an sgRNA library, wherein the sgRNA library comprises a plurality of sgRNAs that target endogenous genes in the cell. In certain embodiments, the CRISPRa system comprises a nucleic acid encoding dCas9-VP64, a nucleic acid encoding MS2-p65-HSF1, and a genome-scale lentiviral SAM CRISPRa sgRNA library. In certain embodiments, the sgRNA library comprises at least one sequence selected from the group consisting of SEQ ID NOs. 1-37. In certain embodiments, the sgRNA library comprises at least one sequence selected from the group consisting of SEQ ID NOs. 51-259. In certain embodiments, the sgRNA library comprises at least one sequence selected from the group consisting of SEQ ID NOs. 260-348. In certain embodiments, the sgRNA library comprises at least one sequence selected from the group consisting of SEQ ID NOs. 349-4,187. In certain embodiments, the sgRNA library comprises at least one sequence selected from the group consisting of SEQ ID NOs. 4,188-7,980. In certain embodiments, the sgRNA library comprises at least one sequence selected from the group consisting of SEQ ID NOs. 7,981-11,808. In certain embodiments, the sgRNA library comprises at least one sequence selected from the group consisting of SEQ ID NOs. 11,809-23,776. In certain embodiments, the sgRNA library comprises at least one sequence selected from the group consisting of SEQ ID NOs. 23,779-23,885. In certain embodiments, the sgRNA library comprises at least one sequence selected from the group consisting of SEQ ID NOs. 23,886-24,104.

The cell or cells utilized in the invention can be from any source known to one of ordinary skill in the art. The cells of the invention may be autologous, allogeneic or xenogeneic with respect to the subject undergoing treatment. In some embodiments, the cell is from a cancer cell line. In some embodiments, the cell is from the subject. In some embodiments, the cell from the subject is a cancer cell. In further embodiments, the cancer cell is from a tumor. In some embodiments, the subject is a mammal. In further embodiments, the subject is a human.

The cells or vectors of the present invention may be administered in a manner appropriate to the disease to be treated or prevented. The quantity and frequency of administration will be determined by such factors as the condition of the patient, and the type and severity of the patient's disease, although appropriate dosages may be determined by clinical trials. Cells or vectors of the invention can be administered in dosages and routes and at times to be determined in appropriate pre-clinical and clinical experimentation and trials. Cell and vector compositions may be administered multiple times at various dosages. Administration of the cells or vectors of the invention may be combined with other methods useful to treat the desired disease or condition as determined by those of skill in the art. In one embodiment, administering the therapeutically effective amount of the composition comprises a one dose, a two dose, a three dose, a four dose, or a multi-dose treatment. The administration of the modified cells or vectors of the invention may be carried out in any convenient manner known to those of skill in the art. In one embodiment, the cells are administered intratumorally.

Certain embodiments of the invention further comprise contacting the cell with a substance that induces senescence in the cell prior to administering to the subject. In one embodiment, the substance that induces senescence in the cell is mitomycin.

The invention includes compositions and methods for treating cancer. Types of cancer that can be treated include, but are not limited to, Acute Lymphoblastic Leukemia (ALL), Acute Myeloid Leukemia (AML), Adrenocortical Carcinoma, AIDS-Related Cancers, Kaposi Sarcoma, AIDS-Related Lymphoma, Primary CNS Lymphoma, Anal Cancer, Appendix Cancer (Gastrointestinal Carcinoid Tumors), Astrocytomas, Atypical Teratoid/Rhabdoid Tumor, Brain Cancer, Basal Cell Carcinoma of the Skin, Bile Duct Cancer, Bladder Cancer, Bone Cancer (includes Ewing Sarcoma and Osteosarcoma and Malignant Fibrous Histiocytoma), Brain Tumors, Breast Cancer, Bronchial Tumors, Burkitt Lymphoma, Non-Hodgkin Lymphoma, Carcinoid Tumors, Carcinoma of Unknown Primary, Cardiac (Heart) Tumors, Embryonal Tumors, Germ Cell Tumor, Primary CNS Lymphoma, Cervical Cancer, Cholangiocarcinoma, Chordoma, Chronic Lymphocytic Leukemia (CLL), Chronic Myelogenous Leukemia (CML), Chronic Myeloproliferative Neoplasms, Colorectal Cancer, Craniopharyngioma, Cutaneous T-Cell Lymphoma (Mycosis Fungoides and Sézary Syndrome), Ductal Carcinoma In Situ (DCIS), Endometrial Cancer, Ependymoma, Esophageal Cancer, Esthesioneuroblastoma, Ewing Sarcoma, Extracranial Germ Cell Tumor, Eye Cancer, Intraocular Melanoma, Fallopian Tube Cancer, Fibrous Histiocytoma of Bone, Osteosarcoma, Gallbladder Cancer, Gastric Cancer, Stomach Cancer, Gastrointestinal Carcinoid Tumor, Gastrointestinal Stromal Tumors (GIST), Central Nervous System Germ Cell Tumors, Extracranial Germ Cell Tumors, Extragonadal Germ Cell Tumors, Ovarian Germ Cell Tumors, Testicular Cancer, Gestational Trophoblastic Disease, Hairy Cell Leukemia, Head and Neck Cancer, Heart Tumors, Hepatocellular (Liver) Cancer, Histiocytosis (Langerhans Cell), Hodgkin Lymphoma, Hypopharyngeal Cancer, Intraocular Melanoma, Islet Cell Tumors, Pancreatic Neuroendocrine Tumors, Kidney Cancer, Renal Cell Cancer, Langerhans Cell Histiocytosis, Laryngeal Cancer, Leukemia, Lip and Oral Cavity Cancer, Liver Cancer, Lung Cancer (Non-Small Cell and Small Cell), Lymphoma, Male Breast Cancer, Malignant Fibrous Histiocytoma of Bone and Osteosarcoma, Melanoma, Intraocular (Eye) Melanoma, Merkel Cell Carcinoma (Skin Cancer), Malignant Mesothelioma, Metastatic Cancer, Metastatic Squamous Neck Cancer with Occult Primary, Midline Tract Carcinoma With NUT Gene Changes, Mouth Cancer, Multiple Endocrine Neoplasia Syndromes, Multiple Myeloma/Plasma Cell Neoplasms, Mycosis Fungoides (Lymphoma), Myelodysplastic Syndromes, Myelodysplastic/Myeloproliferative Neoplasms, Nasal Cavity and Paranasal Sinus Cancer, Nasopharyngeal Cancer, Neuroblastoma, Non-Small Cell Lung Cancer, Oral Cancer, and Oropharyngeal Cancer, Ovarian Cancer, Pancreatic Cancer, Papillomatosis, Paraganglioma, Paranasal Sinus and Nasal Cavity Cancer, Parathyroid Cancer, Penile Cancer, Pharyngeal Cancer, Pheochromocytoma, Pituitary Tumor, Plasma Cell Neoplasm/Multiple Myeloma, Pleuropulmonary Blastoma, Primary Central Nervous System (CNS) Lymphoma, Primary Peritoneal Cancer, Prostate Cancer, Rectal Cancer Recurrent Cancer, Retinoblastoma, Rhabdomyosarcoma, Salivary Gland Cancer, Sarcoma, Vascular Tumors, Uterine Sarcoma, Sézary Syndrome (Lymphoma), Small Cell Lung Cancer, Small Intestine Cancer, Soft Tissue Sarcoma, Squamous Cell Carcinoma, Stomach (Gastric) Cancer, Throat Cancer, Thymoma, Thymic Carcinoma, Thyroid Cancer, Transitional Cell Cancer of the Renal Pelvis and Ureter, Carcinoma of Unknown Primary, Ureter and Renal Pelvis, Transitional Cell Cancer, Urethral Cancer, Uterine Cancer, Vaginal Cancer, Vulvar Cancer, Wilms Tumor, and combinations thereof.

Certain embodiments of the invention further comprise administering an additional treatment to the subject. Certain embodiments of the invention include treating the subject with a combination of a composition of the present invention and an additional treatment. Examples of additional treatments include but are not limited to, chemotherapy, radiation, surgery, medication, immune checkpoint inhibitors, immune checkpoint blockade (ICB) antibodies, immune checkpoint inhibitors that block CTLA-4 or PD1, anti-CTLA4 monoclonal antibody, anti-PD1 monoclonal antibody, anti-PD-L1 monoclonal antibody, adoptive cell transfer, human recombinant cytokines, cancer vaccines, immunotherapy, targeted therapy, hormone therapy, stem cell transplant, precision medicine, non-specific immunotherapy (e.g. cytokines and chemokines, such as IL-2, IFNa, IFNb, IFNg), oncolytic virus therapy, T-cell therapy (e.g. adoptive transfer of TILs, TCR-T, CAR-T), cancer vaccines (e.g. conventional DC vaccine), Ipilimumab (Yervoy), Nivolumab (Opdivo), Pembrolizumab (Keytruda), Atezolizumab (Tecentriq), Avelumab (Bavencio), Durvalumab (Imfinzi), Anti-LAG-3, anti-TIM1, Anti-TIM3, Anti-CSF-R, IDO inhibitor, OX-40 agonist, GITR agonist, CD80 agonist, CD86 agonist, ICOS agonist, ICOSLG agonist, CD276 agonist, VTCN1 agonist, TNFSF14 agonist, TNFSF9 agonist, TNFSF4 agonist, CD70 agonist, CD40 agonist, LGALS9 agonist, CD80 inhibitor, CD86 inhibitor, ICOS inhibitor, ICOSLG inhibitor, CD276 inhibitor, VTCN1 inhibitor, TNFSF14 inhibitor, TNFSF9 inhibitor, TNFSF4 inhibitor, CD70 inhibitor, CD40 inhibitor, LGALS9 inhibitor, TLR9 agonist, CD20 antibody, CD80 antibody, TIGIT antibody, B7-H1 antibody, B7-H2 antibody, B7-H3 antibody, B7-H4 antibody, CD28 antibody, CD47 antibody, anti-BTLA, anti-Galetin9, anti-IL15R, anti-GD2. In some embodiments the monoclonal antibody is fully human, humanized or chimeric.

In certain embodiments, administering a composition of the present invention alters the tumor microenvironment. In certain embodiments, administering the composition augments host immune responses against established tumors.

Certain aspects of the invention include determining subject-specific, or individualized mutations in a gene or genes of the subject. This determination can be carried out by any means known to one of ordinary skill in the art. For example, whole-genome-sequencing (WGS) and/or molecular inversion probe sequencing (MIPS)(Chow et al. 2018) provide other non-limiting ways of determining the subject-specific mutated endogenous gene or genes. In one embodiment, determining the subject-specific mutated endogenous gene or genes comprises whole-exome sequencing of a cancer cell and whole-exome sequencing of a non-cancer cell from the subject. The sequencing data from the cancer cell and the non-cancer cell are compared, determining at least one mutation. By this, the subject-specific mutated endogenous gene or genes are determined. Any type of mutation can be determined, including but not limited to single nucleotide polymorphisms (SNP), insertions, deletions, frameshifts, and rearrangements.

Certain aspects of the invention include activating or increasing expression of a subset of endogenous genes, for example, but not limited to those enhancing immune cell functions such as antigen-presentation. In certain embodiments sgRNAs are designed against the aforementioned endogenous genes or a subset of these genes. In certain embodiments the sgRNAs are selected from a minipool of 6 selected human antigen presentation genes, with multiple sgRNAs per gene. In one embodiment the sgRNAs are selected from the group consisting of SEQ ID NOs: 1-37. In one embodiment the sgRNAs are selected from the group consisting of SEQ ID NOs: 51-259. In certain embodiments the sgRNAs are selected from a minipool of 29 selected immune function genes related to antigen presentation. In certain embodiments the sgRNAs are selected from the group consisting of SEQ ID NOs: 260-348. In certain embodiments the sgRNAs are selected from the group consisting of 23,779-23,885. In certain embodiments the sgRNAs are selected from the group consisting of 23,886-24,104. In certain embodiments, the sgRNAs are designed to target endogeneous mutant genes present in a variety of cancers (e.g. melanoma, glioma, hepatoma, colon cancer, and pancreatic cancer). In certain embodiments the sgRNAs are selected from the group consisting of SEQ ID NOs. 11,809-23,776. These "off the shelf" sgRNA pools and minipools can be administered to a subject in conjunction with compositions and methods of the present invention, without the need for sequencing individualized tumors.

Alternatively, personalized sgRNA minipools can be designed wherein a subject's tumor is sequenced, and sgRNAs are designed specific to that subject's cancer type/ mutations. Examples of personalized sgRNA minipools described herein include: E0771 (TNBC) exome based PCAVac sgRNAs (SEQ ID NOs: 349-4,187), GL261 (GBM)

exome based PCAVac sgRNAs (SEQ ID NOs: 7,981-11, 808), and Lewis (Lung) exome based PCAVac sgRNAs (SEQ ID NOs: 4,188-7,980).

TABLE 1

| sgRNAs selected from a minipool of human antigen presentation genes | | | | | |
|---|---|---|---|---|---|
| Gene Name | Transcript ID | TSS Distance | Guide Sequence | Top/ Bottom | SEQ ID NO: |
| CD70 | NM_001252 | 145 | GGCGGGGAGGGGTTGGGGGC | b | 1 |
| CD70 | NM_001252 | 166 | ATGTCTCCTGCCTGAAGGTC | b | 2 |
| CD70 | NM_001252 | 103 | CAGGATGCAGGCAGTGGCCC | t | 3 |
| CD70 | NM_001252 | 82 | CAACTGCCTCCACCCACTTT | b | 4 |
| CD70 | NM_001252 | 2 | ATGTCCGGCCGGTCGAGGGG | t | 5 |
| CD70 | NM_001252 | 55 | TCAGACTGGCAGCGGTTGGA | b | 6 |
| CD70 | NM_001252 | 124 | GGCAACTCTGAGGCTCACCC | b | 7 |
| CD70 | NM_001252 | 23 | GGGACTTGAGCAATTGGCGA | t | 8 |
| CD80 | NM_005191 | 153 | TTCTCCTCCCCTAGGCCGCC | b | 9 |
| CD80 | NM_005191 | 100 | GCCTCCCTCACCACCGTGCA | t | 10 |
| CD80 | NM_005191 | 61 | GCTTTTGTAGAGGCTGTGGC | t | 11 |
| CD80 | NM_005191 | 7 | CAAACACCCTGTCCAACTCC | b | 12 |
| CD80 | NM_005191 | 38 | TAGAAGAAGACGGCAGCAGA | b | 13 |
| CD80 | NM_005191 | 174 | AATGGTGCCCGAGAAGAGTG | t | 14 |
| CD80 | NM_005191 | 132 | CATGAAACACCACGAGCACC | t | 15 |
| CD86 | NM_001206924 | 7 | TTAAAGAAAGTTAGCTGGGT | t | 16 |
| CD86 | NM_001206924 | 87 | GAGTTTAAACTGCAAGGAAA | t | 17 |
| CD86 | NM_001206924 | 41 | TCAAAATCTGTAGAGAAAAG | t | 18 |
| CD86 | NM_001206924 | 64 | TTAAATTTCTTCCTCAAGTG | t | 19 |
| CD86 | NM_001206924 | 162 | GCTCATCTTAACGTCATGTC | t | 20 |
| CD86 | NM_006889 | 134 | CTCCCTTTGGGGGTTTCCCA | t | 21 |
| CD86 | NM_006889 | 8 | AGAGAAACAACACCACAGCC | b | 22 |
| CD86 | NM_006889 | 157 | CTTTGTCATGTTTGTGGATG | t | 23 |
| CD86 | NM_006889 | 29 | CCAAGCAAGAGCACTGTCCC | t | 24 |
| CD86 | NM_006889 | 50 | TCCAAATAACTTCTGCCGGC | b | 25 |
| CD86 | NM_006889 | 85 | TTTGTAGTCATTCTCATCAG | t | 26 |
| CD86 | NM_006889 | 112 | GCTTTACACTCATGCTCCGA | t | 27 |
| IFNA4 | NM_021068 | 0 | GAAGACTTTGCTCTGTGCAT | t | 28 |
| IFNA4 | NM_021068 | 152 | TATTTTTCACCTGCACTCAA | t | 29 |
| IFNA4 | NM_021068 | 51 | CAACTAGGGAATTTAGAAAA | b | 30 |
| IFNB1 | NM_002176 | 64 | TGAAAGGGAGAAGTGAAAGT | b | 31 |
| IFNB1 | NM_002176 | 33 | ATGGTCCTCTCTCTATTCAG | t | 32 |
| IFNG | NM_000619 | 155 | AGAGTTTCCTTTAGACTCCT | t | 33 |
| IFNG | NM_000619 | 8 | TAAATACCAGCAGCCAGAGG | b | 34 |
| IFNG | NM_000619 | 33 | ATCCTCAGGAGACTTCAATT | b | 35 |
| IFNG | NM_000619 | 121 | AACTAAGGTTTTGTGGCATT | t | 36 |
| IFNG | NM_000619 | 75 | AAGATGAGATGGTGACAGAT | t | 37 |

Additional sequences for cloning synthesized libraries into:
Subpool amplification (SPA) primers:

SPA_1F      CGGGTTCCGTGGAAAGG (SEQ ID NO: 38)

SPA_1Rms2 ttctattctaagcCTCATGTTggcc (SEQ ID NO: 39)

SPA_2F      GTTTATCGGGCGGAAAGG (SEQ ID NO: 40)

SPA_2Rms2 GGTACAGTAAGTCTCATGTTggcc (SEQ ID NO: 41)

SPA_3F      aCCGATGTTGACGGAAAGG (SEQ ID NO: 42)

SPAv3Rms2 GCTATTACGAGCTCATGTTggcc (SEQ ID NO: 43)

SPAv4F      GAGGTCTTTCATGCGGAAAGG (SEQ ID NO: 44)

SPA_Rms2  TATGTTGTGCTCATGTTggcc (SEQ ID NO: 45)

AF          taacttgaaagtatttcgatttcttggctttatatatc
            ttGTGGAAAGGACGAAACACCg (SEQ ID NO: 46)

AR          actattcaagttgataacggactagccttatttt
            aacttgctaTTTCtagctctaaaac (SEQ ID NO: 47)

ARms2     attttaacttgctaggccCTGCAGACATGGGTGATCC
            TCATGTTggcctagctctaaaac (SEQ ID NO: 48)

TABLE 2

| sgRNAs selected from a minipool of immune function genes | | |
| --- | --- | --- |
| Gene | sgRNA Sequence | SEQ ID NO |
| CD70 | CAGTCTGAAGATCCTAAAGT | 51 |
| CD70 | TCTGAAGATCCTAAAGTGGG | 52 |
| CD70 | AATCCCTAATAAATGTGCAG | 53 |
| CD70 | TACTTGCTTCAACCTGTCAG | 54 |
| CD70 | GGACTTGAGCAATTGGCGAG | 55 |
| CD70 | CCACTTTAGGATCTTCAGAC | 56 |
| CD70 | GAAGATCCTAAAGTGGGTGG | 57 |
| CD70 | TCCCCGCCCGACCTTCAGGC | 58 |
| CD70 | TCAGACTGGCAGCGGTTGGA | 59 |
| CD70 | ATCTTCAGACTGGCAGCGGT | 60 |
| CD70 | TGGGCCCCAGAAGAATGAGG | 61 |
| CD70 | GCAACTCTGAGGCTCACCCG | 62 |
| CD70 | CTCTCCACCTCATTCTTCTG | 63 |
| CD70 | CGGGGCCACTGCCTGCATCC | 64 |
| CD70 | TCTCCTGCCTGAAGGTCGGG | 65 |
| CD70 | GGCCGGACATCCCCAGAGAG | 66 |
| CD70 | GGGACTTGAGCAATTGGCGA | 67 |
| CD70 | ATTGAATGTCTCCTGCCTGA | 68 |
| CD70 | CCCTAATAAATGTGCAGTGG | 69 |
| CD70 | GAATGGGCCCCAGAAGAATG | 70 |
| CD70 | AGGGACTTGAGCAATTGGCG | 71 |
| CD70 | GGGCAGGCTGGTCCCCTGAC | 72 |
| CD70 | GGGGATGTCCGGCCGGTCGA | 73 |
| CD70 | TTCAGACTGGCAGCGGTTGG | 74 |
| CD70 | CCAGTCTGAAGATCCTAAAG | 75 |
| CD70 | CCGGCCGGACATCCCCAGAG | 76 |
| CD70 | AGGCAACTCTGAGGCTCACC | 77 |
| CD70 | CCTCTCTGGGGATGTCCGGC | 78 |
| CD70 | CTCAAGTCCCTCCCCTCGAC | 79 |
| CD70 | TCCTGCCTGAAGGTCGGGCG | 80 |
| CD70 | AGTCCCTCCCCTCGACCGGC | 81 |
| CD70 | CGGCCGGACATCCCCAGAGA | 82 |
| CD70 | GGGATGTCCGGCCGGTCGAG | 83 |
| CD70 | CCCAGAAGAATGAGGTGGAG | 84 |
| CD70 | GACCAGCCTGCCCCTCTCTG | 85 |
| CD70 | AGTGGGTGGAGGCAGTTGCC | 86 |
| CD70 | ATGTCTCCTGCCTGAAGGTC | 87 |

TABLE 2-continued

| sgRNAs selected from a minipool of immune function genes | | |
| --- | --- | --- |
| Gene | sgRNA Sequence | SEQ ID NO |
| CD70 | TCTACTTGCTTCAACCTGTC | 88 |
| CD70 | CAGAAGAATGAGGTGGAGAG | 89 |
| CD70 | TGCCCCTCTCTGGGGATGTC | 90 |
| CD70 | CTACTTGCTTCAACCTGTCA | 91 |
| CD70 | CCCCTCCCCGCCCGACCTTC | 92 |
| CD70 | AATGTCTCCTGCCTGAAGGT | 93 |
| CD70 | GGAGGCAGTTGCCAGGATGC | 94 |
| CD70 | AGGATGCAGGCAGTGGCCCC | 95 |
| CD70 | TAGGATCTTCAGACTGGCAG | 96 |
| CD70 | CTCCTGCCTGAAGGTCGGGC | 97 |
| CD70 | CCCTCTCCACCTCATTCTTC | 98 |
| CD70 | CCAGAAGAATGAGGTGGAGA | 99 |
| CD70 | TGTCCGGCCGGTCGAGGGGA | 100 |
| CD70 | CCTCTCCACCTCATTCTTCT | 101 |
| CD70 | AGTTGCCAGGATGCAGGCAG | 102 |
| CD70 | TGGGGATGTCCGGCCGGTCG | 103 |
| CD70 | GGGACCAGCCTGCCCCTCTC | 104 |
| CD70 | AGGTTTGTTGAATAAATGAA | 105 |
| CD70 | GGACATCCCCAGAGAGGGGC | 106 |
| CD70 | GTTGGGGGCAGGCAACTCTG | 107 |
| CD70 | GGTTTGTTGAATAAATGAAT | 108 |
| CD70 | ATGTCCGGCCGGTCGAGGGG | 109 |
| CD70 | GGCAACTCTGAGGCTCACCC | 110 |
| CD70 | CCTGAAGGTCGGGCGGGGAG | 111 |
| CD70 | GCCTGAAGGTCGGGCGGGGA | 112 |
| CD70 | AGGGGAGGGACTTGAGCAAT | 113 |
| CD70 | ATCCCCAGAGAGGGGCAGGC | 114 |
| CD70 | TGCCTGAAGGTCGGGCGGGG | 115 |
| CD70 | GGTCGGGCGGGGAGGGGTTG | 116 |
| CD70 | CAACTGCCTCCACCCACTTT | 117 |
| CD70 | GTCGGGCGGGGAGGGGTTGG | 118 |
| CD70 | CAGGATGCAGGCAGTGGCCC | 119 |
| CD70 | GGCGGGGAGGGGTTGGGGGC | 120 |
| CD70 | AATGAGGTGGAGAGGGGAAT | 121 |
| CD70 | GGACCAGCCTGCCCCTCTCT | 122 |
| CD70 | AGGTCGGGCGGGGAGGGGTT | 123 |
| CD70 | AAGGTCGGGCGGGGAGGGGT | 124 |

TABLE 2-continued

TABLE 2-continued

| | sgRNAs selected from a minipool of immune function genes | | | | sgRNAs selected from a minipool of immune function genes | |
|---|---|---|---|---|---|---|
| Gene | sgRNA Sequence | SEQ ID NO | | Gene | sgRNA Sequence | SEQ ID NO |
| CD80 | GTTTGTTAGTCCATGCACGG | 125 | | CD80 | GCTTTTGTAGAGGCTGTGGC | 162 |
| CD80 | TCAGTGCCAGGAGTTGGACA | 126 | | CD80 | GGGAGGCCAGCTTCATGGGC | 163 |
| CD80 | TGGTGCCCGAGAAGAGTGAG | 127 | | CD80 | TGGGCTGGCTGTTTCTGTGC | 164 |
| CD80 | TAGAAGAAGACGGCAGCAGA | 128 | | CD80 | AGTTGCTTTTGTAGAGGCTG | 165 |
| CD80 | TAGTCCATGCACGGTGGTGA | 129 | | CD80 | TTCTCCTCCCCTAGGCCGCC | 166 |
| CD80 | ATGGTGCCCGAGAAGAGTGA | 130 | | CD80 | AGATGCCCCTCACTCTTCTC | 167 |
| CD80 | ACGAGCACCAGGCGGCCTAG | 131 | | CD80 | GTGATGGGAGGCCAGCTTCA | 168 |
| CD80 | CATGAAACACCACGAGCACC | 132 | | CD86 | CAGTTTAAACTCATTGACGT | 169 |
| CD80 | GAAACACCACGAGCACCAGG | 133 | | CD86 | ACAGATTTTGACCACACTTG | 170 |
| CD80 | CAAACACCCTGTCCAACTCC | 134 | | CD86 | TTTTTTGAGGGAATTTCAAG | 171 |
| CD80 | CATGTTTGTTAGTCCATGCA | 135 | | CD86 | TCAAAATCTGTAGAGAAAAG | 172 |
| CD80 | TAGCCTTGCTGTGTGATGGG | 136 | | CD86 | TTAAATTTCTTCCTCAAGTG | 173 |
| CD80 | ACTCAGTACTTGTCAGTGCC | 137 | | CD86 | GCTCATCTTAACGTCATGTC | 174 |
| CD80 | TCTTCTAGTTGCTTTTGTAG | 138 | | CD86 | ATTCTATTTTGTTGCTGCGG | 175 |
| CD80 | TGGCCTCCCATCACACAGCA | 139 | | CD86 | TTTTTGAGGGAATTTCAAGA | 176 |
| CD80 | TTAGTCCATGCACGGTGGTG | 140 | | CD86 | TTTATTCTATTTTGTTGCTG | 177 |
| CD80 | AATGGTGCCCGAGAAGAGTG | 141 | | CD86 | TTTTGAGGGAATTTCAAGAG | 178 |
| CD80 | GGCTAGCCTTGCTGTGTGAT | 142 | | CD86 | AGCAACAAAATAGAATAAAG | 179 |
| CD80 | TCCATGCACGGTGGTGAGGG | 143 | | CD86 | TGAGTTTAAACTGCAAGGAA | 180 |
| CD80 | TGATGGGAGGCCAGCTTCAT | 144 | | CD86 | TTCTCTTAAAGAAAGTTAGC | 181 |
| CD80 | TGGCTAGCCTTGCTGTGTGA | 145 | | CD86 | AGAGGGGAGATTTTTTATTC | 182 |
| CD80 | CCTAGGCCGCCTGGTGCTCG | 146 | | CD86 | TCTCTTAAAGAAAGTTAGCT | 183 |
| CD80 | CTAGAAGAAGACGGCAGCAG | 147 | | CD86 | GTCAATGAGTTTAAACTGCA | 184 |
| CD80 | CACCATTCTTCTCCTCCCCT | 148 | | CD86 | GAGTTTAAACTGCAAGGAAA | 185 |
| CD80 | AAACAGCCAGCCCATGAAGC | 149 | | CD86 | TTATTTTCTAGGTTTTTTGA | 186 |
| CD80 | CAAAAGCAACTAGAAGAAGA | 150 | | CD86 | TTAAAGAAAGTTAGCTGGGT | 187 |
| CD80 | CTTTTGTAGAGGCTGTGGCT | 151 | | CD86 | TTTATTTTCTAGGTTTTTTG | 188 |
| CD80 | AGCACCAGGCGGCCTAGGGG | 152 | | CD86 | TTCTAATTATTTTATTTTCT | 189 |
| CD80 | CACGAGCACCAGGCGGCCTA | 153 | | IFNA4 | AGAGATAGAAAGTACAACTA | 190 |
| CD80 | CCACGAGCACCAGGCGGCCT | 154 | | IFNA4 | CAGAGATAGAAAGTACAACT | 191 |
| CD80 | GTCAGTGCCAGGAGTTGGAC | 155 | | IFNA4 | TATTTTTCACCTGCACTCAA | 192 |
| CD80 | TACTTGTCAGTGCCAGGAGT | 156 | | IFNA4 | CCATAAAAGCCTTTGAGTGC | 193 |
| CD80 | TTTTGTAGAGGCTGTGGCTG | 157 | | IFNA4 | CAACTAGGGAATTTAGAAAA | 194 |
| CD80 | CAGATGCCCCTCACTCTTCT | 158 | | IFNA4 | CCTGCACTCAAAGGCTTTTA | 195 |
| CD80 | CGAGAAGAGTGAGGGGCATC | 159 | | IFNA4 | GAAGACTTTGCTCTGTGCAT | 196 |
| CD80 | GCCTCCCTCACCACCGTGCA | 160 | | IFNA4 | TTTGAGTGCAGGTGAAAAAT | 197 |
| CD80 | GGCCTAGGGGAGGAGAAGAA | 161 | | IFNA4 | AGTTTTTATCTGTGAAGTAG | 198 |

TABLE 2-continued

| | sgRNAs selected from a minipool of immune function genes | |
|---|---|---|
| Gene | sgRNA Sequence | SEQ ID NO |
| IFNA4 | AAATTTTAATAACACAGATT | 199 |
| IFNB1 | ATATAAATAGGCCATACCCA | 200 |
| IFNB1 | AAATTCCTCTGAATAGAGAG | 201 |
| IFNB1 | TAGGCCATACCCATGGAGAA | 202 |
| IFNB1 | CAAGACTTGGGAGAAAGCAA | 203 |
| IFNB1 | AAAAAGATTTACAAACTGTG | 204 |
| IFNB1 | GTTAGAATGTCCTTTCTCCA | 205 |
| IFNB1 | ATGGTCCTCTCTCTATTCAG | 206 |
| IFNB1 | TATTATATATATCATAAGAT | 207 |
| IFNB1 | TACTAAAATGTAAATGACAT | 208 |
| IFNB1 | ATGACATAGGAAAACTGAAA | 209 |
| IFNB1 | CAAATTGTAAAACAAGACTT | 210 |
| IFNB1 | TTAGAATGTCCTTTCTCCAT | 211 |
| IFNB1 | GAGGACCATCTCATATAAAT | 212 |
| IFNB1 | TATGGCCTATTTATATGAGA | 213 |
| IFNB1 | AATGACATAGGAAAACTGAA | 214 |
| IFNB1 | ATGTCCTTTCTCCATGGGTA | 215 |
| IFNB1 | TGAAAGGGAGAAGTGAAAGT | 216 |
| IFNB1 | TTTGAGGTTCTTGAATTCTC | 217 |
| IFNB1 | CTGAAAGGGAGAAGTGAAAG | 218 |
| IFNB1 | CTGTATCTTTTAGTGTTTTG | 219 |
| IFNB1 | ATCTTATGATATATATAATA | 220 |
| IFNB1 | TATCTTATGATATATATAAT | 221 |
| IFNB1 | GCAAATTGTAAAACAAGACT | 222 |
| IFNG | CATTTTACCAGGGCGAAGTG | 223 |
| IFNG | TGGGTCTGTCTCATCGTCAA | 224 |
| IFNG | TTCAAAGAATCCCACCAGAA | 225 |
| IFNG | TACCTAATTGAAGTCTCCTG | 226 |
| IFNG | AACATTTTACCAGGGCGAAG | 227 |
| IFNG | TGTGAAAATACGTAATCCTC | 228 |
| IFNG | GAATCCCACCAGAATGGCAC | 229 |
| IFNG | ACATTTTACCAGGGCGAAGT | 230 |
| IFNG | TCTCATCGTCAAAGGACCCA | 231 |
| IFNG | CCCACCAGAATGGCACAGGT | 232 |
| IFNG | GAGATGGTGACAGATAGGCA | 233 |
| IFNG | AAAGGACCCAAGGAGTCTAA | 234 |
| IFNG | ATCCTCAGGAGACTTCAATT | 235 |

TABLE 2-continued

| | sgRNAs selected from a minipool of immune function genes | |
|---|---|---|
| Gene | sgRNA Sequence | SEQ ID NO |
| IFNG | GTATAAATACCAGCAGCCAG | 236 |
| IFNG | AAGATGAGATGGTGACAGAT | 237 |
| IFNG | ATAGTTTGTATTAATAACTA | 238 |
| IFNG | ATGGCACAGGTGGGCATAAT | 239 |
| IFNG | TAAATACCAGCAGCCAGAGG | 240 |
| IFNG | TGAGATGGTGACAGATAGGC | 241 |
| IFNG | GAGTTTCCTTTAGACTCCTT | 242 |
| IFNG | TCCCACCAGAATGGCACAGG | 243 |
| IFNG | AAAAATTTCCAGTCCTTGAA | 244 |
| IFNG | ACTTCACACCATTCAAGGAC | 245 |
| IFNG | TTTACCAGGGCGAAGTGGGG | 246 |
| IFNG | GCCCACCTGTGCCATTCTGG | 247 |
| IFNG | TATTAATAACTAAGGTTTTG | 248 |
| IFNG | AACTAAGGTTTTGTGGCATT | 249 |
| IFNG | ACTAAGGTTTTGTGGCATTT | 250 |
| IFNG | CCCACCTGTGCCATTCTGGT | 251 |
| IFNG | ACAAGTTTTTTAAGATGAGA | 252 |
| IFNG | ACAATGTGCTGCACCTCCTC | 253 |
| IFNG | TATGCCCACCTGTGCCATTC | 254 |
| IFNG | CTTTTACTTCACACCATTCA | 255 |
| IFNG | AATGGCACAGGTGGGCATAA | 256 |
| IFNG | GCTGCACCTCCTCTGGCTGC | 257 |
| IFNG | AGAGTTTCCTTTAGACTCCT | 258 |
| IFNG | ATTCTGGTGGGATTCTTTGA | 259 |

TABLE 3

| | sgRNAs selected from a minipool of 29 selected immune function genes related to antigen presentation | |
|---|---|---|
| Gene Name | Guide Sequence | SEQ ID NO: |
| CD70F1 | GCTTCAGTTTGTCTGTGGGA | 260 |
| CD70F2 | ATTCACTGAGCATCTATTAG | 261 |
| CD70F3 | ATCAGGAAGCATCCGCATCC | 262 |
| CD80F1 | GAGAGTTCTGAATCAGGGTG | 263 |
| CD80F2 | TCCAGGCCTGTTCTGAGCAC | 264 |
| CD80F3 | GGACCTTTGAGTTGCCCTCA | 265 |
| CD83F1 | CCAAGTCCGCGTTGCTGCTG | 266 |

TABLE 3-continued

| | sgRNAs selected from a minipool of 29 selected immune function genes related to antigen presentation | |
|---|---|---|
| Gene Name | Guide Sequence | SEQ ID NO: |
| CD83F2 | ATCTGCATGACCCACTCGAT | 267 |
| CD83F3 | GTTTGAGGGTCATCTAGCTG | 268 |
| CD86F1 | GCAGGCAGGAGTGGGTGGGT | 269 |
| CD86F2 | CTTTGTAGATTATTCGAGTT | 270 |
| CD86F3 | GAGTTCGGTTTCAGTCTTGA | 271 |
| IFNa4F1 | AAAGAGAATTGGAAAGCAAG | 272 |
| IFNa4F2 | TGTGTACATCTCTCTTAAAT | 273 |
| IFNa4F3 | CAGGCTCTCAGAGAACCTGT | 274 |
| IFNb1F1 | GAAATTCCTCTGAGGCAGAA | 275 |
| IFNb1F2 | CCTGTGCTATTTATAAGGGA | 276 |
| IFNb1F3 | GTGAGAATGATCTTCCTTCA | 277 |
| IFNgF1 | AGAGTTTCCTTTCGACTCCT | 278 |
| IFNgF2 | TTAAGATGGTGACAGATAGG | 279 |
| IFNgF3 | ATACCTGATCGAAGGCTCCT | 280 |
| OX40LF1 | AAGTCACTCAATTCATAACT | 281 |
| OX40LF2 | CAACTCCCTGTTAGCCCGGA | 282 |
| GITRLF1 | AGTGCTTAGCAGTGTTCCAA | 283 |
| GITRLF2 | GCACCAGGCCAAACATACAA | 284 |
| GITRLF3 | CACTACAAGGGAAGTTCAGA | 285 |
| Flt3LF1 | CGCCACCTAGTGGTAACAAG | 286 |
| Flt3LF2 | GGGCCCTGAAAGGATAGCGA | 287 |
| Flt3LF3 | TTCTACATACACTTCGAAGC | 288 |
| LIGHT-F1 | TGTGACTCAGGTGGGATGGA | 289 |
| LIGHT-F2 | GAGGAGGTACGTGAGGAAAG | 290 |
| LIGHT-F3 | CAGTGAGAGTGATCGACCGG | 291 |
| ICOSL-F1 | GAGACTTGGGCATGAGTTAC | 292 |
| ICOSL-F2 | AACCCAATCGGCTGCTGAGC | 293 |
| ICOSL-F3 | CCGCCTGTGCCCAATTAGCC | 294 |
| 4-1BBL-F1 | CCCTCCCTCCCTTCCCTCCC | 295 |
| 4-1BBL-F2 | ACAGGGCCTGGACAGGGAAG | 296 |
| 4-1BBL-F3 | AGAAAGTTCCGGGAGTCGAG | 297 |
| TL1A-F1 | CAGAGGGCTGTCAGAGGGAG | 298 |
| TL1A-F2 | AACTTGGTTTCTGTTGTAGG | 299 |
| TL1A-F3 | ATTCCCTAGCCGGGCAGGGC | 300 |
| CD30L-F1 | AATTGTAGCGAGATAGACGA | 301 |
| CD30L-F2 | GTGGTTGGTGTACACTCACG | 302 |

TABLE 3-continued

| | sgRNAs selected from a minipool of 29 selected immune function genes related to antigen presentation | |
|---|---|---|
| Gene Name | Guide Sequence | SEQ ID NO: |
| CD30L-F3 | CGTTCTGTGGCTGAGCCTAA | 303 |
| TAP1F1 | TGCAGGCAACTTGCAGACTG | 304 |
| TAP1F2 | TTCACGCAAGCAAGTTAAGG | 305 |
| TAP1F3 | CGTGCCGTTCTACCAGCATT | 306 |
| B2M-F1 | ACGACCTCCGGATCTGAGTC | 307 |
| B2M-F2 | CCGTGATATTTCAAACAGCC | 308 |
| B2M-F3 | AGCATCAACAGCTAGGAGAC | 309 |
| CXCL9-F1 | AAACCCTACTCTCAGATCCC | 310 |
| CXCL9-F2 | TAGTTCTTCTAGGTCAGCTG | 311 |
| CXCL9-F3 | TAACCACAAATTGATCGTCC | 312 |
| CXCL10-F1 | ACTTTGGAGATGACTCAGCA | 313 |
| CXCL10-F2 | TTTATTGTGACCCATGAACT | 314 |
| CXCL10-F3 | GCAATGCCCTCGGTTTACAG | 315 |
| Tsn-F1 | GCGGAGTCTAGGCTGATAAA | 316 |
| Tsn-F2 | GGTCTGGGAACGCGGGAGTG | 317 |
| Tsn-F3 | TATTTATTGGTCACTTCACT | 318 |
| TAPBPR F1 | CTCCAGCCCTCTCATAGTTG | 319 |
| TAPBPR F2 | AGGATTTAACATGGACTGAA | 320 |
| TAPBPR F3 | CTGTGATCGAACAGACGAGA | 321 |
| PDIA3-F1 | GCAGTGTGGCAGCCGCCGAT | 322 |
| PDIA3-F2 | AACAGCTGGTAACTGCCGAT | 323 |
| PDIA3-F3 | CTGCGTCACGCAGCGTCGGG | 324 |
| CalR-F1 | GGTCGCACTATGGGCCAATG | 325 |
| CalR-F2 | GTAGGTCTAAACCAGTCAAA | 326 |
| CalR-F3 | GGGTCGACCACGCGTTGTGG | 327 |
| ERAP1-F1 | TGATAGGGAATGCATTCTCC | 328 |
| ERAP1-F2 | ACTTTGAGTTCCCGAAGCCC | 329 |
| ERAP1-F3 | CAAGCCTAAGGGATCTAGCC | 330 |
| NLRC5-F1 | AGCTGGCCGTGCAGAGAGGA | 331 |
| NLRC5-F2 | TCATCTGGGAGATGAGCCTC | 332 |
| NLRC5-F3 | TTCGGTTGGCATTCGGCTAA | 333 |
| TAP2F1 | GGGTCTGAGATGCTTTGAAA | 334 |
| TAP2F2 | GGCGCCTGTCAATTTGCGGG | 335 |
| TAP2F3 | TTGCTAGTAGCGGCCTTGGA | 336 |
| Hmmr-F1 | CCTTCCGATTGGGCGGCGGT | 337 |
| Hmmr-F2 | AGCTGTTTGCGGCGACGATC | 338 |

TABLE 3-continued sgRNAs selected from a minipool of
29 selected immune function genes
related to antigen presentation

| Gene Name | Guide Sequence | SEQ ID NO: |
|---|---|---|
| Hmmr-F3 | AATCTAGTGCGCATGCTCTT | 339 |
| Trp53-F1 | GTCTAAGATATAGAGCTGTG | 340 |
| Trp53-F2 | GATAGTCGCCATAACAAGTA | 341 |
| Trp53-F3 | TTGTGCCAGGAGTCTCGCGG | 342 |
| Tlr9-F1 | TTGTGGGGTGGGGAGGAGAG | 343 |
| Tlr9-F2 | GAAAGAGGAAGGGGTTGAGG | 344 |
| Tlr9-F3 | CCACAGCTCTTTGGGGGGTG | 345 |
| Tlr9-F4 | TGTCCCTACCCTGAAAGAGC | 346 |
| Tlr9-F5 | ACATCATTTGCATAGTCAGA | 347 |
| Tlr9-F6 | GGGGCATATGTGATACCCTT | 348 |

Compositions

Certain aspects of the invention include compositions comprising the cells or vectors of the present invention. One aspect of the invention includes a composition comprising a cancer vaccine, comprising a modified cell comprising a CRISPRa system capable of increasing expression of a plurality of endogenous genes. In certain embodiments, the cell is packaged in an AAV vector. In certain embodiments, the CRISPRa system comprises an sgRNA library.

In certain embodiments, the composition comprises an sgRNA library. In one embodiment, the sgRNA library comprises sequences selected from the group consisting of SEQ ID NOs: 1-37. In one embodiment the sgRNA library comprises sequences selected from the group consisting of SEQ ID NOs: 51-259. In one embodiment the sgRNA library comprises sequences selected from the group consisting of SEQ ID NOs: 260-348. In one embodiment the sgRNA library comprises sequences selected from the group consisting of SEQ ID NOs: 349-4,187. In one embodiment the sgRNA library comprises sequences selected from the group consisting of SEQ ID NOs: 4,188-7,980. In one embodiment the sgRNA library comprises sequences selected from the group consisting of SEQ ID NOs: 7,981-11,808. In one embodiment the sgRNA library comprises sequences selected from the group consisting of SEQ ID NOs: 11,809-23,776. In one embodiment the sgRNA library comprises sequences selected from the group consisting of SEQ ID NOs: 23,779-23,885. In one embodiment the sgRNA library comprises sequences selected from the group consisting of SEQ ID NOs: 23,886-24,104.

In one embodiment, the invention comprises a vector comprising a U6-sgRNA and a EFS-MPH (activator). In one embodiment, the invention comprises a vector comprising two sgRNA cassettes in a CRISPRa system, wherein the first sgRNA cassette is used for activation of antigen presentation machinery, and the second sgRNA cassette is used for activation of patient-specific mutated endogenous genes, either in single gene or pooled format. In one embodiment, the vector comprises SEQ ID NO: 49. In one embodiment, the vector comprises SEQ ID NO: 50.

In one embodiment, the invention comprises a vector comprising SEQ ID NO: 24,105. In one embodiment, the invention comprises a vector comprising SEQ ID NO: 24,106.

Tolerable variations of the any one of the vectors will be known to those of skill in the art. For example, in some embodiments the vector comprises a nucleic acid sequence that has at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99% sequence identity to the nucleic acid sequence set forth in SEQ ID NO: 49, SEQ ID NO: 50, SEQ ID NO: 49, SEQ ID NO: 24,105, or SEQ ID NO: 24,106.

```
CRISPRa AAV vector:
pGW005_pAAV-U6sgbbBsmBI(MS2)-EF1a-MPH-sPA2
                                                          (SEQ ID NO: 49)
     1 cctgcaggca gctgcgcgct cgctcgctca ctgaggccgc ccgggcaaag cccgggcgtc 61 gggcgacctt tggtcgcccg gcctcagtga gcgagcgagc gcgcagagag ggagtggcca 121 actccatcac taggggttcc tgcggccgca gggacccaga gagggcctat ttcccatgat 181 tccttcatat ttgcatatac gatacaaggc tgttagagag ataattagaa ttaatttgac 241 tgtaaacaca aagatattag tacaaaatac gtgacgtaga aagtaataat ttcttgggta 301 gtttgcagtt ttaaaattat gttttaaaat ggactatcat atgcttaccg taacttgaaa 361 gtatttcgat ttcttggctt tatatatctt gtggaaagga cgaaacaccg gaagagcgag 421 ctcttctgtt ttagagctag gccaacatga ggatcaccca tgtctgcagg gcctagcaag 481 ttaaaataag gctagtccgt tatcaacttg gccaacatga ggatcaccca tgtctgcagg 541 gccaagtggc accgagtcgg tgcttttttg gatccaagct tggcgtaact agatcttgag 601 acaaatggga cagcagagat ccagtttggt taattagcta gctgcaaaga tggataaagt 661 tttaaacaga gaggaatctt tgcagctaat ggaccttcta ggtcttgaaa ggagtgggaa 721 ttggctccgg tgcccgtcag tgggcagagc gcacatcgcc cacagtcccc gagaagttgg
```

-continued

```
 781 ggggaggggt cggcaattga accggtgcct agagaaggtg gcgcggggta aactgggaaa 841 gtgatgtcgt gtactggctc cgcctttttc ccgagggtgg gggagaaccg tatataagtg 901 cagtagtcgc cgtgaacgtt ctttttcgca acgggtttgc cgccagaaca caggtaagtg 961 ccgtgtgtgg ttcccgcggg cctggcctct ttacgggtta tggcccttgc gtgccttgaa 1021 ttacttccac ctggctgcag tacgtgattc ttgatcccga gcttcgggtt ggaagtgggt 1081 gggagagttc gaggccttgc gcttaaggag ccccttcgcc tcgtgcttga gttgaggcct 1141 ggcctgggcg ctggggccgc cgcgtgcgaa tctggtggca ccttcgcgcc tgtctcgctg 1201 ctttcgataa gtctctagcc atttaaaatt tttgatgacc tgctgcgacg cttttttttct 1261 ggcaagatag tcttgtaaat gcgggccaag atctgcacac tggtatttcg gtttttgggg 1321 ccgcgggcgg cgacggggcc cgtgcgtccc agcgcacatg ttcggcgagg cggggcctgc 1381 gagcgcggcc accgagaatc ggacgggggt agtctcaagc tggccggcct gctctggtgc 1441 ctggcctcgc gccgccgtgt atcgccccgc cctgggcggc aaggctggcc cggtcggcac 1501 cagttgcgtg agcggaaaga tggccgcttc ccggccctgc tgcagggagc tcaaaatgaa 1561 ggacgcggcg ctcgggagag cgggcgggtg agtcacccac acaaaggaaa agggcctttc 1621 cgtcctcagc cgtcgcttca tgtgactcca cggagtaccg ggcgccgtcc aggcacctcg 1681 attagttctc gagctttngg agtacgtcgt ctttaggttg gggggagggg ttttatgcga 1741 tggagtttcc ccacactgag tgggtggaga ctgaagttag gccagcttgg cacttgatgt 1801 aattctcctt ggaatttgcc cttttttgagt ttggatcttg gttcattctc aagcctcaga 1861 cagtggttca aagttttttt cttccatttc aggtgtcgtg acgtacggcc accatggctt 1921 caaactttac tcagttcgtg ctcgtggaca atggtgggac aggggatgtg acagtggctc 1981 cttctaattt cgctaatggg gtggcagagt ggatcagctc caactcacgg agccaggcct 2041 acaaggtgac atgcagcgtc aggcagtcta gtgcccagaa gagaaagtat accatcaagg 2101 tggaggtccc caaagtggct acccagacag tgggcggagt cgaactgcct gtcgccgctt 2161 ggaggtccta cctgaacatg gagctcacta tcccaatttt cgctaccaat tctgactgtg 2221 aactcatcgt gaaggcaatg cagggggctcc tcaaagacgg taatcctatc ccttccgcca 2281 tcgccgctaa ctcaggtatc tacagcgctg gaggaggtgg aagcggagga ggaggaagcg 2341 gaggaggagg tagcggacct aagaaaaaga ggaaggtggc ggccgctgga tccccttcag 2401 ggcagatcag caaccaggcc ctggctctgg cccctagctc cgctccagtg ctggcccaga 2461 ctatggtgcc ctctagtgct atggtgcctc tggcccagcc acctgctcca gcccctgtgc 2521 tgaccccagg accaccccag tcactgagcg ctccagtgcc caagtctaca caggccggcg 2581 aggggactct gagtgaagct ctgctgcacc tgcagttcga cgctgatgag gacctgggag 2641 ctctgctggg gaacagcacc gatcccggag tgttcacaga tctggcctcc gtggacaact 2701 ctgagtttca gcagctgctg aatcagggcg tgtccatgtc tcatagtaca gccgaaccaa 2761 tgctgatgga gtaccccgaa gccattaccc ggctggtgac cggcagccag cggccccccg 2821 accccgctcc aactcccctg ggaaccagcg cctgcctaa tgggctgtcc ggagatgaag 2881 acttctcaag catcgctgat atggactttta gtgccctgct gtcacagatt tcctctagtg 2941 ggcaggagg aggtggaagc ggcttcagcg tggacaccag tgccctgctg gacctgttca 3001 gcccctcggt gaccgtgccc gacatgagcc tgcctgacct tgcagcagc ctggccagta 3061 tccaagagct cctgtctccc caggagcccc caggcctcc cgaggcagag aacagcagcc 3121 cggattcagg gaagcagctg gtgcactaca gcgcgcagcc gctgttcctg ctggaccccg 3181 gctccgtgga caccgggagc aacgacctgc cggtgctgtt tgagctggga gagggctcct
```

-continued

```
3241 acttctccga aggggacggc ttcgccgagg accccaccat ctccctgctg acaggctcgg 3301 agcctcccaa agccaaggac cccactgtct cctaagaatt cgatatcaag cttaataaaa 3361 gatctttatt ttcattagat ctgtgtgttg gttttttgtg tggtaaccac gtgcggaccg 3421 agcggccgca ggaacccta gtgatggagt tggccactcc ctctctgcgc gctcgctcgc 3481 tcactgaggc cgggcgacca aaggtcgccc gacgcccggg ctttgcccgg cggcctcag 3541 tgagcgagcg agcgcgcagc tgcctgcagg ggcgcctgat gcggtatttt ctccttacgc 3601 atctgtgcgg tatttcacac cgcatacgtc aaagcaacca tagtacgcgc cctgtagcgg 3661 cgcattaagc gcggcgggtg tggtggttac gcgcagcgtg accgctacac ttgccagcgc 3721 cctagcgccc gctcctttcg ctttcttccc ttcctttctc gccacgttcg ccggctttcc 3781 ccgtcaagct ctaaatcggg ggctcccttt agggttccga tttagtgctt tacggcacct 3841 cgaccccaaa aaacttgatt tgggtgatgg ttcacgtagt gggccatcgc cctgatagac 3901 ggtttttcgc cctttgacgt tggagtccac gttctttaat agtggactct tgttccaaac 3961 tggaacaaca ctcaacccta tctcgggcta ttctttgat ttataaggga ttttgccgat 4021 ttcggcctat tggttaaaaa atgagctgat ttaacaaaaa tttaacgcga attttaacaa 4081 aatattaacg tttacaattt tatggtgcac tctcagtaca atctgctctg atgccgcata 4141 gttaagccag ccccgacacc cgccaacacc cgctgacgcg ccctgacggg cttgtctgct 4201 cccggcatcc gcttacagac aagctgtgac cgtctccggg agctgcatgt gtcagaggtt 4261 ttcaccgtca tcaccgaaac gcgcgagacg aaagggcctc gtgatacgcc tatttttata 4321 ggttaatgtc atgataataa tggtttctta gacgtcaggt ggcactttc ggggaaatgt 4381 gcgcggaacc cctatttgtt tatttttcta aatacattca aatatgtatc cgctcatgag 4441 acaataaccc tgataaatgc ttcaataata ttgaaaaagg aagagtatga gtattcaaca 4501 tttccgtgtc gcccttattc ccttttttgc ggcattttgc cttcctgttt ttgctcaccc 4561 agaaacgctg gtgaaagtaa aagatgctga agatcagttg ggtgcacgag tgggttacat 4621 cgaactggat ctcaacagcg gtaagatcct tgagagtttt cgccccgaag aacgttttcc 4681 aatgatgagc acttttaaag ttctgctatg tggcgcggta ttatcccgta ttgacgccgg 4741 gcaagagcaa ctcggtcgcc gcatacacta ttctcagaat gacttggttg agtactcacc 4801 agtcacagaa aagcatctta cggatggcat gacagtaaga gaattatgca gtgctgccat 4861 aaccatgagt gataacactg cggccaactt acttctgaca acgatcggag gaccgaagga 4921 gctaaccgct tttttgcaca acatggggga tcatgtaact cgccttgatc gttgggaacc 4981 ggagctgaat gaagccatac caaacgacga gcgtgacacc acgatgcctg tagcaatggc 5041 aacaacgttg cgcaaactat taactggcga actacttact ctagatccc ggcaacaatt 5101 aatagactgg atggaggcgg ataaagttgc aggaccactt ctgcgctcgg cccttccggc 5161 tggctggttt attgctgata aatctggagc cggtgagcgt gggtctcgcg gtatcattgc 5221 agcactgggg ccagatggta agccctcccg tatcgtagtt atctacacga cggggagtca 5281 ggcaactatg gatgaargaa atagacagat cgctgagata ggtgcctcac tgattaagca 5341 ttggtaactg tcagaccaag tttactcata tatactttag attgatttaa aacttcattt 5401 ttaatttaaa aggatctagg tgaagatcct ttttgataat ctcatgacca aaatccctta 5461 acgtgagttt tcgttccact gagcgtcaga ccccgtagaa aagatcaaag gatcttcttg 5521 agatcctttt tttctgcgcg taatctgctg cttgcaaaca aaaaaaccac cgctaccagc 5581 ggtggtttgt ttgccggatc aagagctacc aactctttttt ccgaaggtaa ctggcttcag
```

-continued

```
5641 cagagcgcag ataccaaata ctgtccttct agtgtagccg tagttaggcc accacttcaa 5701 gaactctgta gcaccgccta catacctcgc tctgctaatc ctgttaccag tggctgctgc 5761 cagtggcgat aagtcgtgtc ttaccgggtt ggactcaaga cgatagttac cggataaggc 5821 gcagcggtcg ggctgaacgg ggggttcgtg cacacagccc agcttggagc gaacgaccta 5881 caccgaactg agatacctac agcgtgagct atgagaaagc gccacgcttc ccgaagggag 5941 aaaggcggac aggtatccgg taagcggcag ggtcggaaca ggagagcgca cgagggagct 6001 tccaggggga aacgcctggt atctttatag tcctgtcggg tttcgccacc tctgacttga 6061 gcgtcgattt ttgtgatgct cgtcaggggg cggagcctta tggaaaaacg ccagcaacgc 6121 ggccttttta cggttcctgg cctttttgctg gcctttttgct cacatgt
``` pAAV-U6sgbbBsmBI(MS2)-U6CD80MS2-EF1a-MPH-sPA (SEQ ID NO: 50)

```
   1 cctgcaggca gctgcgcgct cgctcgctca ctgaggccgc ccgggcaaag cccgggcgtc 61 gggcgacctt tggtcgcccg gcctcagtga gcgagcgagc gcgcagagag ggagtggcca 121 actccatcac tagggggttcc tgcggccgca cgcgttctag aagagggcct atttcccatg 181 attccttcat atttgcatat acgatacaag gctgttagag agataattgg aattaatttg 241 actgtaaaca caaagatatt agtacaaaat acgtgacgta gaaagtaata atttcttggg 301 tagtttgcag ttttaaaatt atgttttaaa atggactatc atatgcttac cgtaacttga 361 aagtatttcg atttcttggc tttatatatc ttgtggaaag gacgaaacac cggaagagcg 421 agctcttctg ttttagagct aggccaacat gaggatcacc catgtctgca gggcctagca 481 agttaaaata aggctagtcc gttatcaact tggccaacat gaggatcacc catgtctgca 541 gggccaagtg gcaccgagtc ggtgcttttt tggatccaag cttggcgtaa ctagatcttg 601 agacaaatgg gacagcagag atccagtttg gttaattagg acccagaga gggcctattt 661 cccatgattc cttcatattt gcatatacga tacaaggctg ttagagagat aattagaatt 721 aatttgactg taaacacaaa gatattagta caaaatacgt gacgtagaaa gtaataattt 781 cttgggtagt ttgcagtttt aaaattatgt tttaaaatgg actatcatat gcttaccgta 841 acttgaaagt atttcgattt cttggcttta tatatcttgt ggaaaggacg aaacaccgag 901 agttctgaat cagggtggtt ttagagctag gccaacatga ggatcaccca tgtctgcagg 961 gcctagcaag ttaaaataag gctagtccgt tatcaacttg gccaacatga ggatcaccca 1021 tgtctgcagg gccaagtggc accgagtcgg tgcttttttg gatccaagct tggcgtaact 1081 agatcttgag acaaatggct agctgcaaag atggataaag ttttaaacag agaggaatct 1141 ttgcagctaa tggaccttct aggtcttgaa aggagtggga attggctccg gtgcccgtca 1201 gtgggcagag cgcacatcgc ccacagtccc cgagaagttg gggggagggg tcggcaattg 1261 aarcggtgcc tagagaaggt ggcgcggggt aaactgggaa agtgatgtcg tgtactggct 1321 ccgcctttttt cccgagggtg ggggagaacc gtatataagt gcagtagtcg ccgtgaacgt 1381 tctttttcgc aacgggtttg ccgccagaac acaggtaagt gccgtgtgtg gttcccgcgg 1441 gcctggcctc tttacgggtt atggcccttg cgtgccttga attacttcca cctggctgca 1501 gtacgtgatt cttgatcccg agcttcgggt tggaagtggg tgggagagtt cgaggccttg 1561 cgcttaagga gccccttcgc ctcgtgcttg agttgaggcc tggcctgggc gctggggccg 1621 ccgcgtgcga atctggtggc accttcgcgc ctgtctcgct gctttcgata agtctctagc 1681 catttaaaat ttttgatgac ctgctgcgac gctttttttc tggcaagata gtcttgtaaa 1741 tgcgggccaa gatctgcaca ctggtatttc ggttttttggg gccgcgggcg gcgacggggc 1801 ccgtgcgtcc cagcgcacat gttcggcgag gcggggcctg cgagcgcggc caccgagaat
```

-continued

```
1861 cggacggggg tagtctcaag ctggccggcc tgctctggtg cctggcctcg cgccgccgtg 1921 tatcgccccg ccctgggcgg caaggctggc ccggtcggca ccagttgcgt gagcggaaag 1981 atggccgctt cccggccctg ctgcaggggag ctcaaaatga aggacgcggc gctcgggaga 2041 gcggcgggt gagtcaccca cacaaaggaa aagggccttt ccgtcctcag ccgtcgcttc 2101 atgtgactcc acggagtacc gggcgccgtc caggcacctc gattagttct cgagcttttg 2161 gagtacgtcg tctttaggtt gggggggaggg gttttatgcg atggagtttc cccacactga 2221 gtgggtggag actgaagtta ggccagcttg gcacttgatg taattctcct tggaatttgc 2281 ccttttttgag tttggatctt ggttcattct caagcctcag acagtggttc aaagtttttt 2341 tcttccattt caggtgtcgt gacgtacggc caccatggct tcaaacttta ctcagttcgt 2401 gctcgtggac aatggtggga caggggatgt gacagtggct ccttctaatt cgctaatgg 2461 ggtggcagag tggatcagct ccaactcacg gagccaggcc tacaaggtga catgcagcgt 2521 caggcagtct agtgcccaga agagaaagta taccatcaag gtggaggtcc ccaaagtggc 2581 tacccagaca gtgggcggag tcgaactgcc tgtcgccgct tggaggtcct acctgaacat 2641 ggagctcact atcccaattt cgctaccaa ttctgactgt gaactcatcg tgaaggcaat 2701 gcaggggctc ctcaaagacg gtaatcctat cccttccgcc atcgccgcta actcaggtat 2761 ctacagcgct ggaggaggtg gaagcggagg aggaggaagc ggaggaggag gtagcggacc 2821 taagaaaaag aggaaggtgg cggccgctgg atccccttta gggcagatca gcaaccaggc 2881 cctggctctg gcccctagct ccgctccagt gctggcccag actatggtgc cctctagtgc 2941 tatggtgcct ctggcccagc cacctgctcc agccctgtg ctgaccccag gaccacccca 3001 gtcactgagc gctccagtgc ccaagtctac acaggccggc gaggggactc tgagtgaagc 3061 tctgctgcac ctgcagttcg acgctgatga ggacctggga gctctgctgg ggaacagcac 3121 cgatcccgga gtgttcacag atctggcctc cgtggacaac tctgagtttc agcagctgct 3181 gaatcagggc gtgtccatgt ctcatagtac agccgaacca atgctgatgg agtacccga 3241 agccattacc cggctggtga ccggcagcca gcggccoccc gaccccgctc caactcccct 3301 gggaaccagc ggcctgccta atgggctgtc cggagatgaa gacttctcaa gcatcgctga 3361 tatggacttt agtgccctgc tgtcacagat ttcctctagt gggcagggag gaggtggaag 3421 cggcttcagc gtggacacca gtgccctgct ggacctgttc agcccctcgg tgaccgtgcc 3481 cgacatgagc ctgcctgacc ttgacagcag cctggccagt atccaagagc tcctgtctcc 3541 ccaggagccc cccaggcctc ccgaggcaga gaacagcagc ccggattcag ggaagcagct 3601 ggtgcactac acagcgcagc cgctgttcct gctggacccc ggctccgtgg acaccgggag 3661 caacgacctg ccggtgctgt ttgagctggg agagggctcc tacttctccg aaggggacgg 3721 cttcgccgag gaccccacca tctccctgct gacaggctcg gagcctccca aagccaagga 3781 ccccactgtc tcctaagaat tcgatatcaa gcttaataaa agatctttat tttcattaga 3841 tctgtgtgtt ggttttttgt gtggtaacca cgtgcggacc gagcggccgc aggaacccct 3901 agtgatggag ttggccactc cctctctgcg cgctcgctcg ctcactgagg ccgggcgacc 3961 aaaggtcgcc cgacgcccgg gctttgcccg ggcggcctca gtgagcgagc gagcgcgcag 4021 ctgcctgcag gggcgcctga tgcggtattt tctccttacg catctgtgcg gtatttcaca 4081 ccgcatacgt caaagcaacc atagtacgcg ccctgtagcg gcgcattaag cgcggcgggt 4141 gtggtggtta cgcgcagcgt gaccgctaca cttgccagcg ccctagcgcc cgctcctttc 4201 gctttcttcc cttcctttct cgccacgttc gccggctttc cccgtcaagc tctaaatcgg
```

-continued

```
4261 gggctccctt tagggttccg atttagtgct ttacggcacc tcgaccccaa aaaacttgat 4321 ttgggtgatg gttcacgtag tgggccatcg ccctgataga cggttttttcg ccctttgacg 4381 ttggagtcca cgttctttaa tagtggactc ttgttccaaa ctggaacaac actcaacccct 4441 atctcgggct attcttttga tttataaggg attttgccga tttcggccta ttggttaaaa 4501 aatgagctga tttaacaaaa atttaacgcg aattttaaca aaatattaac gtttacaatt 4561 ttatggtgca ctctcagtac aatctgctct gatgccgcat agttaagcca gccccgacac 4621 ccgccaacac ccgctgacgc gccctgacgg gcttgtctgc tcccggcatc cgcttacaga 4681 caagctgtga ccgtctccgg gagctgcatg tgtcagaggt tttcaccgtc atcaccgaaa 4741 cgcgcgagac gaaagggcct cgtgatacgc ctattttttat aggttaatgt catgataata 4801 atggtttctt agacgtcagg tggcactttt cggggaaatg tgcgcggaac ccctatttgt 4861 ttatttttct aaatacattc aaatatgtat ccgctcatga caataaacc ctgataaatg 4921 cttcaataat attgaaaaag gaagagtatg agtattcaac atttccgtgt cgcccttatt 4981 ccctttttttg cggcatttttg ccttcctgtt tttgctcacc cagaaacgct ggtgaaagta 5041 aaagatgctg aagatcagtt gggtgcacga gtgggttaca tcgaactgga tctcaacagc 5101 ggtaagatcc ttgagagttt tcgccccgaa gaacgttttc caatgatgag cacttttaaa 5161 gttctgctat gtggcgcggt attatcccgt attgacgccg ggcaagagca actcggtcgc 5221 cgcatacact attctcagaa tgacttggtt gagtactcac cagtcacaga aaagcatctt 5281 acggatggca tgacagtaag agaattatgc agtgctgcca taaccatgag tgataacact 5341 gcggccaact tacttctgac aacgatcgga ggaccgaagg agctaaccgc ttttttgcac 5401 aacatggggg atcatgtaac tcgccttgat cgttgggaac cggagctgaa tgaagccata 5461 ccaaacgacg agcgtgacac cacgatgcct gtagcaatgg caacaacgtt gcgcaaacta 5521 ttaactggcg aactacttac tctagcttcc cggcaacaat taatagactg gatggaggcg 5581 gataaagttg caggaccact tctgcgctcg gcccttccgg ctggctggtt tattgctgat 5641 anatctggag ccggtgagcg tgggtctcgc ggtatcattg cagcactggg gccagatggt 5701 aagccctccc gtatcgtagt tatctacacg acggggagtc aggcaactat ggatgaacga 5761 aatagacaga tcgctgagat aggtgcctca ctgattaagc attggtaact gtcagaccaa 5821 gtttactcat atatacttta gattgattta aaacttcatt tttaatttaa aaggatctag 5881 gtgaagatcc ttttttgataa tctcatgacc aaaatccctt aacgtgagtt ttcgttccac 5941 tgagcgtcag accccgtaga aaagatcaaa ggatcttctt gagatccttt ttttctgcgc 6001 gtaatctgct gcttgcaaac aaaaaaacca ccgctaccag cggtggtttg tttgccggat 6061 caagagctac caactctttt tccgaaggta actggcttca gcagagcgca gataccaaat 6121 actgtccttc tagtgtagcc gtagttaggc caccacttca agaactctgt agcaccgcct 6181 acatacctcg ctctgctaat cctgttacca gtggctgctg ccagtggcga taagtcgtgt 6241 cttaccgggt tggactcaag acgatagtta ccggataagg cgcagcggtc gggctgaacg 6301 gggggttcgt gcacacagcc cagcttggag cgaacgacct acaccgaact gagatacccta 6361 cagcgtgagc tatgagaaag cgccacgctt cccgaaggga gaaaggcgga caggtatccg 6421 gtaagcggca gggtcggaac aggagagcgc acgagggagc ttccaggggg aaacgcctgg 6481 tatctttata gtcctgtcgg gtttcgccac ctctgacttg agcgtcgatt tttgtgatgc 6541 tcgtcagggg ggcggagcct atggaaaaac gccagcaacg cggccttttt acggttcctg 6601 gccttttgct ggccttttgc tcacatgt
``` pZB2_EFS-LTR-dCas9_addgene-plasmid-106430

-continued (SEQ ID NO: 24, 105)

```
cctgcaggcagctgcgcgctcgctcgctcactgaggccgcccgggcgtcgggcgacctttggtcgcccggcctcagtgag cgagcgagcgcgcagagagggagtggccaactccatcactaggggttcctgcggcctctagaaaggatctgcgatcgctc cggtgcccgtcagtgggcagagcgcacatcgcccacagtccccgagaagttgggggagggtcggcaattgaacgggtg cctagagaaggtggcgcggggtaaactgggaaagtgatgtcgtgtactggctccgccttttcccgagggtgggggagaa ccgtatataagtgcagtagtcgccgtgaacgttcttttcgcaacgggtttgccgccagaacacagctgaagcttcgagg ggctcgcatctctccttcacgcgcccgccgccctacctgaggccgccatccacgccggttgagtcgcgttctgccgcctc ccgcctgtggtgcctcctgaactgcgtccgccgtctaggtaagtttaaagctcaggtcgagaccgggcattgtccggcg ctccatggagcctacctagactcagccggctctccacgctttgcctgaccctgcttgctcaactctacgtctttgtttc gttttctgttctgcgccgttacagatccaagctgtgaccggcgcctacaccggtgccaccatgtacccatacgatgttcc agattacgcttcgccgaagaaaaagcgcaaggtcgaagcgtccgacaagaagtactccattgggctcgctatcggcacaa acagcgtcggctgggccgtcattacggacgagtacaaggtgccgagcaaaaaattcaaagttctgggcaataccgatcgc cacagcataaagaagaacctcattggcgccctcctgttcgactccggggagacggccgaagccacgcggctcaaaagaac agcacggcgcagatatacccgcagaaagaatcggatctgctacctgcaggagatctttagtaatgagatggctaaggtgg atgactattcttccataggctggaggagtcctttttggtggaggaggataaaaagcacgagcgccacccaatctttggc aatatcgtggacgaggtggcgtaccatgaaaagtacccaaccatatatcatctgaggaagaagcttgtagacagtactga taaggctgacttgcggttgatctatctcgcgctggcgcatatgatcaaatttcggggacacttcctcatcgaggggggacc tgaacccagacaacagcgatgtcgacaaactctttatccaactggttcagacttacaatcagatttcgaagagaacccg atcaacgcatccggagttgacgccaaagcaatcctgagcgctaggctgtccaaatcccggcggctcgaaaacctcatcgc acagctccctggggagaagaagaacggcctgtttggtaatcttatcgccctgtcactcgggctgacccccaactttaaat ctaacttcgacctggccgaagatgccaagcttcaactgagcaaagacacctacgatgatgatctcgacaatctgctggcc cagatcggcgaccagtacgcagacctttttttggcggcaaagaacctgtcagacgccattctgctgagtgatattctgcg agtgaacacggagatcaccaaagctccgctgagcgctagtatgatcaagcgctatgatgagcaccaccaagacttgactt tgctgaaggccatgtcagacagcaactgcctgagaagtacaaggaaattttcttcgatcagtctaaaaatggctacgcc ggatacattgacggcggagcaagccaggaggaattttacaaatttattaagcccatcttggaaaaaatggacggcaccga ggagctgctggtaaagcttaacagagaagatctgttgcgcaaacagcgcactttcgacaatggaagcatcccccaccaga ttcacctgggcgaactgcacgctatcctcaggcggcaagaggatttctaccccUtttgaaagataacagggaaaagatt gagaaaatcctcacatttcggataccctactatgtaggcccctcgcccgggaaattccagattcgcgtggatgactcg caaatcagaagagaccatcactccctggaacttcgaggaagtcgtggataaggggggcctctgcccagtccttcatcgaaa ggatgactaactttgataaaaatctgcctaacgaaaggtgatcctaaacactctctgctgtacgagtacttcacagtt tataacgagctcaccaaggtcaaatacgtcacagaagggatgagaaagccagcattcctgtctggagagcagaagaaagc tatcgtggacctcctcttcaagacgaaccggaaagttaccgtgaaacagctcaaagaagactatttcaaaaagattgaat gtttcgactctgttgaaatcagcggagtggaggatcgcttcaacgcatccctgggaacgtatcacgatctcctgaaaatc attaaagacaaggacttcctggacaatgaggagaacgaggacattcttgaggacattgtcctcacccttacgttgtttga agatagggagatgattgaagaacgcttgaaaacttacgctcatctcttcgacgacaaagtcatgaaacagctcaagaggc gccgatatacaggatggggcggctgtcaagaaaactgatcaatgggatccgagacaagcagagtggaaagacaatcctg gattttcttaagtccgatggatttgccaaccggaacttcatgcagttgatccatgatgactctctcacctttaaggagga catccagaaagcacaagtttctggccaggggacagtcttcacgagcacatcgctaatcttgcaggtagcccagctatca aaaagggaatactgcagaccgttaaggtcgtggatgaactcgtcaaagtaatgggaaggcataagcccgagaatatcgtt atcgagatggcccgagagaaccaaactacccagaagggacagaagaacagtagggaaaggatgaagaggattgaagaggg tataaaagaactggggtcccaaatccttaaggaacacccagttgaaaacacccagcttcagaatgagaagctctacctgt
```

-continued

```
actacctgcagaacggcagggacatgtacgtggatcaggaactggacatcaatcggctctccgactacgacgtggctgct atcgtgccccagtcttttctcaaagatgattctattgataataaagtgttgacaagatccgataaagctagagggaagag tgataacgtcccctcagaagaagttgtcaagaaaatgaaaaattattggcggcagctgctgaacgccaaactgatcacac aacggaagttcgataatctgactaaggctgaacgaggtggcctgtctgagttggataaagccggatcatcaaaaggcag cttgttgagacacgccagatcaccaagcacgtggcccaaattctcgattcacgcatgaacaccaagtacgatgaaaatga caaactgattcgagaggtgaaagttattactctgaagtctaagctggtctcagatttcagaaaggactttcagtttttata aggtgagagagatcaacaattaccaccatgcgcatgatgcctacctgaatgcagtggtaggcactgcacttatcaaaaaa tatcccaagcttgaatctgaatttgtttacggagactataaagtgtacgatgttaggaaaatgatcgcaaagtctgagca ggaaataggcaaggccaccgctaagtacttcttttacagcaatattatgaatttttttcaagaccgagattacactggcca atggagagattcggaagcgaccacttatcgaaacaaacggagaaacaggagaaatcgtgtgggacaagggtagggatttc gcgacagtccggaaggtcctgtccatgccgcaggtgaacatcgttaaaaagaccgaagtacagaccggaggcttctccaa ggaaagtatcctcccgaaaaggaacagcgacaagctgatcgcacgcaaaaaagattgggaccccaagaaatacggcggat tcgattctcctacagtcgcttacagtgtactggttgtggccaaagtggagaaagggaagtctaaaaaactcaaaagcgtc aaggaactgctgggcatcacaatcatggagcgatcaagcttcgaaaaaaaccccatcgactttctcgaggcgaaaggata taaagaggtcaaaaaagacctcatcattaagcttcccaagtactctctctttgagcttgaaaacggccggaaacgaatgc tcgctagtgcgggcgagctgcagaaaggtaacgagctggcactgccctctaaatacgttaatttcttgtatctggccagc cactatgaaaagctcaaagggtctcccgaagataatgagcagaagcagctgttcgtggaacaacacaaacactaccttga tgagatcatcgagcaaataagcgaattctccaaaagagtgatcctcgccgacgctaacctcgataaggtgctttctgctt acaataagcacagggataagcccatcagggagcaggcagaaaacattatccacttgtttactctgaccaacttgggcgcg cctgcagccttcaagtacttcgacaccaccatagacagaaagcggtacacctctacaaaggaggtcctggacgccacact gattcatcagtcaattacggggctctatgaaacaagaatcgacctctctcagctcggtggagacagccccaagaagaaga gaaaggtggaggccagctaagaattcaataaaaagatctttatttttcattagatctgtgtgttggtttttttgtgtgcggcc gcaggaacccctagtgatggagttggccactccctctctgcgcgctcgctcgctcactgaggccgggcgaccaaaggtcg cccgacgcccgggctttgcccgggcggcctcagtgagcgagcgagcgcgcagctgcctgcaggggcgcctgatgcggtat tttctccttacgcatctgtgcggtatttcacaccgcatacgtcaaagcaaccatagtacgcgccctstagcggcgcatta agcgcggcgggtgtggtggttacgcgcagcgtgaccgctacacttgccagcgccttagcgcccgctcctttcgctttctt cccttcctttctcgccacgttcgccggctttccccgtcaagctctaaatcggggctcccctttagggttccgatttagtg ctttacggcacctcgaccccaaaaaacttgatttgggtgatggttcacgtagtgggccatcgccctgatagacggttttt cgccctttgacgttggagtccacgttctttaatagtggactcttgttccaaactggaacaacactcaactctatctcggg ctattctatgatttataagggattttgccgatttcggtctattggttaaaaaatgagctgatttaacaaaaatttaacg cgaattttaacaaaatattaacgtttacaattttatggtgcactctcagtacaatctgctctgatgccgcatagttaagc cagccccgacacccgccaacacccgctgacgcgccctgacgggcttgtctgctccoggcatccgcttacagacaagctgt gaccgtctccgggagctgcatgtgtcagaggttttcaccgtcatcaccgaaacgcgcgagacgaaagggcctcgtgatac gcctatttttataggttaatgtcatgataataatggtttcttagacgtcaggtggcacttttcggggaaatgtgcgcgga acccctatttgtttatttttctaaatacattcaaatatgtatccgctcatgagacaataaccctgataaatgcttcaata atattgaaaaaggaagagtatgagtattcaacatttccgtgtcgccatattcccttttttgcggcattttgccttcctg ttttttgctcacccagaaacgctggtgaaagtaaaagatgctgaagatcagttgggtgcacgagtgggttacatcgaactg gatctcaacagcggtaagatccttgagagttttcgccccgaagaacgttttccaatgatgagcacttttaaagttctgct atgtggcgcggtattatcccgtattgacgccgggcaagagcaactcggtcgccgcatacactattctcagaatgacttgg ttgagtactcaccagtcacagaaaagcatatacggatggcatgacagtaagagaattatgcagtgctgccataaccatg agtgataacactgcggccaacttacttctgacaacgatcggaggaccgaaggagctaaccgcttttttgcacaacatggg
```

-continued ggatcatgtaactcgccttgatcgttgggaaccggagctgaatgaagccataccaaacgacgagcgtgacaccacgatgc ctgtagcaatggcaacaacgttgcgcaaactattaactggcgaactacttactctagcttcccggcaacaattaatagac tggatggaggcggataaagttgcaggaccacttctgcgctcggcccttccggctggctggtttattgctgataaatctgg agccggtgagcgtggaagccgcgggtatcattgcagcactggggccagatggtaagccctcccgtatcgtagttatctaca cgacggggagtcaggcaactatggatgaacgaaatagacagatcgctgagataggtgcctcactgattaagcattggtaa ctgtcagaccaagtttactcatatatactttagattgatttaaaacttcatttttaatttaaaaggatctaggtgaagat cctttttgataatctcatgaccaaaatcccttaacgtgagttttcgttccactgagcgtcagacccccgtagaaaagatca aaggatcttcttgagatcctatatctgcgcgtaatctgctgcttgcaaacaaaaaaaccaccgctaccagcggtggtt tgtttgccggatcaagagctaccaactcttttttccgaaggtaactggcttcagcagagcgcagataccaaatactgttct tctagtgtagccgtagttaggccaccacttcaagaactctgtagcaccgcctacatacctcgctctgctaatcctgttac cagtggctgctgccagtggcgataagtcgtgtcttaccgggttggactcaagacgatagttaccggataaggcgcagcgg tcgggctgaacggggggttcgtgcacacagcccagcttggagcgaacgacctacaccgaactgagatacctacagcgtga gctatgagaaagcgccacgcttcccgaagggagaaaggcggacaggtatccggtaagcggcagggtcggaacaggagagc gcacgagggagcttccaggggaaacgcctggtatctttatagtcctgtcgggtttcgccacctctgacttgagcgtcga tttttgtgatgctcgtcaggggggcggagcctatggaaaaacgccagcaacgcggcctttttacggttcctggccttttg ctggcctttgctcacatgt pGW011b_pAAV-EFS-dCAS9-spA (SEQ ID NO: 24, 106)

cctgcaggcagctgcgcgctcgctcgctcactgaggccgcccgggcaaagcccgggcgtcgggcgacctttggtcgcccg gcctcagtgagcgagcgagcgcgcagagagggagtggccaactccatcactaggggttcctgcggccgcacgcgttctag gtcttgaaaggagtgggaattggctccggtgcccgtcagtgggcagagcgcacatcgcccacagtccccgagaagttggg gggaggggtcggcaattgatccggtgcctagagaaggtggcgcggggtaaactgggaaagtgatgtcgtgtactggctcc gcctattcccgaggtggggggagaaccgtatataagtgcagtagtcgcgcgtgaacgttattttcgcaacgggtttgccgc cagaacacaggTGTCGTGACGCGcGTACGtaatacgactcactatagggccgccaccATGAAAAGGCCG

GCGGCCACGAAAAAGGCCGGCCAGGCAAAAAAGAAAAAGGACAAGAAGTAC

AGCATCGGCCTGGCCATCGGCACCAACTCTGTGGGCTGGGCCGTGATCACCG

ACGAGTACAAGGTGCCCAGCAAGAAATTCAAGGTGCTGGGCAACACCGACCG

GCACAGCATCAAGAAGAACCTGATCGGAGCCCTGCTGTTCGACAGCGGCGAA

ACAGCCGAGGCCACCCGGCTGAAGAGAACCGCCAGAAGAAGATACACCAGA

CGGAAGAACCGGATCTGCTATCTGCAAGAGATCTTCAGCAACGAGATGGCCA

AGGTGGACGACAGCTTCTTCCACAGACTGGAAGAGTCCTTCCTGGTGGAAGA

GGATAAGAAGCACGAGCGGCACCCCATCTTCGGCAACATCGTGGACGAGGTG

GCCTACCACGAGAAGTACCCCACCATCTACCACCTGAGAAAGAAACTGGTGG

ACAGCACCGACAAGGCCGACCTGCGGCTGATCTATCTGGCCCTGGCCCACAT

GATCAAGTTCCGGGGCCACTTCCTGATCGAGGGCGACCTGAACCCCGACAAC

AGCGACGTGGACAAGCTGTTCATCCAGCTGGTGCAGACCTACAACCAGCTGT

TCGAGGAAAACCCCATCAACGCCAGCGGCGTGGACGCCAAGGCCATCCTGTC

TGCCAGACTGAGCAAGAGCAGACGGCTGGAAAATCTGATCGCCCAGCTGCCC

GGCGAGAAGAAGAATGGCCTGTTCGGCAACCTGATTGCCCTGAGCCTGGGCC

TGACCCCCAACTTCAAGAGCAACTTCGACCTGGCCGAGGATGCCAAACTGCA

GCTGAGCAAGGACACCTACGACGACGACCTGGACAACCTGCTGGCCCAGATC

-continued

```
GGCGACCAGTACGCCGACCTGTTTCTGGCCGCCAAGAACCTGTCCGACGCCA

TCCTGCTGAGCGACATCCTGAGAGTGAACACCGAGATCACCAAGGCCCCCCT

GAGCGCCTCTATGATCAAGAGATACGACGAGCACCACCAGGACCTGACCCTG

CTGAAAGCTCTCGTGCGGCAGCAGCTGCCTGAGAAGTACAAAGAGATTTTCT

TCGACCAGAGCAAGAACGGCTACGCCGGCTACATTGACGGCGGAGCCAGCCA

GGAAGAGTTCTACAAGTTCATCAAGCCCATCCTGGAAAAGATGGACGGCACC

GAGGAACTGCTCGTGAAGCTGAACAGAGAGGACCTGCTGCGGAAGCAGCGG

ACCTTCGACAACGGCAGCATCCCCCACCAGATCCACCTGGGAGAGCTGCACG

CCATTCTGCGGCGGCAGGAAGATTTTTACCCATTCCTGAAGGACAACCGGGA

AAAGATCGAGAAGATCCTGACCTTCCGCATCCCCTACTACGTGGGCCCTCTG

GCCAGGGGAAACAGCAGATTCGCCTGGATGACCAGAAAGAGCGAGGAAACCA

TCACCCCCTGGAACTTCGAGGAAGTGGTGGACAAGGGCGCTTCCGCCCAGAG

CTTCATCGAGCGGATGACCAACTTCGATAAGAACCTGCCCAACGAGAAGGTG

CTGCCCAAGCACAGCCTGCTGTACGAGTACTTCACCGTGTATAACGAGCTGA

CCAAAGTGAAATACGTGACCGAGGGAATGAGAAAGCCCGCCTTCCTGAGCGG

CGAGCAGAAAAAGGCCATCGTGGACCTGCTGTTCAAGACCAACCGGAAAGTG

ACCGTGAAGCAGCTGAAAGAGGACTACTTCAAGAAAATCGAGTGCTTCGACT

CCGTGGAAATCTCCGGCGTGGAAGATCGGTTCAACGCCTCCCTGGGCACATA

CCACGATCTGCTGAAAATTATCAAGGACAAGGACTTCCTGGACAATGAGGAA

AACGAGGACATTCTGGAAGATATCGTGCTGACCCTGACACTGTTTGAGGACA

GAGAGATGATCGAGGAACGGCTGAAAACCTATGCCCACCTGTTCGACGACAA

AGTGATGAAGCAGCTGAAGCGGCGGAGATACACCGGCTGGGGCAGGCTGAG

CCGGAAGCTGATCAACGGCATCCGGGACAAGCAGTCCGGCAAGACAATCCTG

GATTTCCTGAAGTCCGACGGCTTCGCCAACAGAAACTTCATGCAGCTGATCC

ACGACGACAGCCTGACCTTTAAAGAGGACATCCAGAAAGCCCAGGTGTCCGG

CCAGGGCGATAGCCTGCACGAGCACATTGCCAATCTGGCCGGCAGCCCCGCC

ATTAAGAAGGGCATCCTGCAGACAGTGAAGGTGGTGGACGAGCTCGTGAAAG

TGATGGGCCGGCACAAGCCCGAGAACATCGTGATCGAAATGGCCAGAGAGAA

CCAGACCACCCAGAAGGGACAGAAGAACAGCCGCGAGAGAATGAAGCGGAT

CGAAGAGGGCATCAAAGAGCTGGGCAGCCAGATCCTGAAAGAACACCCCGT

GGAAAACACCCAGCTGCAGAACGAGAGCTGTACCTGTACTACCTGCAGAA

TGGGCGGGATATGTACGTGGACCAGGAACTGGACATCAACCGGCTGTCCGAC

TACGATGTGGACCACATCGTGCCTCAGAGCTTTCTGAAGGACGACTCCATCG

ACAACAAGGTGCTGACCAGAAGCGACAAGGCCCGGGGCAAGAGCGACAACGT

GCCCTCCGAAGAGGTCGTGAAGAAGATGAAGAACTACTGGCGGCAGCTGCTG

AACGCCAAGCTGATTACCCAGAGAAAGTTCGACAATCTGACCAAGGCCGAGA

GAGGCGGCCTGAGCGAACTGGATAAGGCCGGCTTCATCAAGAGACAGCTGGT

GGAAACCCGGCAGATCACAAAGCACGTGGCACAGATCCTGGACTCCCGGATG

AACACTAAGTACGACGAGAATGACAAGCTGATCCGGGAAGTGAAAGTGATCA

CCCTGAAGTCCAAGCTGGTGTCCGATTTCCGGAAGGATTTCCAGTTTTACAA

AGTGCGCGAGATCAACAACTACCACCACGCCCACGACGCCTACCTGAACGCC
```

-continued

```
GTCGTGGGAACCGCCCTGATCAAAAAGTACCCTAAGCTGGAAAGCGAGTTCG

TGTACGGCGACTACAAGGTGTACGACGTGCGGAAGATGATCGCCAAGAGCGA

GCAGGAAATCGGCAAGGCTACCGCCAAGTACTTCTTCTACAGCAACATCATG

AACTTTTTCAAGACCGAGATTACCCTGGCCAACGGCGAGATCCGGAAGCGGC

CTCTGATCGAGACAAACGGCGAAACCGGGGAGATCGTGTGGGATAAGGGCC

GGGATTTTGCCACCGTGCGGAAAGTGCTGAGCATGCCCCAAGTGAATATCGT

GAAAAAGACCGAGGTGCAGACAGGCGGCTTCAGCAAAGAGTCTATCCTGCCC

AAGAGGAACAGCGATAAGCTGATCGCCAGAAAGAAGGACTGGGACCCTAAG

AAGTACGGCGGCTTCGACAGCCCCACCGTGGCCTATTCTGTGCTGGTGGTGG

CCAAAGTGGAAAAGGGCAAGTCCAAGAAACTGAAGAGTGTGAAAGAGCTGCT

GGGGATCACCATCATGGAAAGAAGCAGCTTCGAGAAGAATCCCATCGACTTT

CTGGAAGCCAAGGGCTACAAAGAAGTGAAAAAGGACCTGATCATCAAGCTG

CCTAAGTACTCCCTGTTCGAGCTGGAAAACGGCCGGAAGAGAATGCTGGCCT

CTGCCGGCGAACTGCAGAAGGGAAACGAACTGGCCCTGCCCTCCAAATATGT

GAACTTCCTGTACCTGGCCAGCCACTATGAGAAGCTGAAGGGCTCCCCCGAG

GATAATGAGCAGAAACAGCTGTTTGTGGAACAGCACAAGCACTACCTGGACG

AGATCATCGAGCAGATCAGCGAGTTCTCCAAGAGAGTGATCCTGGCCGACGC

TAATCTGGACAAAGTGCTGTCCGCCTACAACAAGCACCGGGATAAGCCCATC

AGAGAGCAGGCCGAGAATATCATCCACCTGTTTACCCTGACCAATCTGGGAG

CCCCTGCCGCCTTCAAGTACTTTGACACCACCATCGACCGGAAGAGGTACAC

CAGCACCAAAGAGGTGCTGGACGCCACCCTGATCCACCAGAGCATCACCGGC

CTGTACGAGACACGGATCGACCTGTCTCAGCTGGGAGGCGACAgcgctGGAG

GAGGTGGAAGCGGAGGAGGAGGAAGCGGAGGAGGAGGTAGCggacctaagaa aaagaggaaggtggcggccgctggatccGGACGGGCTGACGCATTGGACGAT

TTTGATCTGGATATGCTGGGAAGTGACGCCCTCGATGATTTTGACCTTGACA

TGCTTGGTTCGGATGCCCTTGATGACTTTGACCTCGACATGCTCGGCAGTGA

CGCCCTTGATGATTTCGACCTGGACATGCTGATTTAACtgtacgaattcAAT

AAATAAAGATCTTTATTTTCATTAGATCTGTGTGTTGGTTTTTTGTGTG cggaccgagcggccgcaggaacccctagtgatggagttggc cactccctctctgcgcgctcgctcgctcactgaggccgggcgaccaaaggtcgcccgacgcccgggctttgcccgggcggc ctcagtgagcgagcgagcgcgcagctgcctgcaggggcgcctgatgcggtattttctccttacgcatctgtgcggtatttc acaccgcatacgtcaaagcaaccatagtacgcgccctgtagcggcgcattaagcgcggcgggtgtggtggttacgcgcagc gtgaccgctacacttgccagcgccctagcgcccgctcctttcgctttcttcccttcctttctcgccacgttcgccggcttt ccccgtcaagctctaaatcggggggctcccctttagggttccgatttagtgctttacggcacctcgaccccaaaaaacttgat ttgggtgatggttcacgtagtgggccatcgccctgatagacggttttttcgccctttgacgttggagtccacgttctttaat agtggactcttgttccaaactggaacaacactcaaccctatctcgggctattcttttgatttataagggattttgccgatt tcggcctattggttaaaaaatgagctgatttaacaaaaatttaacgcgaattttaacaaaatattaacgtttacaatttta tggtgcactctcagtacaatctgctctgatgccgcatagttaagccagccccgacacccgccaacacccgctgacgcgccc tgacgggcttgtctgctcccggcatccgcttacagacaagctgtgaccgtctccgggagctgcatgtgtcagaggttttca ccgtcatcaccgaaacgcgcgagacgaaagggcctcgtgatacgcctatttttataggttaatgtcatgataataatggtt
```

-continued

```
tcttagacgtcaggtggcacttttcggggaaatgtgcgcggaacccctatttgtttattttttctaaatacattcaaatatg tatccgctcatgagacaataaccctgataaatgcttcaataatattgaaaaaggaagagtatgagtattcaacatttccgt gtcgcccttattcccttttttgcggcattttgccttcctgttttttgctcacccagaaacgctggtgaaagtaaaagatgct gaagatcagttgggtgcacgagtgggttacatcgaactggatctcaacagcggtaagatccttgagagttttcgccccgaa gaacgttttccaatgatgagcacttttaaagttctgctatgtggcgcggtattatcccgtattgacgccgggcaagagcaa ctcggtcgccgcatacactattctcagaatgacttggttgagtactcaccagtcacagaaaagcatcttacggatggcatg acagtaagagaattatgcagtgctgccataaccatgagtgataacactgcggccaacttacttctgacaacgatcggagga ccgaaggagctaaccgcttttttgcacaacatgggggatcatgtaactcgccttgatcgttgggaaccggagctgaatgaa gccataccaaacgacgagcgtgacaccacgatgcctgtagcaatggcaacaacgttgcgcaaactattaactggcgaacta cttactctagcttcccggcaacaattaatagactggatggaggcggataaagttgcaggaccacttctgcgctcggccctt ccggctggctggtttattgctgataaatctggagccggtgagcgtgggtctcgcggtatcattgcagcactggggccagat ggtaagccctcccgtatcgtagttatctacacgacggggagtcaggcaactatggatgaacgaaatagacagatcgctgag ataggtgcctcactgattaagcattggtaactgtcagaccaagtttactcatatatactttagattgatttaaaacttcat ttttaatttaaaaggatctaggtgaagatcctttttgataatctcatgaccaaaatcccttaacgtgagttttcgttccac tgagcgtcagacccctagaaaagatcaaaggatcttcttgagatcctttttttctgcgcgtaatctgctgcttgcaaaca aaaaaaccaccgctaccagcggtggtttgtttgccggatcaagagctaccaactctttttccgaaggtaactggcttcagc agagcgcagataccaaatactgtccttctagtgtagccgtagttaggccaccacttcaagaactctgtagcaccgcctaca tacctcgctctgctaatcctgttaccagtggcrgctgccagtggcgataagtcgtgtcttaccgggttggactcaagacga tagttaccggataaggcgcagcggtcgggctgaacggggggttcgtgcacacagcccagcttggagcgaacgacctacacc gaactgagatacctacagcgtgagctatgagaaagcgccacgcttcccgaagggagaaaggcggacaggtatccggtaagc ggcagggtcggaacaggagagcgcacgagggagcttccaggggaaacgcctggtatctttatagtcctgtcgggtttcgc cacctctgacttgagcgtcgatttttgtgatgctcgtcaggggggcggagcctatggaaaaacgccagcaacgcggccttt ttacggttcctggcctttgctggccttttgctca catgt
```

In one aspect, the invention provides a precision CAVac. Precision CAVac, or personalized CAVac, is a derivative of CAVac that is customized based on the genetic composition of an individual's tumor, such as those identified from genomic profiling of a patient's resected tumor or biopsy.

In one aspect, the invention provides an off-the-shelf APCM, which is an approach of endogenous gene activation that targets a small set of genes regardless of patient's tumor's genetic identity.

In one aspect, the invention provides methods of dual-AAV delivery comprising delivery of any one of the vectors described herein with sgRNAs or sgRNA pools cloned into them, together with the delivery of a second vector (e.g. an AAV-dCas9 vector such as pZB2_EFS-LTR-dCas9_addgene-plasmid-106430 or pGW011b_pAAV-EFS-dCAS9-spA). Compositions comprising said dual-AAV delivery systems and methods of using said dual-delivery systems for treating cancer are also provided with the invention.

Generation of AAV-PCAVac:

I. Patient Tumor Sequencing

For a personalized vaccine, genomic DNA is extracted from each patient's tumor biopsy, along with matched normal sample such as peripheral blood. The gDNA is subjected to whole-exome sequencing (WES) and/or whole-genome sequencing (WGS). Mutations are identified from WES of tumor sample, and subtracted from matched normal to exclude background and germline variants, and associated to annotated genes. This will produce a personalized tumor mutation panel of genes (Patient-mutation-geneset).

II. Geneset Choice

This gene set can be further filtered by one or more of the filtering metrics:

1. Select for Immunogenicity, by prediction of immunogenic scores including but not limited to tools such as PVACseq 2. Select against Oncogenecity, by excluding known oncogenes and/or genes amplified in any types of cancer in cancer genomics datasets/databases including but not limited to TCGA, COSMIC, TARGET, cBio-Portal.

3. Consider Coding capacity, by choosing coding genes only, or coding and non-coding genes The filtered (Patient-mutation-geneset-filt) or unfiltered gene set (Patient-mutation-geneset) will be subjected to library design. The gene set can be ranging from 1 to 20,000.

III. SgRNA Design and Library Generation

1. SgRNAs are chosen from a pre-defined sequence list for these genes, or designed ab initio using existing or customized codes.

2. An sgRNA library for each patient is synthesized using pooled oligo synthesis, using individual or commercial vendors including but not limited to Yale/Keck ISP, IDT, Thermofisher, Customarray, Agilent.

3. A synthesized sgRNA library is pool cloned into the AAV-CRISPRa vector, or derivatives, or similar vectors using other effectors, adaptors, Cas enzymes for the same purpose.

4. A cloned library is sequence verified using Sanger and/or Illumina sequencing using custom methods and primers as described herein.

5. Plasmid library is subjected to amplification for viral packaging

IV. Generation of AAV-PCAVac

1. An AAV library is generated by packaging the plasmid library into viral particles using various viral packaging systems including the one described herein 2. An AAV library is purified using methods including the one described herein 3. An AAV library is titered using methods including the one described herein such as qPCR 4. Additional GIP, GMP and/or cGMP methods of AAV production may be adopted Carriers of the vaccine or personalized vaccine can be AAVs of different serotypes for different tissue-specificity/tropism, including but not limited to natural variants AAV1, AAV2, AAV3, AAV4, AAV5, AAV6, AAV7, AAV8, AAV9, AAV10, AAV11, AAV12, artificial variants such as AAV.rhlO, AAV.rh32/33, AAV.rh43, AAV.rh64R1, rAAV2-retro, AAV-DJ, AAV-PHP.B, AAV-PHP.S, AAV-PHP.eB, or other engineered versions of AAV, other novel AAV variants, or any combinations thereof.

The invention should be construed to encompass any type of viral vector known to one of ordinary skill in the art. For example, the carrier of the vaccine or personalized vaccine can be AAV (described herein), but can also be other viral vectors including but not limited to adenovirus, retrovirus, lentivirus, hybrid viral vectors, or any combinations thereof.

Introduction of Nucleic Acids

In certain embodiments an expression system is used for the introduction of gRNAs and (d) Cas9 proteins into the cells of interest. Typically employed options include but are not limited to plasmids and viral vectors such as adeno-associated virus (AAV) vector, adenoviral vector or lentivirus vector.

Methods of introducing nucleic acids into a cell include physical, biological and chemical methods. Physical methods for introducing a polynucleotide, such as RNA, into a host cell include calcium phosphate precipitation, lipofection, particle bombardment, microinjection, electroporation, and the like. RNA can be introduced into target cells using commercially available methods which include electroporation (Amaxa Nucleofector-II (Amaxa Biosystems, Cologne, Germany)), (ECM 830 (BTX) (Harvard Instruments, Boston, Mass.) or the Gene Pulser II (BioRad, Denver, Colo.), Multiporator (Eppendort, Hamburg Germany). RNA can also be introduced into cells using cationic liposome mediated transfection using lipofection, using polymer encapsulation, using peptide mediated transfection, or using biolistic particle delivery systems such as "gene guns" (see, for example, Nishikawa, et al. Hum Gene Ther., 12(8):861-70 (2001).

Biological methods for introducing a polynucleotide of interest into a host cell include the use of DNA and RNA vectors. Viral vectors have become the most widely used method for introducing genes into mammalian, e.g., human cells. Other viral vectors can include as listed above. See, for example, U.S. Pat. Nos. 5,350,674 and 5,585,362.

Chemical means for introducing a polynucleotide into a host cell include colloidal dispersion systems, such as macromolecule complexes, nanocapsules, microspheres, beads, and lipid-based systems including oil-in-water emulsions, micelles, mixed micelles, and liposomes. An exemplary colloidal system for use as a delivery vehicle in vitro and in vivo is a liposome (e.g., an artificial membrane vesicle).

Lipids suitable for use can be obtained from commercial sources. For example, dimyristyl phosphatidylcholine ("DMPC") can be obtained from Sigma, St. Louis, MO; dicetyl phosphate ("DCP") can be obtained from K & K Laboratories (Plainview, NY); cholesterol ("Choi") can be obtained from Calbiochem-Behring; dimyristyl phosphatidylglycerol ("DMPG") and other lipids may be obtained from Avanti Polar Lipids, Inc. (Birmingham, AL). Stock solutions of lipids in chloroform or chloroform/methanol can be stored at about –20° C. Chloroform is used as the only solvent since it is more readily evaporated than methanol. "Liposome" is a generic term encompassing a variety of single and multilamellar lipid vehicles formed by the generation of enclosed lipid bilayers or aggregates. Liposomes can be characterized as having vesicular structures with a phospholipid bilayer membrane and an inner aqueous medium. Multilamellar liposomes have multiple lipid layers separated by aqueous medium. They form spontaneously when phospholipids are suspended in an excess of aqueous solution. The lipid components undergo self-rearrangement before the formation of closed structures and entrap water and dissolved solutes between the lipid bilayers (Ghosh et al., 1991 Glycobiology 5: 505-10). However, compositions that have different structures in solution than the normal vesicular structure are also encompassed. For example, the lipids may assume a micellar structure or merely exist as nonuniform aggregates of lipid molecules. Also contemplated are lipofectamine-nucleic acid complexes.

Regardless of the method used to introduce exogenous nucleic acids into a host cell or otherwise expose a cell to the inhibitor of the present invention, in order to confirm the presence of the nucleic acids in the host cell, a variety of assays may be performed. Such assays include, for example, "molecular biological" assays well known to those of skill in the art, such as Southern and Northern blotting, RT-PCR and PCR; "biochemical" assays, such as detecting the presence or absence of a particular peptide, e.g., by immunological means (ELISAs and Western blots) or by assays described herein to identify agents falling within the scope of the invention.

Moreover, the nucleic acids may be introduced by any means, such as transducing the cells, transfecting the cells, and electroporating the cells. One nucleic acid may be introduced by one method and another nucleic acid may be introduced into the cell by a different method.

RNA

In one embodiment, the nucleic acids introduced into the cell are RNA. In another embodiment, the RNA is mRNA that comprises in vitro transcribed RNA or synthetic RNA. The RNA is produced by in vitro transcription using a polymerase chain reaction (PCR)-generated template. DNA of interest from any source can be directly converted by PCR into a template for in vitro mRNA synthesis using appropriate primers and RNA polymerase. The source of the DNA can be, for example, genomic DNA, plasmid DNA, phage DNA, cDNA, synthetic DNA sequence or any other appropriate source of DNA.

PCR can be used to generate a template for in vitro transcription of mRNA which is then introduced into cells. Methods for performing PCR are well known in the art. Primers for use in PCR are designed to have regions that are substantially complementary to regions of the DNA to be used as a template for the PCR. "Substantially complementary", as used herein, refers to sequences of nucleotides where a majority or all of the bases in the primer sequence are complementary, or one or more bases are non-complementary, or mismatched. Substantially complementary sequences are able to anneal or hybridize with the intended DNA target under annealing conditions used for PCR. The primers can be designed to be substantially complementary to any portion of the DNA template. For example, the primers can be designed to amplify the portion of a gene that is normally transcribed in cells (the open reading frame), including 5' and 3' UTRs. The primers can also be designed to amplify a portion of a gene that encodes a particular domain of interest. In one embodiment, the primers are designed to amplify the coding region of a human cDNA, including all or portions of the 5' and 3' UTRs. Primers useful for PCR are generated by synthetic methods that are well known in the art. "Forward primers" are primers that contain a region of nucleotides that are substantially complementary to nucleotides on the DNA template that are upstream of the DNA sequence that is to be amplified. "Upstream" is used herein to refer to a location 5, to the DNA sequence to be amplified relative to the coding strand. "Reverse primers" are primers that contain a region of nucleotides that are substantially complementary to a double-stranded DNA template that are downstream of the DNA sequence that is to be amplified. "Downstream" is used herein to refer to a location 3' to the DNA sequence to be amplified relative to the coding strand.

Chemical structures that have the ability to promote stability and/or translation efficiency of the RNA may also be used. The RNA preferably has 5' and 3' UTRs. In one embodiment, the 5' UTR is between zero and 3000 nucleotides in length. The length of 5' and 3' UTR sequences to be added to the coding region can be altered by different methods, including, but not limited to, designing primers for PCR that anneal to different regions of the UTRs. Using this approach, one of ordinary skill in the art can modify the 5' and 3' UTR lengths required to achieve optimal translation efficiency following transfection of the transcribed RNA.

The 5' and 3' UTRs can be the naturally occurring, endogenous 5' and 3' UTRs for the gene of interest. Alternatively, UTR sequences that are not endogenous to the gene of interest can be added by incorporating the UTR sequences into the forward and reverse primers or by any other modifications of the template. The use of UTR sequences that are not endogenous to the gene of interest can be useful for modifying the stability and/or translation efficiency of the RNA. For example, it is known that AU-rich elements in 3' UTR sequences can decrease the stability of mRNA. Therefore, 3' UTRs can be selected or designed to increase the stability of the transcribed RNA based on properties of UTRs that are well known in the art.

In one embodiment, the 5' UTR can contain the Kozak sequence of the endogenous gene. Alternatively, when a 5' UTR that is not endogenous to the gene of interest is being added by PCR as described above, a consensus Kozak sequence can be redesigned by adding the 5' UTR sequence. Kozak sequences can increase the efficiency of translation of some RNA transcripts, but does not appear to be required for all RNAs to enable efficient translation. The requirement for Kozak sequences for many mRNAs is known in the art. In other embodiments the 5' UTR can be derived from an RNA virus whose RNA genome is stable in cells. In other embodiments various nucleotide analogues can be used in the 3' or 5' UTR to impede exonuclease degradation of the mRNA. To enable synthesis of RNA from a DNA template, a promoter of transcription should be attached to the DNA template upstream of the sequence to be transcribed. When a sequence that functions as a promoter for an RNA polymerase is added to the 5' end of the forward primer, the RNA polymerase promoter becomes incorporated into the PCR product upstream of the open reading frame that is to be transcribed. In one embodiment, the promoter is a T7 polymerase promoter, as described elsewhere herein. Other useful promoters include, but are not limited to, T3 and SP6 RNA polymerase promoters. Consensus nucleotide sequences for T7, T3 and SP6 promoters are known in the art.

In one embodiment, the mRNA has a cap on the 5' end and a 3' poly(A) tail which determine ribosome binding, initiation of translation and stability mRNA in the cell. On a circular DNA template, for instance, plasmid DNA, RNA polymerase produces a long concatameric product which may not be suitable for expression in eukaryotic cells. The transcription of plasmid DNA linearized at the end of the 3' UTR results in normal sized mRNA which may not be effective in eukaryotic transfection even if it is polyadenylated after transcription.

On a linear DNA template, phage T7 RNA polymerase can extend the 3' end of the transcript beyond the last base of the template (Schenborn and Mierendorf, Nuc Acids Res., 13:6223-36 (1985); Nacheva and Berzal-Herranz, Eur. J. Biochem., 270:1485-65 (2003).

The conventional method of integration of polyA/T stretches into a DNA template is by molecular cloning. However polyA/T sequence integrated into plasmid DNA can cause plasmid instability, which is why plasmid DNA templates obtained from bacterial cells are often highly contaminated with deletions and other aberrations. This makes cloning procedures not only laborious and time consuming but often not reliable. That is why a method which allows construction of DNA templates with polyA/T 3' stretch without cloning highly desirable.

The polyA/T segment of the transcriptional DNA template can be produced during PCR by using a reverse primer containing a polyT tail, such as 100T tail (size can be 50-5000 T), or after PCR by any other method, including, but not limited to, DNA ligation or in vitro recombination. Poly(A) tails also provide stability to RNAs and reduce their degradation. Generally, the length of a poly(A) tail positively correlates with the stability of the transcribed RNA. In one embodiment, the poly(A) tail is between 100 and 5000 adenosines.

Poly(A) tails of RNAs can be further extended following in vitro transcription with the use of a poly(A) polymerase, such as E. coli polyA polymerase (E-PAP). In one embodiment, increasing the length of a poly(A) tail from 100 nucleotides to between 300 and 400 nucleotides results in about a two-fold increase in the translation efficiency of the RNA. Additionally, the attachment of different chemical groups to the 3' end can increase mRNA stability. Such attachment can contain modified/artificial nucleotides, aptamers and other compounds. For example, ATP analogs can be incorporated into the poly(A) tail using poly(A) polymerase. ATP analogs can further increase the stability of the RNA.

5' caps also provide stability to RNA molecules. In a preferred embodiment, RNAs produced by the methods disclosed herein include a 5' cap. The 5' cap is provided using techniques known in the art and described herein (Cougot, et al., Trends in Biochem. Sci., 29:436-444 (2001); Stepinski, et al., RNA, 7:1468-95 (2001); Elango, et al., Biochim. Biophys. Res. Commun., 330:958-966 (2005)).

The RNAs produced by the methods disclosed herein can also contain an internal ribosome entry site (IRES) sequence. The IRES sequence may be any viral, chromosomal or artificially designed sequence which initiates cap-independent ribosome binding to mRNA and facilitates the initiation of translation. Any solutes suitable for cell electroporation, which can contain factors facilitating cellular permeability and viability such as sugars, peptides, lipids, proteins, antioxidants, and surfactants can be included.

In some embodiments, the RNA is electroporated into the cells, such as in vitro transcribed RNA.

The methods also provide the ability to control the level of expression over a wide range by changing, for example, the promoter or the amount of input RNA, making it possible to individually regulate the expression level. Furthermore, the PCR-based technique of mRNA production greatly facilitates the design of the mRNAs with different structures and combination of their domains.

One advantage of RNA transfection methods of the invention is that RNA transfection is essentially transient and vector-free. A RNA transgene can be delivered to a lymphocyte and expressed therein following a brief in vitro cell activation, as a minimal expressing cassette without the need for any additional viral sequences. Under these conditions, integration of the transgene into the host cell genome is unlikely. Cloning of cells is not necessary because of the efficiency of transfection of the RNA and its ability to uniformly modify the entire lymphocyte population.

Genetic modification of cells with in vitro-transcribed RNA (IVT-RNA) makes use of two different strategies both of which have been successively tested in various animal models. Cells are transfected with in vitro-transcribed RNA by means of lipofection or electroporation. It is desirable to stabilize IVT-RNA using various modifications in order to achieve prolonged expression of transferred IVT-RNA.

Some IVT vectors are known in the literature which are utilized in a standardized manner as template for in vitro transcription and which have been genetically modified in such a way that stabilized RNA transcripts are produced. Currently protocols used in the art are based on a plasmid vector with the following structure: a 5' RNA polymerase promoter enabling RNA transcription, followed by a gene of interest which is flanked either 3' and/or 5' by untranslated regions (UTR), and a 3' polyadenyl cassette containing 50-70 A nucleotides. Prior to in vitro transcription, the circular plasmid is linearized downstream of the polyadenyl cassette by type II restriction enzymes (recognition sequence corresponds to cleavage site). The polyadenyl cassette thus corresponds to the later poly(A) sequence in the transcript. As a result of this procedure, some nucleotides remain as part of the enzyme cleavage site after linearization and extend or mask the poly(A) sequence at the 3' end. It is not clear, whether this nonphysiological overhang affects the amount of protein produced intracellularly from such a construct.

RNA has several advantages over more traditional plasmid or viral approaches. Gene expression from an RNA source does not require transcription and the protein product is produced rapidly after the transfection. Further, since the RNA has to only gain access to the cytoplasm, rather than the nucleus, and therefore typical transfection methods result in an extremely high rate of transfection. In addition, plasmid based approaches require that the promoter driving the expression of the gene of interest be active in the cells under study.

In another aspect, the RNA construct is delivered into the cells by electroporation. See, e.g., the formulations and methodology of electroporation of nucleic acid constructs into mammalian cells as taught in US 2004/0014645, US 2005/0052630A1, US 2005/0070841A1, US 2004/0059285A1, US 2004/0092907A1. The various parameters including electric field strength required for electroporation of any known cell type are generally known in the relevant research literature as well as numerous patents and applications in the field. See e.g., U.S. Pat. Nos. 6,678,556, 7,171, 264, and 7,173,116. Apparatus for therapeutic application of electroporation are available commercially, e.g., the MedPulser™ DNA Electroporation Therapy System (Inovio/Genetronics, San Diego, Calif.), and are described in patents such as U.S. Pat. Nos. 6,567,694; 6,516,223, 5,993, 434, 6,181,964, 6,241,701, and 6,233,482; electroporation may also be used for transfection of cells in vitro as described e.g. in US20070128708A1. Electroporation may also be utilized to deliver nucleic acids into cells in vitro. Accordingly, electroporation-mediated administration into cells of nucleic acids including expression constructs utilizing any of the many available devices and electroporation systems known to those of skill in the art presents an exciting new means for delivering an RNA of interest to a target cell.

Sources of Cells

In one embodiment, cells are obtained from a subject. Non-limiting examples of subjects include humans, dogs, cats, mice, rats, pigs and transgenic species thereof. Preferably, the subject is a human. Cells can be obtained from a number of sources, including peripheral blood mononuclear cells, bone marrow, lymph node tissue, spleen tissue, umbilical cord, cancer cells and tumors. In certain embodiments, any number of cell lines available in the art, may be used. In certain embodiments, cells can be obtained from a unit of blood collected from a subject using any number of techniques known to the skilled artisan, such as Ficoll separation. In one embodiment, cells from the circulating blood of an individual are obtained by apheresis or leukopheresis. The apheresis product typically contains lymphocytes, including T cells, monocytes, granulocytes, B cells, other nucleated white blood cells, red blood cells, and platelets. The cells collected by apheresis may be washed to remove the plasma fraction and to place the cells in an appropriate buffer or media, such as phosphate buffered saline (PBS) or wash solution lacks calcium and may lack magnesium or may lack many if not all divalent cations, for subsequent processing steps. After washing, the cells may be resuspended in a variety of biocompatible buffers, such as, for example, Ca-free, Mg-free PBS. Alternatively, the undesirable components of the apheresis sample may be removed and the cells directly resuspended in culture media.

In another embodiment, cells are isolated from peripheral blood. Alternatively, cells can be isolated from umbilical cord. In any event, a specific subpopulation of cells can be further isolated by positive or negative selection techniques.

Cells can also be frozen. While many freezing solutions and parameters are known in the art and will be useful in this context, in a non-limiting example, one method involves using PBS containing 20% DMSO and 8% human serum albumin, or other suitable cell freezing media. The cells are then frozen to −80° C. at a rate of 1 per minute and stored in the vapor phase of a liquid nitrogen storage tank. Other methods of controlled freezing may be used as well as uncontrolled freezing immediately at −20° C. or in liquid nitrogen.

Pharmaceutical Compositions

Pharmaceutical compositions of the present invention may comprise the modified cell as described herein, in combination with one or more pharmaceutically or physiologically acceptable carriers, diluents or excipients. Such compositions may comprise buffers such as neutral buffered saline, phosphate buffered saline and the like; carbohydrates such as glucose, mannose, sucrose or dextrans, mannitol; proteins; polypeptides or amino acids such as glycine; antioxidants; chelating agents such as EDTA or glutathione; adjuvants (e.g., aluminum hydroxide); and preservatives. Compositions of the present invention are preferably formulated for intravenous administration.

Pharmaceutical compositions of the present invention may be administered in a manner appropriate to the disease to be treated (or prevented). The quantity and frequency of administration will be determined by such factors as the condition of the patient, and the type and severity of the patient's disease, although appropriate dosages may be determined by clinical trials.

It can generally be stated that a pharmaceutical composition comprising the modified cells described herein may be administered at a dosage of $10^4$ to $10^9$ cells/kg body weight, in some instances $10^5$ to $10^6$ cells/kg body weight, including all integer values within those ranges. Compositions of the invention may also be administered multiple times at these dosages. The cells or vectors can be administered by using infusion techniques that are commonly known in immunotherapy (see, e.g., Rosenberg et al., New Eng. J. of Med. 319:1676, 1988). The optimal dosage and treatment regime for a particular patient can readily be determined by one skilled in the art of medicine by monitoring the patient for signs of disease and adjusting the treatment accordingly.

The administration of the modified cells or vectors of the invention may be carried out in any convenient manner known to those of skill in the art. The cells or vectors of the present invention may be administered to a subject by aerosol inhalation, injection, ingestion, transfusion, implantation or transplantation. The compositions described herein may be administered to a patient transarterially, subcutaneously, intradermally, intratumorally, intranodally, intramedullarly, intracystically intramuscularly, by intravenous (i.v.) injection, parenterally or intraperitoneally. In other instances, the cells of the invention are injected directly into a site of inflammation in the subject, a local disease site in the subject, a lymph node, an organ, a tumor, and the like.

It should be understood that the method and compositions that would be useful in the present invention are not limited to the particular formulations set forth in the examples. The following examples are put forth so as to provide those of ordinary skill in the art with a complete disclosure and description of how to make and use the cells, expansion and culture methods, and therapeutic methods of the invention, and are not intended to limit the scope of what the inventors regard as their invention.

The practice of the present invention employs, unless otherwise indicated, conventional techniques of molecular biology (including recombinant techniques), microbiology, cell biology, biochemistry and immunology, which are well within the purview of the skilled artisan. Such techniques are explained fully in the literature, such as, "Molecular Cloning: A Laboratory Manual", fourth edition (Sambrook, 2012); "Oligonucleotide Synthesis" (Gait, 1984); "Culture of Animal Cells" (Freshney, 2010); "Methods in Enzymology" "Handbook of Experimental Immunology" (Weir, 1997); "Gene Transfer Vectors for Mammalian Cells" (Miller and Calos, 1987); "Short Protocols in Molecular Biology" (Ausubel, 2002); "Polymerase Chain Reaction: Principles, Applications and Troubleshooting", (Babar, 2011); "Current Protocols in Immunology" (Coligan, 2002).

These techniques are applicable to the production of the polynucleotides and polypeptides of the invention, and, as such, may be considered in making and practicing the invention. Particularly useful techniques for particular embodiments will be discussed in the sections that follow.

EXPERIMENTAL EXAMPLES

The invention is now described with reference to the following Examples. These Examples are provided for the purpose of illustration only, and the invention is not limited to these Examples, but rather encompasses all variations that are evident as a result of the teachings provided herein.

The materials and methods employed in these experiments are now described.

Lentiviral SAM library production: Mouse CRISPR activation plasmid libraries (lenti-U6-mSAM-EFS-Puro) were expanded by electroporation (Konermann et al. (2015) *Nature* 517, 583-588). An estimated library coverage of >100× (>100 colonies per sgRNA) was achieved in electroporation, and the coverage of sgRNAs was subsequently sequence-verified by Illumina sequencing. For lentivirus production, 20 µg of plasmids of lenti-EF1a-NLS-dCas9-VP64-P2A-Blast, lenti-EF1a-MS2-p65-HSF1-P2A-Hygro or lenti-U6-SAM-EFS-Puro library, together with 10 µg of pMD2.G and 15 µg of psPAX2 were co-transfected into HEK293FT cells in 150 mm-dish at 80-90% confluency using 130 µg polyethyleneimine (PEI) as the transfection reagent. 6-12 hours later, the media was replaced by fresh DMEM+10% FBS. Virus supernatant was collected 48 h and 72 h post-transfection, centrifuged at 1500 g for 10 min and passed through 0.45-µm filter to remove the cell debris; aliquoted and stored at −80° C. Virus was titrated by infecting E0771 cells followed by the selection under 5 µg/ml puromycin.

Generation of cell-based CAVac: E0771 cells stably expressing dCas9-VP64 and MS2-P65-HSF1 (E0771-dCas9-MPH) were generated by transducing lentiviruses containing lenti-EF1a-NLS-dCas9-VP64-2A-Blast and lenti-EF1a-MS2-p65-HSF1-2A-Hygro into E0771 cells, followed by 7 days of selection under the pressure of 10 µg/ml blasticidin and 500 µg/ml hygromycin. Then, the E0771-dCas9-MPH cells were transduced with mSAM-library-containing lentiviruses at an MOI of 0.2-0.3, with a minimal representation of 200× transduced cells per sgRNA as described previously (Konermann et al. (2015) *Nature* 517, 583-588). Briefly, $1×10^8$ cells were infected by lib-containing viruses at a calculated MOI of 0.2 and cultured at 37° C. more than 1 day before replacing with 5 µg/ml puromycin containing media, and the transduced cells were drug-selected for 7 days before using.

Sequencing confirmation of SAM sgRNA library representation: Library transduced cells were subjected to genomic DNA (gDNA) extraction using standard molecular biology protocols. The sgRNA library readout was performed using a two-step PCR strategy, where the first PCR includes enough genomic DNA to preserve full library complexity and the second PCR adds appropriate sequencing adapters to the products from the first PCR.

```
PCR1 primers:
Forward:
                              (SEQ ID NO: 23, 777)
AATGGACTATCATATGCTTACCGTAACTTGAAAGTATTTCG
```

-continued

```
Reverse:
                                   (SEQ ID NO: 23, 778)
CTTTAGTTTGTATGTCTGTTGCTATTATGTCTACTATTCTTTCCC
```

PCR was performed using Phusion Flash High Fidelity Master Mix (PF) or DreamTaq Green PCR Master Mix (DT) (ThermoFisher). For reactions using PF, in PCR #1, the thermocycling parameters were: 98° C. for 1 min, 16-20 cycles of (98° C. for Is, 62° C. for 5 s, 72° C. for 30 s), and 72° C. for 2 min. For reactions using DT, the thermocycling parameters were adjusted according to manufacturer's protocol. In each PCR #1 reaction, 3 μg of total gDNA was used. A total of 8 to 12 of PCR #1 reactions was used to capture the full representation of the library in the cells. PCR #1 products for each biological sample were pooled and used for amplification with barcoded second PCR primers.

```
Barcoding second PCR primers used:
SF5:
                                   (SEQ ID NO: 24, 107)
AATGATACGGCGACCACCGAGATCTACACTCTTTCCCTACACGACGCT

CTTCCGATCTTCGATCGTTACCATCTTGTGGAAAGGACGAAACACCG (SEQ ID NO: 24, 108)
SF6:
AATGATACGGCGACCACCGAGATCTACACTCTTTCCCTACACGACGCT

CTTCCGATCTATCGATTCCTTGGTTCTTGTGGAAAGGACGAAACACCG

SR1:
                                   (SEQ ID NO: 24, 109)
CAAGCAGAAGACGGCATACGAGATAAGTAGAGGTGACTGGAGTTCAGA

CGTGTGCTCTTCCGATCTTTCTACTATTCTTTCCCCTGCACTGT

SR2:
                                   (SEQ ID NO: 24, 110)
CAAGCAGAAGACGGCATACGAGATACACGATCGTGACTGGAGTTCAGA

CGTGTGCTCTTCCGATCTATTCTACTATTCTTTCCCCTGCACTGT

SR3:
                                   (SEQ ID NO: 24, 1111)
CAAGCAGAAGACGGCATACGAGATCGCGCGGTGTGACTGGAGTTCAGA

CGTGTGCTCTTCCGATCTGATTCTACTATTCTTTCCCCTGCACTGT

SR4:
                                   (SEQ ID NO: 24, 112)
CAAGCAGAAGACGGCATACGAGATCATGATCGGTGACTGGAGTTCAGA

CGTGTGCTCTTCCGATCTCGATTCTACTATTCTTTCCCCTGCACTGT

SR5:
                                   (SEQ ID NO: 24, 113)
CAAGCAGAAGACGGCATACGAGATCGTTACCAGTGACTGGAGTTCAGA

CGTGTGCTCTTCCGATCTCGATCTCTACTATTCTTTCCCCTGCACTGT

SR6:
                                   (SEQ ID NO: 24, 114)
CAAGCAGAAGACGGCATACGAGATTCCTTGGTGTGACTGGAGTTCAGA

CGTGTGCTCTTCCGATCTTTCTACTATTCTTTCCCCTGCACTGT
```

For reactions using PF, in PCR #2, the thermocycling parameters were: 98° C. for 1 min, 18-24 cycles of (98° C. for is, 60° C. for 5 s, 72° C. for 30 s), and 72° C. for 2 min. Second PCR products were pooled and then normalized for each biological sample before combining uniquely barcoded separate biological samples. The pooled product was then gel purified from a 2% E-gel EX (Life Technologies) using the QiaQuick kit (Qiagen). The purified pooled library was then quantified with a gel-based method using the Low- Range Quantitative Ladder Life Technologies, dsDNA High-Sensitivity Qubit (Life Technologies), BioAnalyzer (Agilent) and/or qPCR. Diluted libraries with 5-20/PhiX were sequenced with MiSeq, HiSeq 2500 or HiSeq 4000 systems (Illumina).

Raw single-end fastq read files were filtered and demultiplexed using Cutadapt (Martin et al. (2011) *EMBnet.journal* 17, 10-12). To remove extra sequences downstream (i.e. 3' end) of the sgRNA spacer sequences, the following settings were used: cutadapt—discard-untrimmed–a GTTTTAGAGCTAGGCCAAC (SEQ ID NO: 24,115). As the forward PCR primers used to readout sgRNA representation were designed to have a variety of barcodes to facilitate multiplexed sequencing, these filtered reads were then demultiplexed with the following settings: cutadapt -g file: fbc.fasta --no-trim, where fbc.fasta contained the 12 possible barcode sequences within the forward primers. Finally, to remove extra sequences upstream (i.e. 5' end) of the sgRNA spacers, the following settings were used: cutadapt --discard-untrimmed -g GTGGAAAGGACGAAACACCG (SEQ ID NO: 24,116). Through this procedure, the raw fastq read files could be pared down to the 20 bp sgRNA spacer sequences. These 20 bp sgRNA spacer sequences from each demultiplexed sample were mapped the sgRNA spacers to the mSAM library using Bowtie 1.1.2 (Langmead et al. (2009) *Genome Biol* 10, R25): bowtie -v1 --suppress 4,5,6, 7—chunkmbs 2000—best. Using the resultant mapping output, the number of reads that had mapped to each sgRNA within the library were quantitated. To count sgRNA representation, a detection threshold of $\log_2$ rpm≥1 was set and the number of unique sgRNAs present in each sample was counted.

Mice: All animal work was approved by IACUC and performed with approved protocols. Mice of both sexes, between 5-12 weeks of age were used for the study. Various animals were used in this study. 5-10 week old C57BL/6J mice were used for experiments. Female mice were used for breast cancer models. Male mice were used for pancreatic adenocarcinoma (Pan2) models. A mix of both male and female mice were used for melanoma (B16F10) models. All animals were housed in standard individually ventilated, pathogen-free conditions, with 12 h:12 h or 13 h:11 h light cycle, room temperature (21-23° C.) and 40-60% relative humidity. Sample size was determined based on number of animals used. Prior estimation of number of mice used was estimated based on similar tumor models in the field. When a cohort of animals receive multiple treatments, animals were randomized by 1) randomly assign animals to different groups using littermates, 2) random mixing of females prior to treatment, maximizing the evenness or representation of mice from different cages in each group, and/or 3) random assignment of mice to each group, in order to minimize the effect of litter, small difference in age, cage, housing position, where applicable.

Tumorigenesis of E0771-SAM in C57BL/6J, Nu/Nu, or $Rag1^{-/-}$ mice: $5 \times 10^6$ of E0771-SAM or E0771-Vector tumor cells were injected into the orthotopic mammary fat pad of syngeneic 5-8 weeks old female C57BL/6J mice, Nu/Nu, or $Rag1^{-/-}$ mice. Tumor sizes were measured every 3-4 days by caliper on the three diameters, and sizes were calculated as approximate spheroids with the formula: Vol=π/6*x*y*z. Statistical significance of all tumor growth curves in the study was assessed by analysis of variance (2-way ANOVA), jointly considering the effect of treatment and the passage of time on tumor growth. For CD4 and CD8 T cell depletion, 200 ug α-CD4 (GK1.5, BioXcell) and 200 ug α-CD8 (YTS 169.4) were intraperitoneally injected into tumor-transplanted C57BL/6J mice at dpi 7 and dpi 14 to block the effect of T cells at an early stage of tumorigenesis. The successful depletion of CD8 T cells was confirmed by isolating PBMCs from mice at dpi 14 and 21 and analyzing the CDC T cell population with flow cytometry.

Generation of cell-based MAEGI: Cell-based MAEGI (c-MAEGI) was produced by treating E0771-SAM cells (described above) with 10 ug/ml mitomycin for more than 2 hrs to restrain their proliferation ability while maintaining cellular integrity. In parallel, mitomycin-treated E0771-Vector (referred to as mock Cell-Vector) was used as control. The therapeutic effects of heat-inactivated lysates of the same numbers of E0771-mSAM and E0771-Vector cells were also used for comparison. Heat induced cell lysis of E0771 and c-MAEGI was performed by incubation at 65° C. for 30 minutes followed by 3 freezing-thaw cycles, lysing the cells and disrupting the integrity of peptide-MHC complexes on the cell surface.

Prophylactic application of CAVac (c-MAEGI) in syngeneic tumor models: $5 \times 10^6$ mSAM-transduced E0771 tumor cells were injected orthotopically into mammary fatpad of syngeneic 5-8 weeks old female C57BL/6J mice. 3, 7, or 14 days after CAVac inoculation, $5 \times 10^6$ E0771 tumor cells were transplanted into the mammary fatpad in C57BL/6J mice. For the challenges with tumors derived from different cells of origin, $5 \times 10^6$ LCC cells were injected subcutaneously into flank of E0771-CAVac vaccinated C57BJ6J mice. The growth of tumors was continuously monitored and measured by caliper, twice per week. Statistical significance was assessed by paired f-test and/or analysis of variance (ANOVA) where applicable.

Therapeutic effects of CAVac (c-MAEGI) in syngeneic tumor models: Syngeneic orthotopic breast tumors were established by transplanting $2 \times 10^6$ or $5 \times 10^6$ E0771 cells into the mammary fatpad of 5-8 weeks old female C57BL/6J mice. 4, 8 and 14 days after transplantation, therapeutic CAVac made using $5 \times 10^6$-$1 \times 10^7$ mSAM-transduced E0771 cells was s.c. injected into left flank of tumor-bearing mice. Tumors were measured every 3-4 days using caliper and sizes were calculated with the formula: Vol=$\pi/6 \times x \times y \times z$.

Generation of AAV-CAVac (AAV-based MAEGI): An AAV version of the CRISPR activation vector (AAV-CRIS-PRa vector, i.e. U6p-sgSapI-EF1a-MS2-p65-HSF1-WPRE), and an AAV version of dCas9 vector (AAV-dCas9, i.e. EFS-dCas9-VP64-spA), were generated by restriction cloning and Gibson assembly. The sgRNA libraries of mSAM were cloned into the above CRISPRa plasmid by linearization with SapI digestion and Gibson assembly. The purification and electroporation of Gibson products into Endura electrocompetent cells were performed as previously described (Joung, et al. (2017) *Nat Protoc* 12, 828-863), with at least 100× coverage of colonies represented per sgRNA. AAV9 was produced by co-transfecting HEK293FT cells with above AAV plasmids of CRISPR activation vector or library (AAV-mSAM), AAV9 serotype plasmid and helper plasmid PDF6. Briefly, 5.2 μg of AAV-vector or AAV-mSAM, 8.7 μg of AAV9 serotype plasmid and 10.4 μg of pDF6 were mixed with PEI, room temperature 10 min before drop-wisely adding them into HEK293FT cells in 150 mm-dish at 80-90% confluency. Replicates collected from multiple dishes were pooled to enhance production yield. Cells were collected 72 h post transfection. For AAV9 purification, ¹⁄₁₀ volume of chloroform was added and the mixture was vigorously shaken for 1 h at 37° C. NaCl was added to a final concentration of 1 M and the mixture was shaken until dissolved and then pelleted at 20,000 g at 4° C. for 15 min. The aqueous layer was discarded while the chloroform layer was transferred to another tube. PEG8000 was added to 10% (w/v) and shaken until dissolved. The mixture was incubated at 4° C. for 1 h and then spun at 20,000 g at 4° C. for 15 min. The supernatant was discarded and the pellet was resuspended in DPBS plus $MgCl_2$ and treated with Benzonase (Sigma) and incubated at 37° C. for 30 min. Chloroform (1.1 volume) was then added, shaken, and spun down at 12,000 g at 4° C. for 15 min. The aqueous layer was isolated and passed through a 100 kDa MWCO (Millipore). The concentrated solution was washed with PBS and the filtration process was repeated. Genomic copy number (GC) of AAV was determined by real-time quantitative PCR using custom Taqman assays (ThermoFisher) targeted to the engineered U6 promoter.

Combinatorial therapy using CAVac (c-MAEGI) and monoclonal antibodies: To check the synergistic effect between therapeutic CAVac (c-MAEGI) and immune checkpoint blockade or CD4 depletion, 5 mg/kg anti-CTLA4 monoclonal antibody (9D9, BioXcell), 8 mg/kg anti-PD1 monoclonal antibody (RMP1-14, BioXcell) or 200 μg per mouse anti-CD4 antibody (GK1.5, BioXcell) were administrated by i.p. injection at day 7 and day 14 with or without CAVac vaccination as described elsewhere herein. Two-way ANOVA was used to compare growth curves between treatment groups. Tumor re-challenge was done by injecting $5 \times 10^6$ E0771 cells into the contralateral fatpad of mice underwent complete response.

ELISPOT assay: IFN-γ ELISPOT mouse kits (BD Biosciences) were used according to the manufacturer's instructions. Briefly, 96-well filtration plates were coated overnight at 4° C. with capturing monoclonal antibody; the plates were then washed and blocked with RPMI-1640 medium containing 10% FBS for 2 h at room temperature. Splenocytes in RPMI-1640 ($1 \times 10^6$ cells/well) were then added, and $5 \times 10^4$ mitomycin-treated E0771 cells was subsequently added as the stimulation antigen; the plates were cultured for approximately 45 hours at 37° C. and 5% $CO_2$. After washing once with DI water and three times with PBST, the plates were incubated with biotinylated detection antibody at room temperature for 2 h. Then, plates were incubated with HRP-conjugated streptavidin at room temperature for 1 h after washing three times with PBST. Spots were revealed using an AEC substrate reagent kit (BD Bioscience) at room temperature and counted using an Immunospot Reader (Cellular Technology).

Therapeutic testing of AAV-CAVac (g-MAEGI) in syngeneic tumor models: Syngeneic orthotopic breast tumors were established by transplanting $2 \times 10^6$ E0771-dCas9-VP64 cells into the mammary fatpad of 5-8 weeks old female C57BL/6J mice. 4, 10, 14, and 21 days after transplantation, $2$-$5 \times 10^{10}$ GCs of AAV-CAVac or PBS were injected intratumorally to tumor-bearing mice. For the B16F10 melanoma model, $5 \times 10^5$ dCas9-VP64 expressing cancer cells were injected subcutaneously into the flank of C57BL/6J mice. 7, 10, 14, and 20 days after transplantation, $5$-$10 \times 10^{10}$ GCs of AAV-CAVac (AAV-g-MAEGI), AAV-Vector, or PBS were intratumorally administrated into tumor-bearing mice. For the pancreatic tumor model, $2 \times 10^6$ Pan02 cancer cells were injected subcutaneously into the flank of C57BL/6J mice. 5, 13, 21, and 35 days after transplantation, $5$-$10 \times 10^{10}$ GCs of AAV-CAVac or PBS were intratumorally administrated into tumor-bearing mice. Tumors were measured every 3-4 days using caliper and sizes were calculated with the formula: Vol=$\pi/6 \times x \times y \times z$.

Splenocytes and tumor infiltrating lymphocyte isolation: Syngeneic breast tumors were established by transplanting $2 \times 10^6$ E0771 cells into the mammary fatpad of 5-8 weeks old female C57BL/6J mice. Tumor-bearing mice were randomly assembled into different treatment group and treated with PBS, CAVac, ICB monoclonal antibodies, CAVac+ICB antibodies accordingly. Mice were euthanized 35 days' post-transplantation, tumors and spleens were collected and kept in ice-cold 2% FBS. For spleens, they were placed in ice-cold 2% FBS and mashed through a 100 μm filter. Splenocytes were washed once with 2% FBS. RBCs were lysed with 1 ml of ACK Lysis Buffer (Lonza) per spleen by incubating 2 mins at room temperature, which was followed by the dilution with 10 ml 2% FBS and pass through a 40 μm filter. Splenocytes were resuspended in 2% FBS buffer, counted for flow cytometry staining or RNA isolation. Tumors were minced into 1-3 mm size pieces using scalper and then digested using 100 U/mL Collagenase IV for 30-60 min while stirred at 37° C. Tumor suspensions were filtered twice through 100 μm cell strainer, and once through 40 μm cell strainer to remove large bulk. Subsequently, single cell suspensions can be directly used for FACS staining, or further Ficoll purification to obtain tumor-infiltrating lymphocytes. For Ficoll-Paque purification, single cell suspensions at density of ($\sim 10^7$ cells/ml) were carefully layered onto Ficoll-Paque media (GE Healthcare) and centrifuge at 400 g for 30 min. Cells at the interface were carefully collected, and washed twice with 2% FBS, counted, and used for RNA isolation or flow cytometry staining.

Flow cytometry: All antibodies were purchased from Biolegend. Single cell suspensions from tumors or spleens were prepared as previous described. For surface staining, cells were blocked with anti-Fc receptor anti-CD16/CD32 and surface stained with anti-CD45.2-APC/Cy7, anti-CD3-PE, anti-CD4-FITC, anti-CD8a-APC, in PBS+2% FBS on ice for 30 min. Samples were washed twice with PBS+2% FBS before analyzed or sorted on a BD FACSAria. The data was analyzed using FlowJo software on a MAC® workstation.

Fluorescence-activated cell soring (FACS) isolation of CD45$^+$ cells from tumors: Single tumor cell suspensions were prepared using the gentleMACS system with the method described in "Splenocytes and tumor infiltrating lymphocyte isolation". Tumor cells were blocked using anti-Fc receptor anti-CD16/CD32. Live cells were distinguished from dead cells in flow cytometry by staining with LIVE/DEAD™ Fixable Near-IR Dead Cell Stain Kit following manufacturer's instructions. Cells at a density of 10/ml were stained with DMSO dissolved live/dead staining dye and PerCP/Cy5.5 or APC conjugated CD45 antibody in PBS+2% FBS, and incubated on ice for 30 min. Stained cells were washed three times before being analyzed and FACS isolated on a BD FACSAria. Tumor-infiltrating CD45+ pan-immune cells (TIICs) were isolated by gating on PerCP/Cy7$^+$APC/Cy7$^-$ or APC$^+$APC/Cy7$^-$ populations. Sorted TIICs were counted, and used for scRNAseq and ELISpot analysis.

Immune cell profiling by single-cell RNA-seq: Single cell suspensions from tumors were prepared as previously described. For CD45$^+$ cell isolation, cells were blocked with anti-Fc receptor anti-CD16/CD32 and surface stained with anti-CD45.2 in PBS+2% FBS on ice for 30 min. Samples were washed twice with PBS+2% FBS, and CD45$^+$ cell populations in tumors were FACS sorted using a BD FACSAria. Sorted cells were collected in PBS+2% FBS, cell numbers and viabilities were assessed by trypan blue staining and counting in Countess II FL Automated Cell Counter (Thermo). 10,000 CD45$^+$ cells isolated from tumors were used for single-cell RNAseq by following the protocol from 10× Genomics.

Single cell RNA-seq data processing: Pan-immune cell scRNA-seq data was pre-processed using established and custom pipelines. Briefly, raw Illumina data files were processed by Cell Ranger 1.3 (10× Genomics)(Zheng, et al. (2017) Nat Commun 8, 14049), using cellranger mkfastq to wrap Illumina's bcl2fastq to correctly demultiplex sequencing samples and to convert barcode and read data to FASTQ files. Then, cellranger count was used to take FASTQ files and perform alignments to the mouse genome (mm10) (Dobin, et al. (2013) Bioinformatics 29, 15-21), filtering, and UMI counting. Using Seurat (Butler & Satija (2017) bioRxiv), cells passing the initial quality control metrics imposed by the Cell Ranger pipeline were further filtered by excluding all cells in which mitochondrial genes disproportionately comprised the total % of the library (empirically determined cutoff of 5% mitochondrial reads). With this filter, a final set of 7,458 cells was retained for further analysis (from initial of 7,492 cells). After log normalization, the 27,998 genes/features were filtered using a flat cutoff metric such that genes with low variance were excluded, leaving 1267 genes. The data were then scaled based on UMI total counts and the % of mitochondrial reads. Using the final normalized and processed dataset above, t-SNE dimension reduction was performed (Maaten & Hinton (2008) J. Mach. Learn. Res. 9, 2579-2605; Maaten (2014) J. Mach. Learn. Res. 15, 3221-3245). Individual data points were colored based on the treatment condition for each cell, or based on unbiased k-means clustering performed in Seurat. Differential expression analyses between clusters and/or treatment conditions was performed by nonparametric Wilcoxon rank sum test. Multiple hypothesis correction was performed by the Benjamini-Hochberg method. Significantly differentially expressed genes were defined as having a Benjamini-Hochberg adjusted $p<0.05$.

RNA extraction, reverse transcription, and quantitative PCR: RNA in cells, splenocytes, and tumor infiltrating lymphocytes were extracted using TRIzol Reagent (Invitrogen) by following standard RNA extraction protocols. The first-strand cDNA of RNA was synthesized using Super-Script™ IV Reverse Transcriptase (Invitrogen). After normalizing the concentrations of cDNA with nuclease-free water, quantitative PCR (qPCR) was performed by adding designated Taqman probe of interested genes, and GAPDH was used as an internal positive control.

Western Blot: E0771, E0771-dCas9-VP64, and E0771-dCas9-VP64-MPH cells in 6-well plate were washed twice with ice cold PBS before lysis with 1×RIPA buffer which was kept on ice for 15 min. Cell lysates were centrifuged at 12,000 g for 15 min at 4° C. and protein-containing supernatant was collected. Protein concentration was measured using a standard Bradford assay (BioRad) and 20 μg of protein in each sample were loaded into SDS-PAGE gel. After electrophoresis, proteins separated in gel were transferred into nitrocellulose membranes. Membranes were blocked at room temperature for 1 h using 5% skim-milk in TBST, followed by the incubation with primary antibody in 4° C. overnight. After washing three times with TBST, horseradish peroxidase (HRP)-conjugated secondary antibody was added and incubated at room temperature for 30-60 min. The chemiluminescent substrate (Clarity Western ECL Substrate, Bio-Rad) was added on top of blot membrane according to the manufacturer's instructions. The signals were captured using a CCD camera-based imager (GE Healthcare).

Histology and immunohistochemistry: At matched time points, tumors from different treatment group were collected and fixed in 10% neutral formalin for 2-5 days. Tissues were transferred into 70% ethanol for long-term storage. Haematoxylin and eosin (H&E) staining or antibody staining were performed on 3-5 μm tissue sections using standard procedures.

T cell receptor sequencing (TCR-seq): Mice in different treatment groups were euthanized at 30-40 days' post-transplantation. Tumors and spleens were collected and kept in ice-cold 2% FBS before use. Single cell suspensions from tumors or spleens were prepared as previous described. The RNA from collected splenocytes and TILs were extracted using Trizol according to manufacturer's instructions.

TCR-seq data analysis: Raw fastq files from TCR-seq were processed to clonotypes using MiXCR following the author recommendations for 5' RACE-based library protocols (Bolotin, et al. (2015) Nat Methods 12, 380-381). Specifically, the mixer align function was first used to align to the V segment transcript, followed by collotype assembly using mixer assemble and mixcr exportClones. Subsequently, TCR-seq data were analyzed using the tcR package (Nazarov, et al. (2015) BMC Bioinformatics 16, 175) to determine clonal proportions and occupied clonal homeostasis in each sample. Metrics of diversity were calculated using ecological diversity, Gini-Simpson, and Chao indices.

Exome sequencing of E0771 and identification of all genic mutational spectrum: E0771 cells and freshly-dissected mammary fatpad from healthy, untreated 6-8 wk old female C57BL/6J mice were subjected to gDNA extraction following standard protocol. A total of 2 μg of gDNA per sample were subjected to exome capture using mouse exome probes (Roche) and then Illumina library preparation following manufacturer's protocols. Exome capture paired-end fastq files were mapped to the mm10 genome using Bowtie v2.2.9 (Langmead et al. (2009) Genome Biol 10, R25), and sorted by Samtools (Li et al. (2009) Bioinformatics 25, 2078-2079). VarScan v2.3.9 (Koboldt, D. C. et al. (2012) Genome Res 22, 568-576) was then used in somatic mode to call indels and SNPs that were specific to E0771 cells and not found in wildtype C57BL/6J mammary fatpad tissue. Germline calls were subsequently filtered out. The remaining variants were collapsed to the gene level, and the number of indels or SNPs for each gene was tabulated.

Generation of mutational spectrum guided precision AAV-CAVac (AAV-PCAVac/AAV-p-MAEGI): Genes were ranked by their number of somatic variants present in E0771 cells but not in healthy mammary fatpad. A set of 1,116 top mutated genes were chosen as differentially mutated genes in E0771 and 3 sgRNAs per gene (for the majority of genes) targeting promoter regions were chosen. A CRISPRa library consisting of 3,839 sgRNAs (SEQ ID NOs: 349-4,187) were designed for the E0771 top mutated gene set, pool-synthesized (Customarray), and cloned into the AAV-CRISPRa vector above. AAV library packaging was done as above to generate AAV-PCAVac for E0771.

Therapeutic testing of AAV-PCAVac (p-MAEGI): Syngeneic TNBC were established by orthotopic transplantation of $2\times10^6$ E0771 cells into the mammary fat pad of 5-8 weeks old female C57BL/6J mice. 5, 12 and 18 days after tumor induction, $5\times10^{10}$-$1\times10^{11}$ GCs of AAV-CAVac, AAV-Vector, or PBS were intratumorally administrated into tumor-bearing mice. For testing of the abscopal effect, syngeneic TNBC were established by orthotopic transplantation of $2\times10^6$ E0771 cells into an ipsilateral mammary fat pad, and 2.5× $10^5$ E0771 cells into the contralateral mammary fat pad. 4, 11, 18 and 24 days after tumor induction, $5\times10^{10}$-$1\times10^{11}$ GCs of AAV-p-MAEGI or AAV-Vector were intratumorally administrated into the ipsilateral tumor. Tumors were measured every 3-4 days using caliper and sizes were calculated with the formula: $Vol=\pi/6*x*y*z$. Two-way ANOVA was used to compare growth curves between treatment groups. Response to therapy was defined by a method similar to RECIST 1.1 criteria (CR, complete response, where endpoint tumor size=0; Near-CR, near complete response, where tumor size<50 $mm^3$ for the last 2 measurements; PR, partial response, where tumor sizes decreased for at least 2 consecutive measurements; SD, stable disease, where tumor size is between 70~100% of initial tumor size at the first treatment; PD, progressive disease, where tumor size>initial tumor size at the first treatment).

The results of the experiments are now described.

Figure 1A:
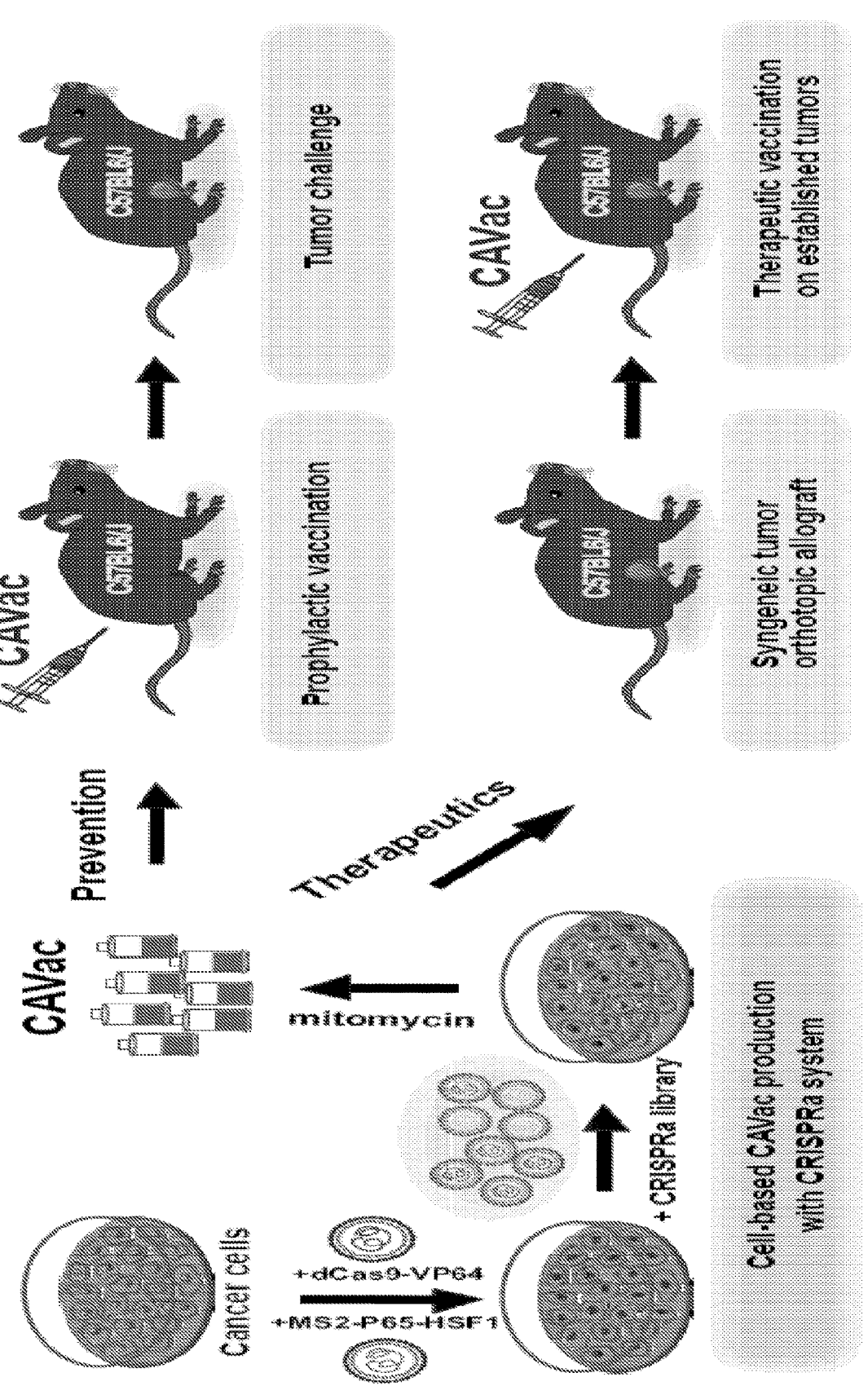
FIGS. 1A-K illustrate CRISPRa based endogenous gene activation as prophylactic and therapeutic vaccines.
Figure 5A:
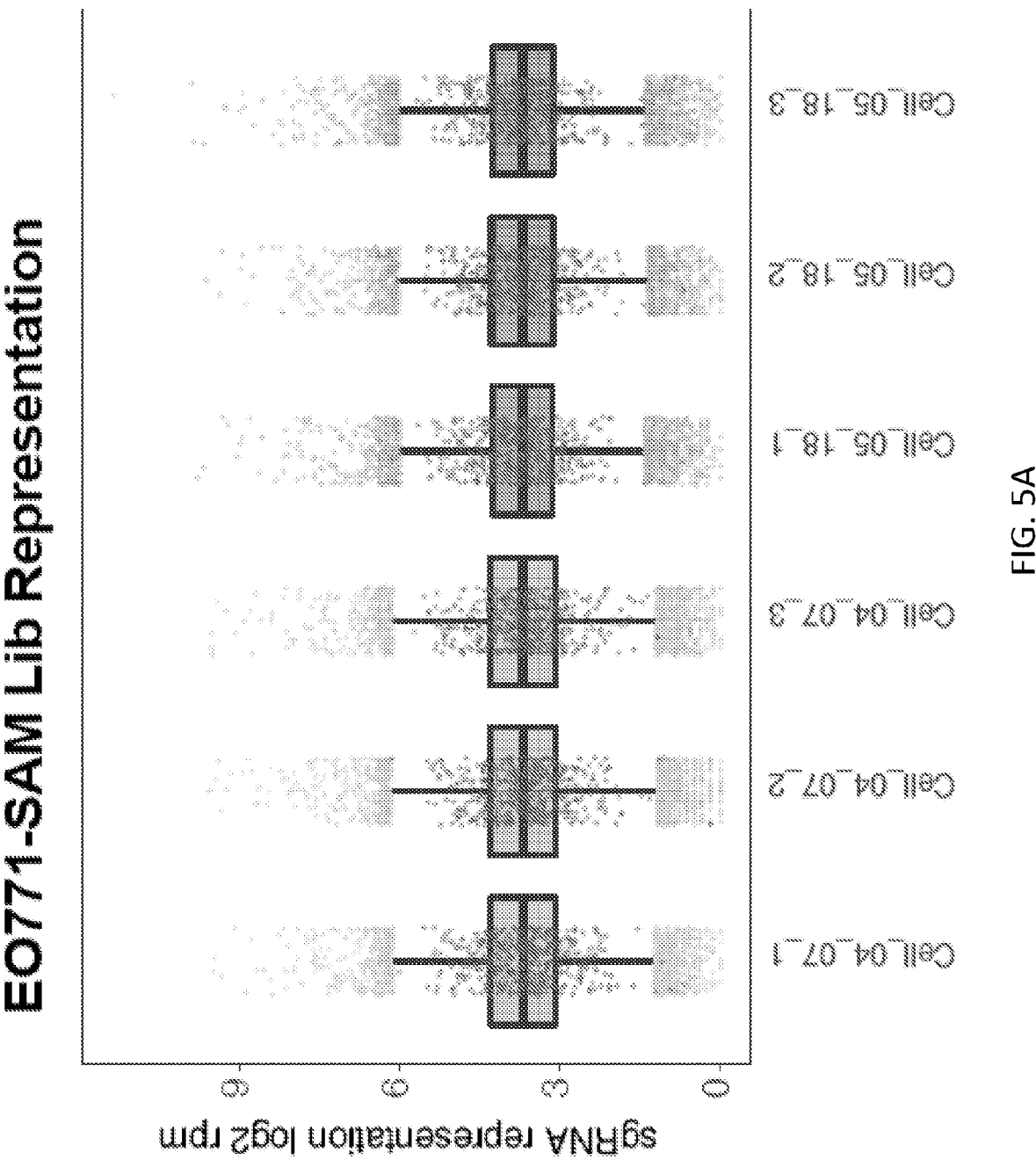
FIGS. 5A-5D illustrate library representation of mouse CRISPRa library transduced E0771 cells.
Figure 5B:
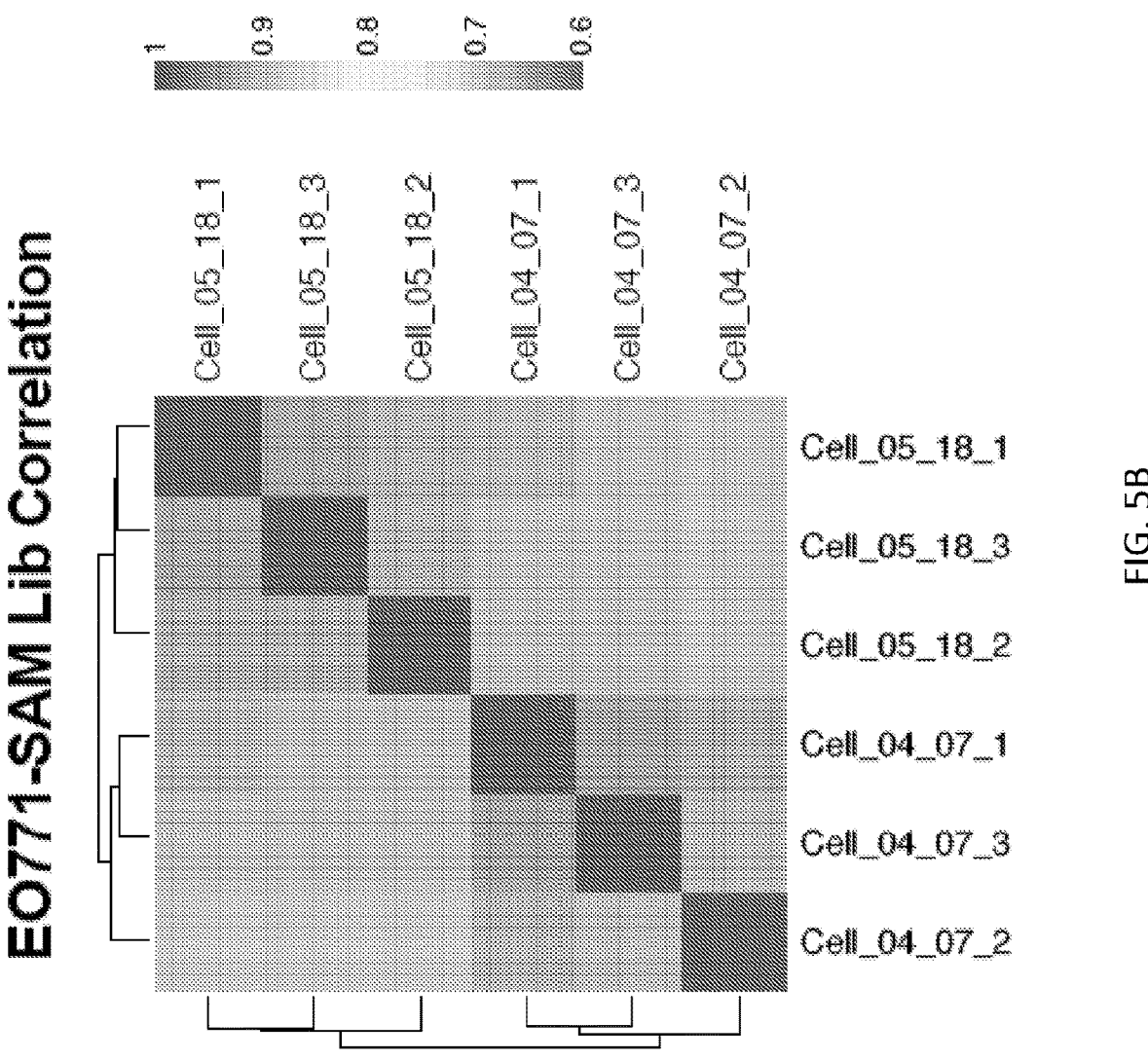

Example 1: Endogenous Gene Activation Induces Protective Anti-Tumor Responses Mutation profiles can vary dramatically between patients. Thus, to investigate a generalized multiplexed tumor vaccination concept, experiments first tested whether an unbiased activation of all endogenous coding genes can lead to an enhanced anti-tumor response in vivo. A syngeneic mouse model of triple-negative breast cancer (TNBC) was used wherein E0771 cells were transplanted in the mammary fatpad of fully immunocompetent hosts. E0771 cells were transduced with lentiviral vectors expressing dCas9-VP64 and MS2-p65-HSF1 (E0771-dCas9-MPH) (FIG. 1A). After confirming robust endogenous gene activation with the CRISPRa system (FIG. 5B), a mouse genome-scale lentiviral SAM CRISPRa sgRNA library (mSAM, or SAM for short) (Konermann et al. (2015) Nature 517, 583-588) was transduced into E0771-dCas9-MPH cells, generating a highly diverse population of cells encompassing the entire library (E0771-SAM). This was confirmed by Illumina sequencing readout of library representation for all 6 independent replicates used in the in vivo experiments (FIGS. 5A-5B). The E0771-SAM cell pool was transplanted into C57BL/6J mice to test their ability to form syngeneic tumors. In sharp contrast to vector transduced E0771 cells (0/8 rejection, i.e. 8/8 engrafted, all with large tumors), the E0771-SAM cell pool was rejected in most (42/50, 84%) of the mice, and the remaining 8/50 (16%) grew small tumors (p<2.2e-16, FIGS. 6A-6B). Of note, the E0771-SAM outgrown tumors were sensitive to checkpoint blockade immunotherapy (CBI), with rapid complete regression under the treatment of monoclonal immune checkpoint blockade (ICB) antibodies against programmed death-1 (PD-1) or cytotoxic T-lymphocyte associated antigen-4 (CTLA-4) (p<1e-5, FIGS. 7A-7D). To test the roles of innate and adaptive immune responses in tumor rejection responses, E0771-SAM cells were transplanted into the mammary fatpad of immune-deficient Nu/Nu and Rag1$^{-/-}$ mice. In sharp contrast to immunocompetent C57BL/6J hosts (2/5 with small modules, 3/5 tumor-free), all Nu/Nu (4/4) and Rag1$^{-/-}$ (5/5) mice grew large breast tumors from E0771-SAM (p<1e-5, FIGS. 6C-6F). Notably, E0771-SAM formed significantly larger tumors in Rag1$^{-/-}$ mice compared to that in Nu/Nu mice (p<0.0001, FIG. 6C). Furthermore, when both CD4$^+$ and CD8$^+$ T cells were pharmacologically depleted in C57BL/6J mice by treatment with both anti-CD4+anti-CD8 monoclonal antibodies, all mice receiving E0771-SAM transplantation formed large tumors (4/4), again in sharp contrast to non-treated (0/11) (p<1e-9, FIGS. 6G-6H). Together, these results indicated that activation of endogenous genes using the CRISPRa system in a genome-scale manner induced potent protective anti-tumor immune responses in vivo, leading to robust tumor rejection of syngeneic cancer cells by immunocompetent hosts.

Figures 1B, 1C:
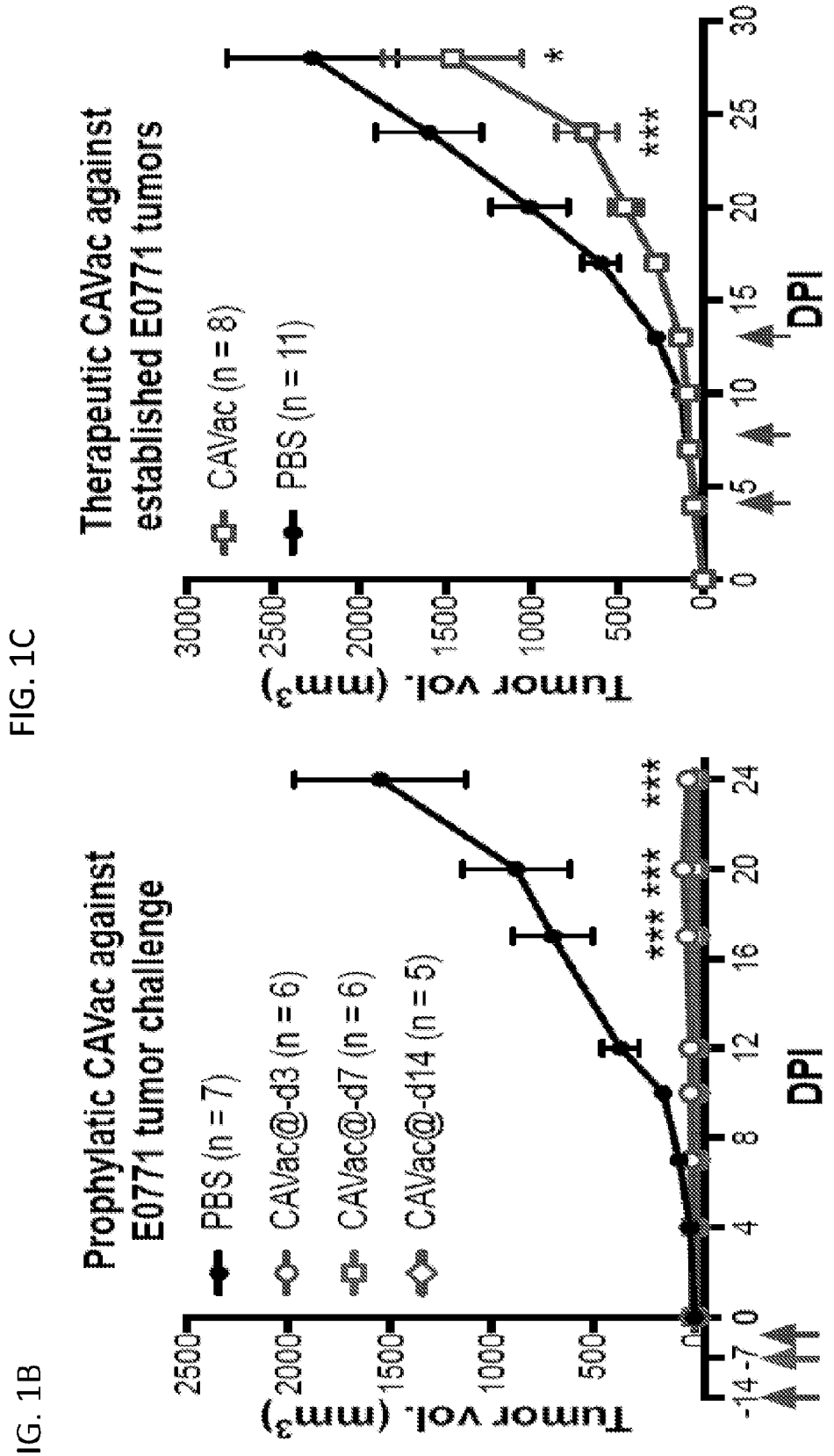

Example 2: Massively Parallel Gene Activation as Prophylactic and Therapeutic Cancer Vaccines The observations that E0771-SAM library cells were consistently rejected by the hosts led to the postulation that multiplexed activation of endogenous genes can stimulate broad anti-tumor immune responses to protect the host from the same type of tumor, thereby serving as prophylactic or therapeutic vaccines (FIG. 1A). To test the application of CRISPRa mediated endogenous gene Activation as a vaccine (CAVac), E0771-CAVac was generated by transducing genome-scale CRISPRa sgRNA libraries into E0771-dCas9-MPH cells followed by mitomycin treatment to induce senescence, and then tested as a cell-based vaccine (E0771-CAVac, or CAVac for short). To test the concept of a prophylactic vaccine, E0771-CAVac was inoculated into C57BL/6J mice prior to tumor induction (FIG. 1A). In sharp contrast to unvaccinated mice (0% tumor free), vaccination with E0771-CAVac granted the host complete protection (100% tumor free) against a subsequent tumor challenge with the unmodified parental cancer cell line (E0771), across two vaccination regiments (7 or 14 days prior to tumor challenge) (p<2.2e-16, 2.2e-16, respectively). Vaccination 3 days prior to tumor challenge also granted the host a close-to-complete protection (1/6 mouse with a small module, 5/6 tumor-free) (p<1e-10) (FIG. 1B). The results demonstrated that genome-scale activation of endogenous genes using CRISPRa is an effective approach to generate prophylactic vaccination against tumors with otherwise identical genetic backgrounds.

Figures 1D, 1E:
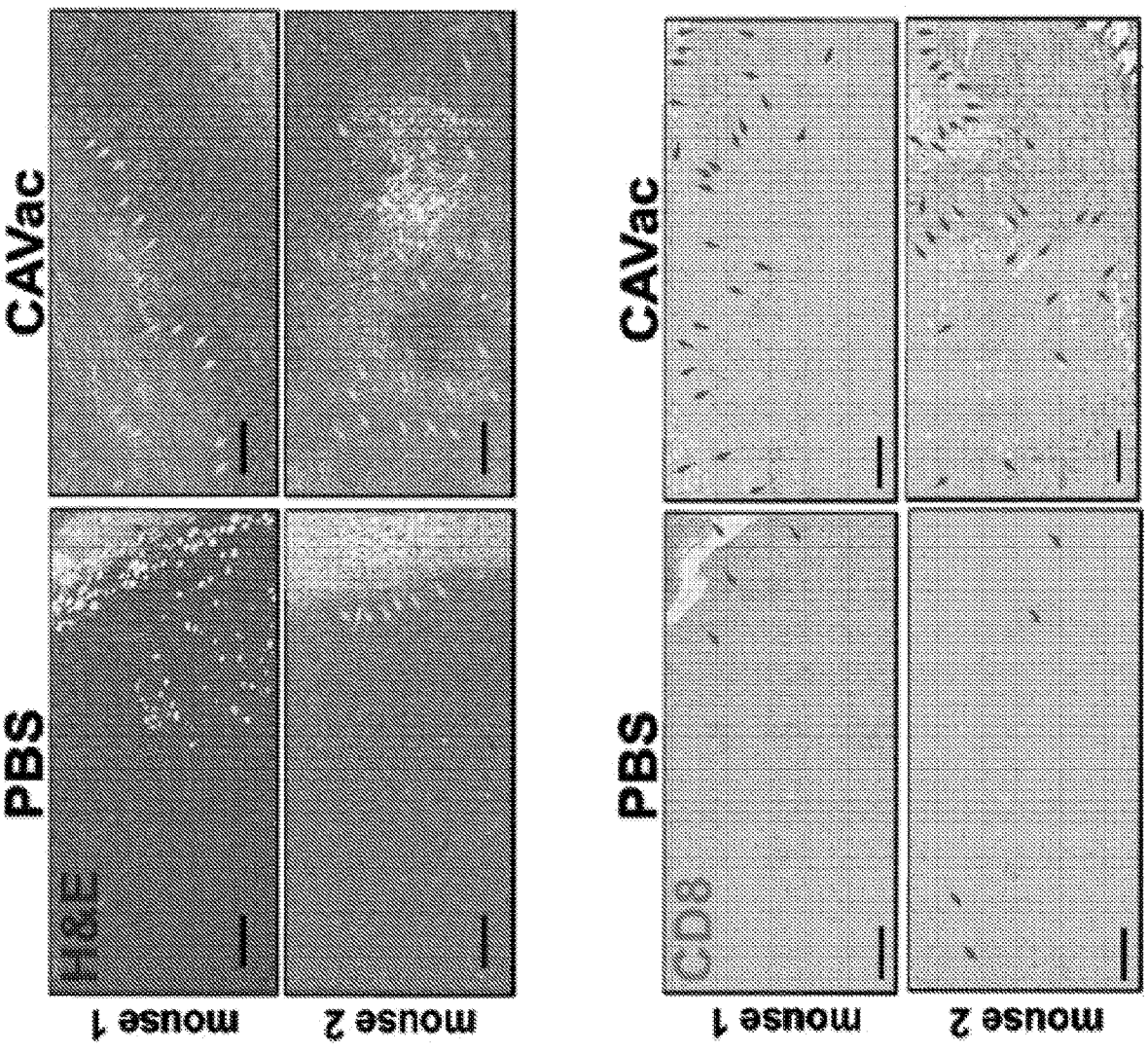
Figure 1F:
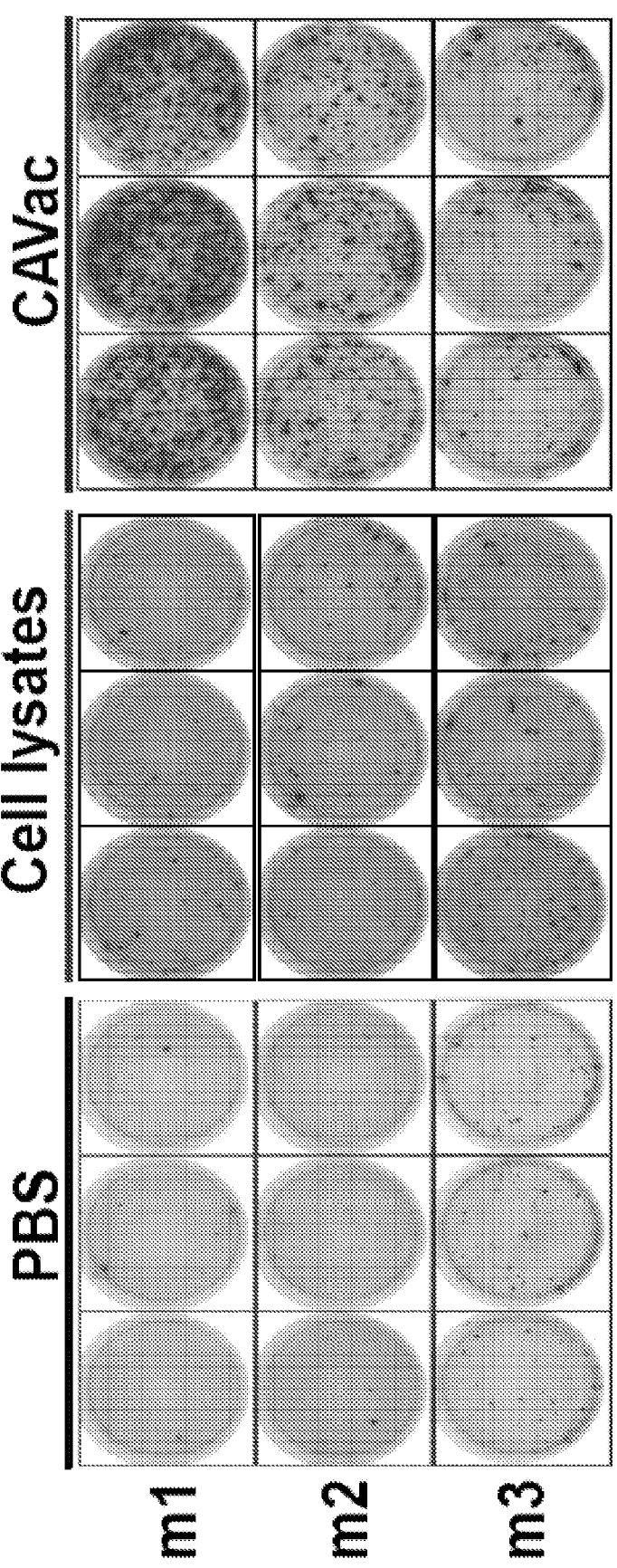

To test CAVac as a therapeutic intervention, orthotopic syngeneic E0771 tumors were induced before treating the mice with CAVac (FIG. 1A). Following a three-dose treatment scheme, CAVac treated mice tumors were significantly smaller than those of PBS treated (p<0.05, FIG. 1C, FIG. 8A-8B). The efficacy was not observed using the parental cell line without gene activation (p=0.77, FIG. 9A). Moreover, the therapeutic effect was abolished if CAVac was heat-inactivated (p=0.775, FIG. 9B). Of note, even a single dose CAVac treatment achieved comparable efficacy as the three dose treatment (p<0.05, FIG. 9C). At the experimental endpoint, the histopathology of the tumors were analyzed and large inflamed areas with CD8[+] lymphocytes and cancer cell death was observed in CAVac treated tumors, as compared to the rapidly proliferating PBS treated tumors with little inflammation and few CD8[+] cells (FIG. 1D-1E). To examine whether the anti-tumor effect was mediated by cancer-specific T cell response (at least in part), enzyme-linked immunospot (ELISPOT) assays were performed. CAVac significantly augmented the tumor-specific interferon γ (Ifnγ) production of vaccinated mice (p<0.05, FIG. 1F-1G). Furthermore, depletion of CD8[+] T lymphocytes alone (but not CD4[+] T lymphocytes) with anti-CD8 antibody abolished the therapeutic efficacy of CAVac (FIG. 9D), indicating that CD8[+] T cells are essential for anti-tumor response elicited by CAVac.

Figures 1G, 1H:
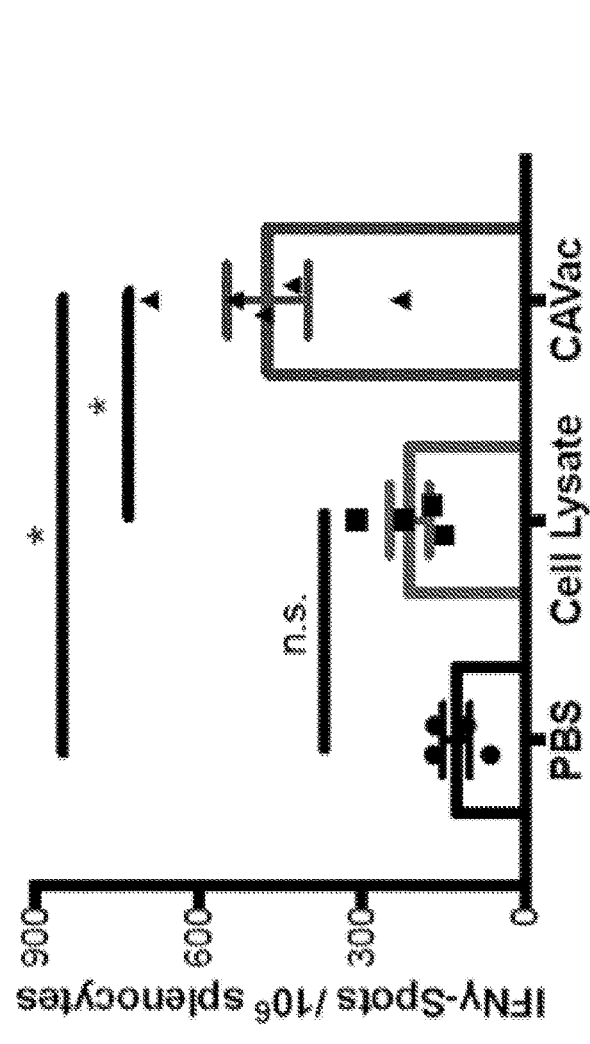
Figures 8A, 8B, 8C, 8D:
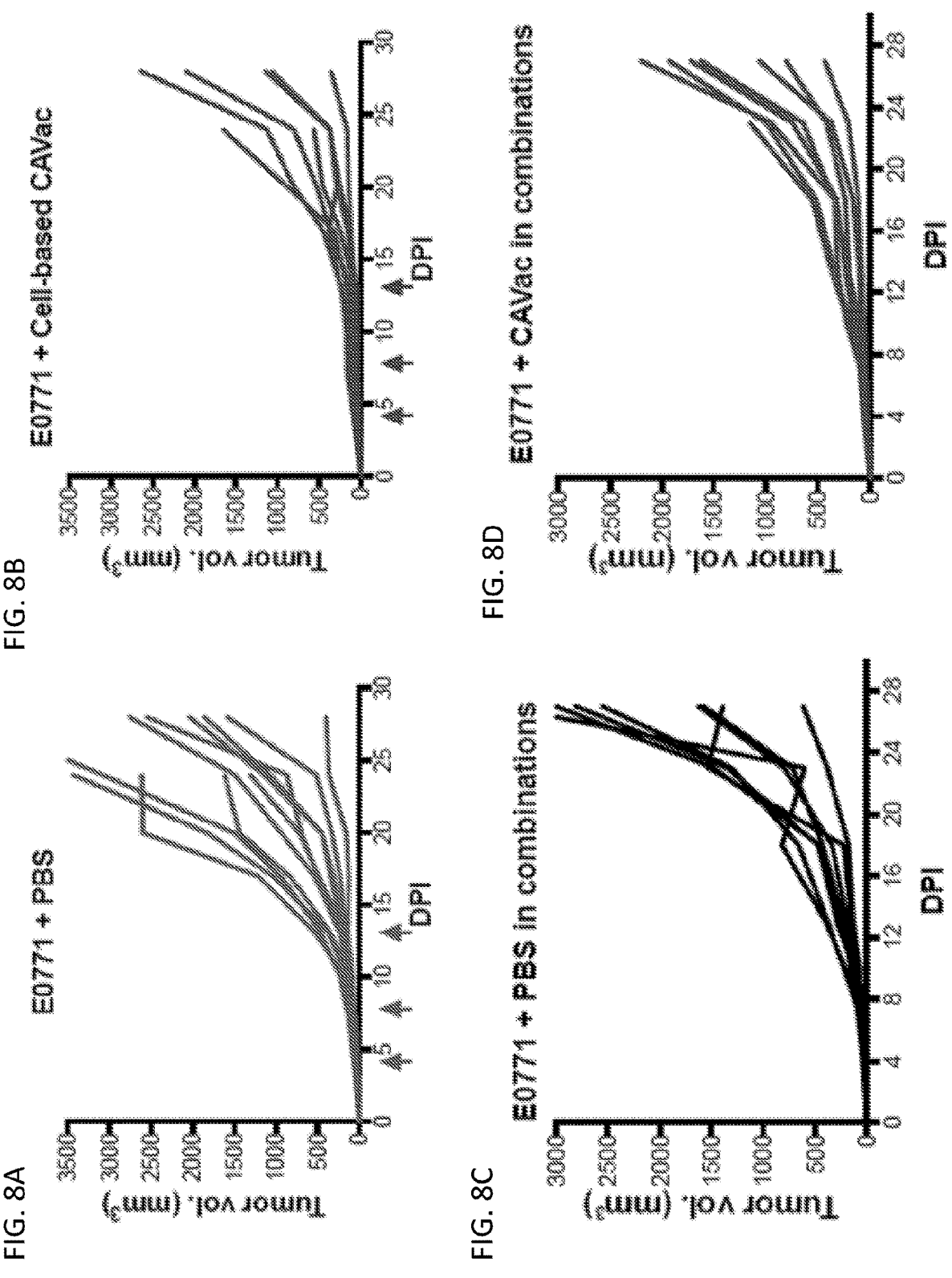
FIGS. 8A-8G illustrate additional spider plots of growth curves of cell-based CAVac and combinatorial treatments.
Figures 8E, 8F, 8G:
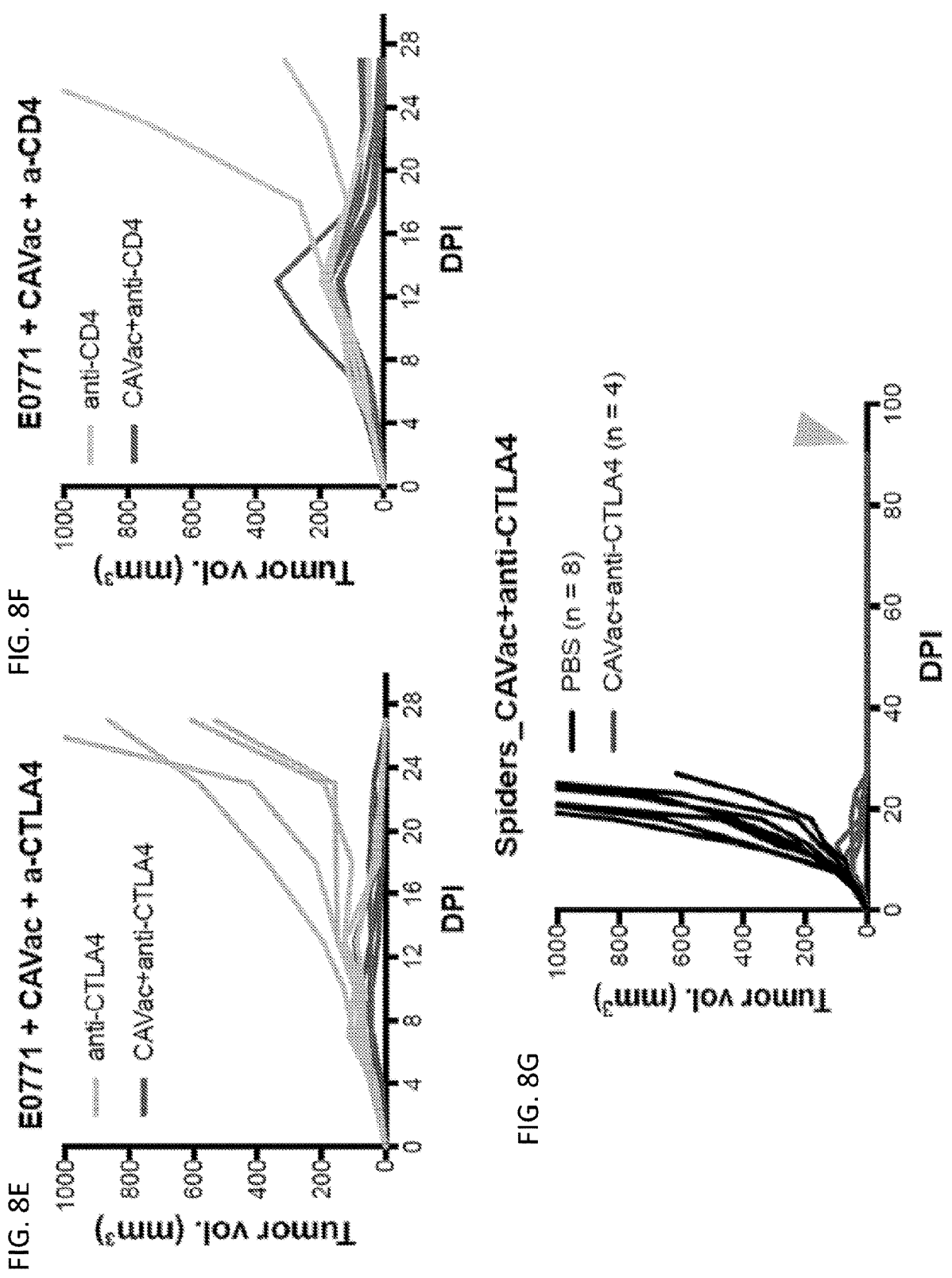
Figures 9A, 9B, 9C, 9D:
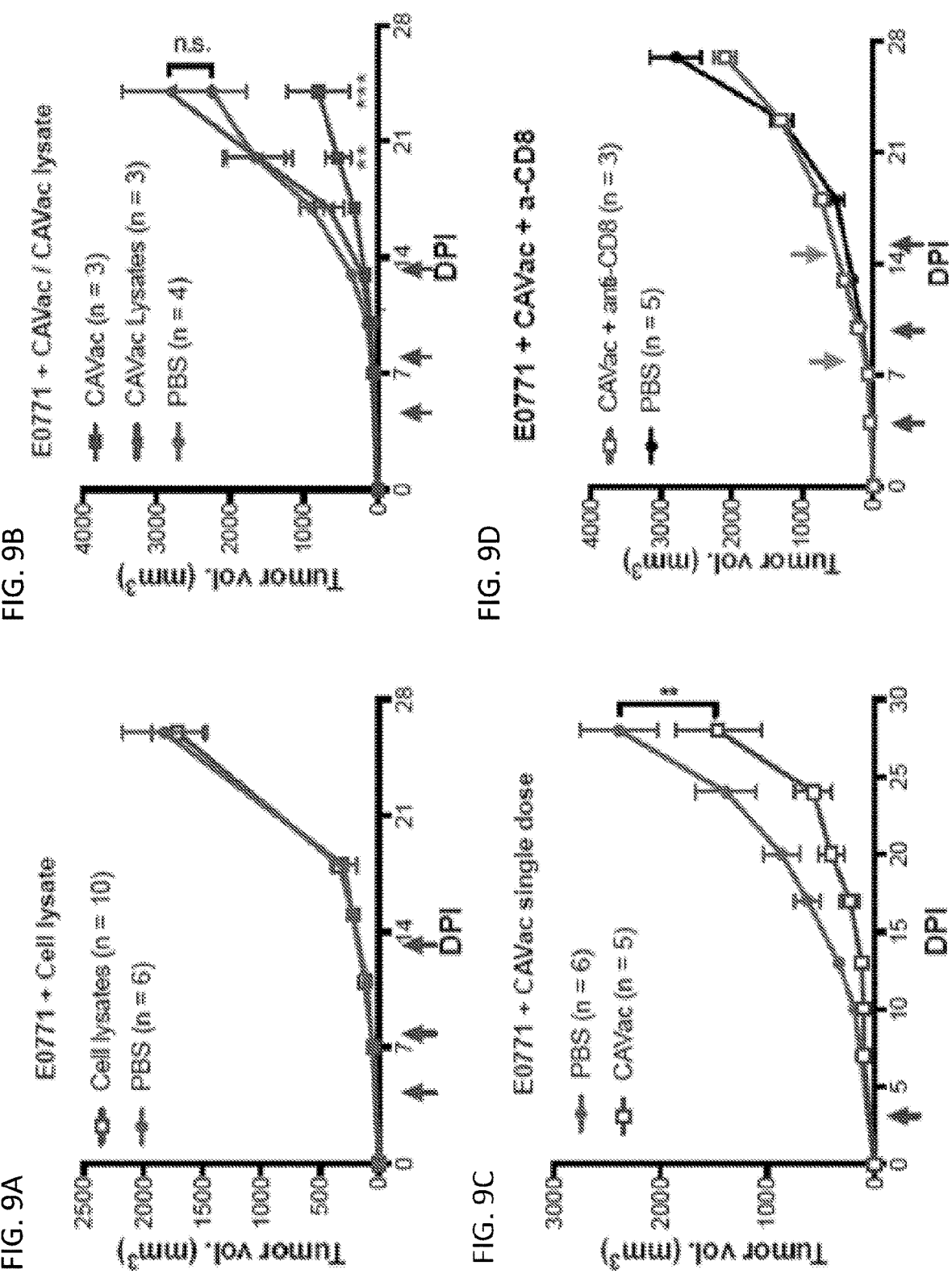
FIGS. 9A-9D illustrate results from additional testing of cell-based CAVac.

To test whether CAVac can be used in conjunction with other immunotherapy or immune modulation, CAVac treatment was tested in combination anti-CTLA4 (FIG. 1H). The combination of CAVac+anti-CTLA4 boosted the efficacy of both CAVac alone (p<1e-7) and anti-CTLA4 alone (p<1e-4) in the same E0771 TNBC syngeneic model, leading to complete regression of established tumors (FIGS. 1I-1J; FIGS. 8C-8E), without any relapse observed until day 90 as the experiment ended (FIG. 8G), suggesting long-term protective memory in these mice. The immunosuppressive microenvironment is known to be a major contributing factor for dampened anti-tumor immune responses and checkpoint blockade immunotherapies, where CD4[+] regulatory T lymphocytes often negatively regulate the cytotoxic effect of CD8[+] T cells in breast cancer. For this reason, it was tested whether depletion of CD4[+] T cells could influence the efficacy of CAVac. CD4[4] depletion using monoclonal anti-CD4 antibody significantly boosted the efficacy of CAVac (p<1e-4, FIGS. 1I-1K; FIGS. 8C-8D & 8F), where the combination of CAVac+anti-CD4 led to nearly complete regression of established tumors (FIG. 1K; FIG. 8F).

Figure 2A:
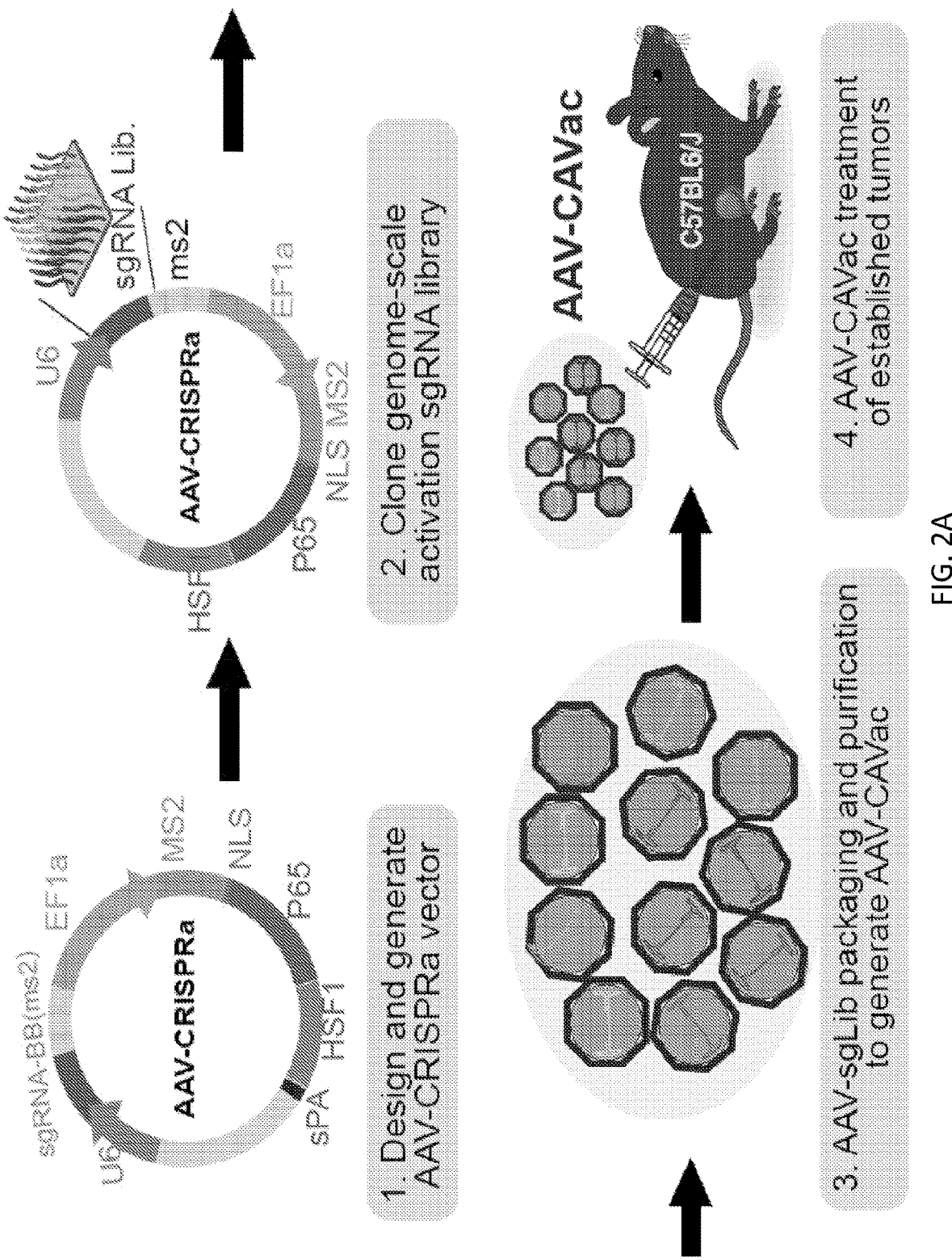
FIGS. 2A-2G illustrate AAV-carried CRISPR activation system (AAV-CAVac) as a therapeutic treatment agent against established tumors.
Figures 2B, 2C:
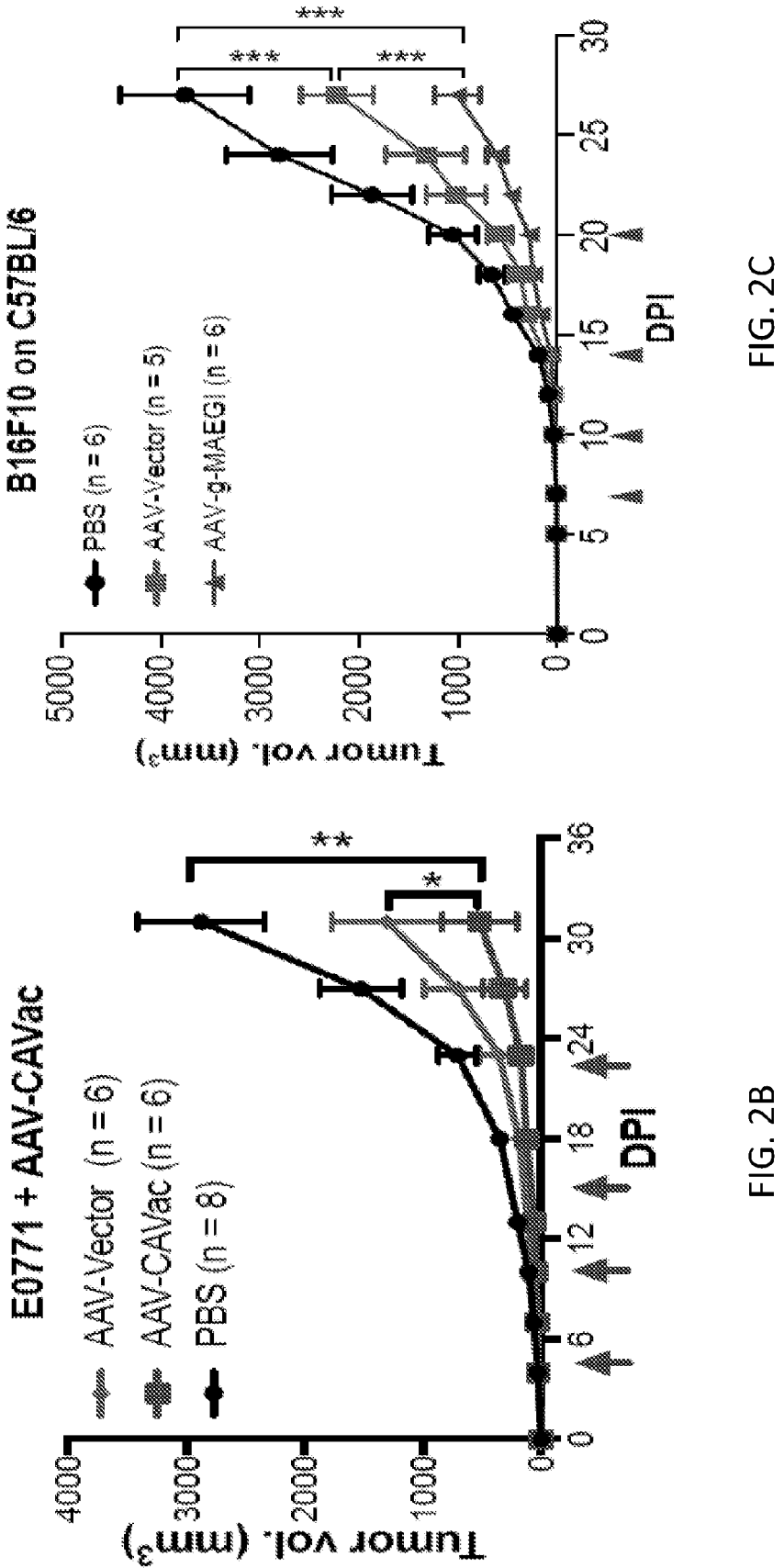
Figure 2D:
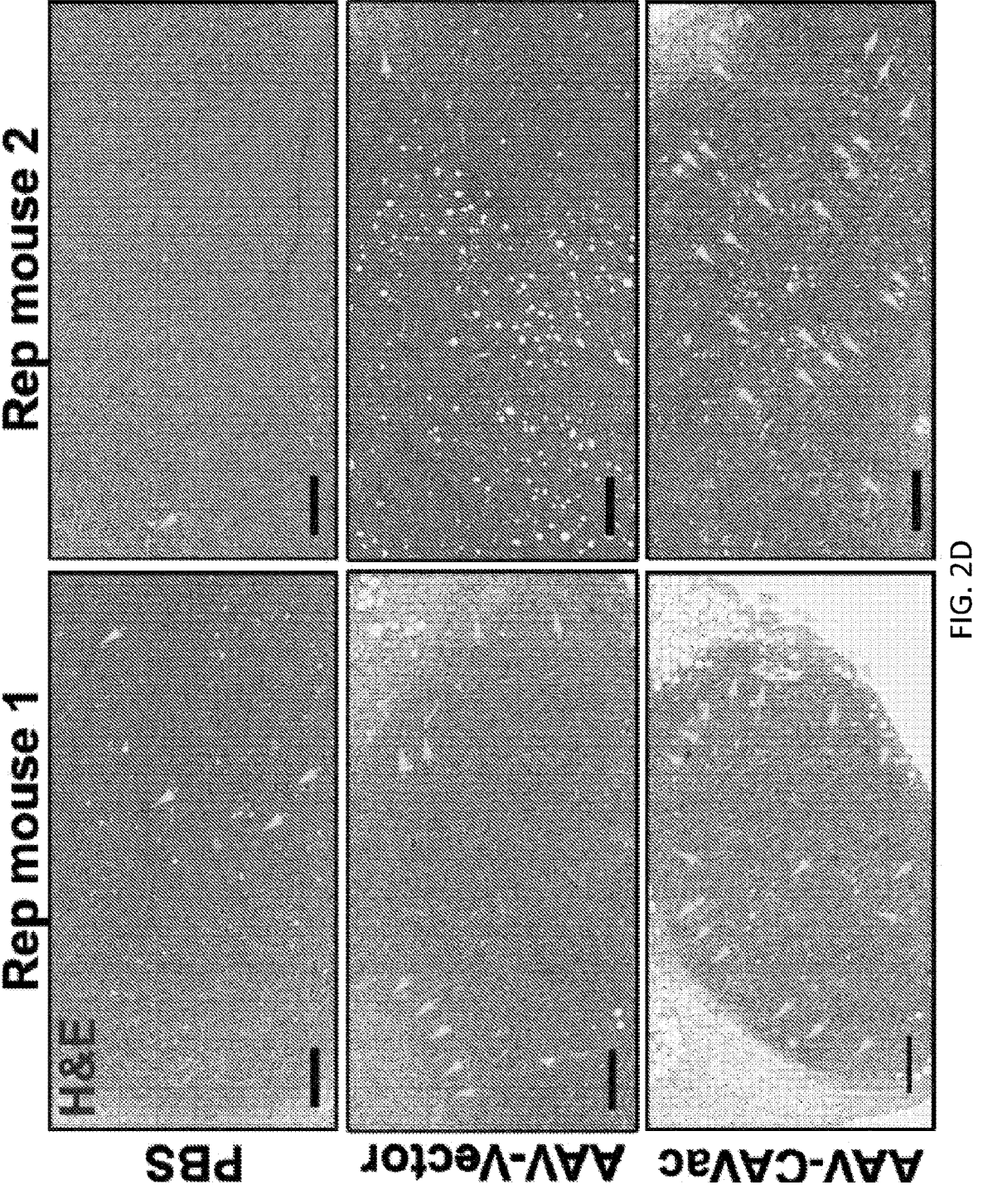
Figure 2E:
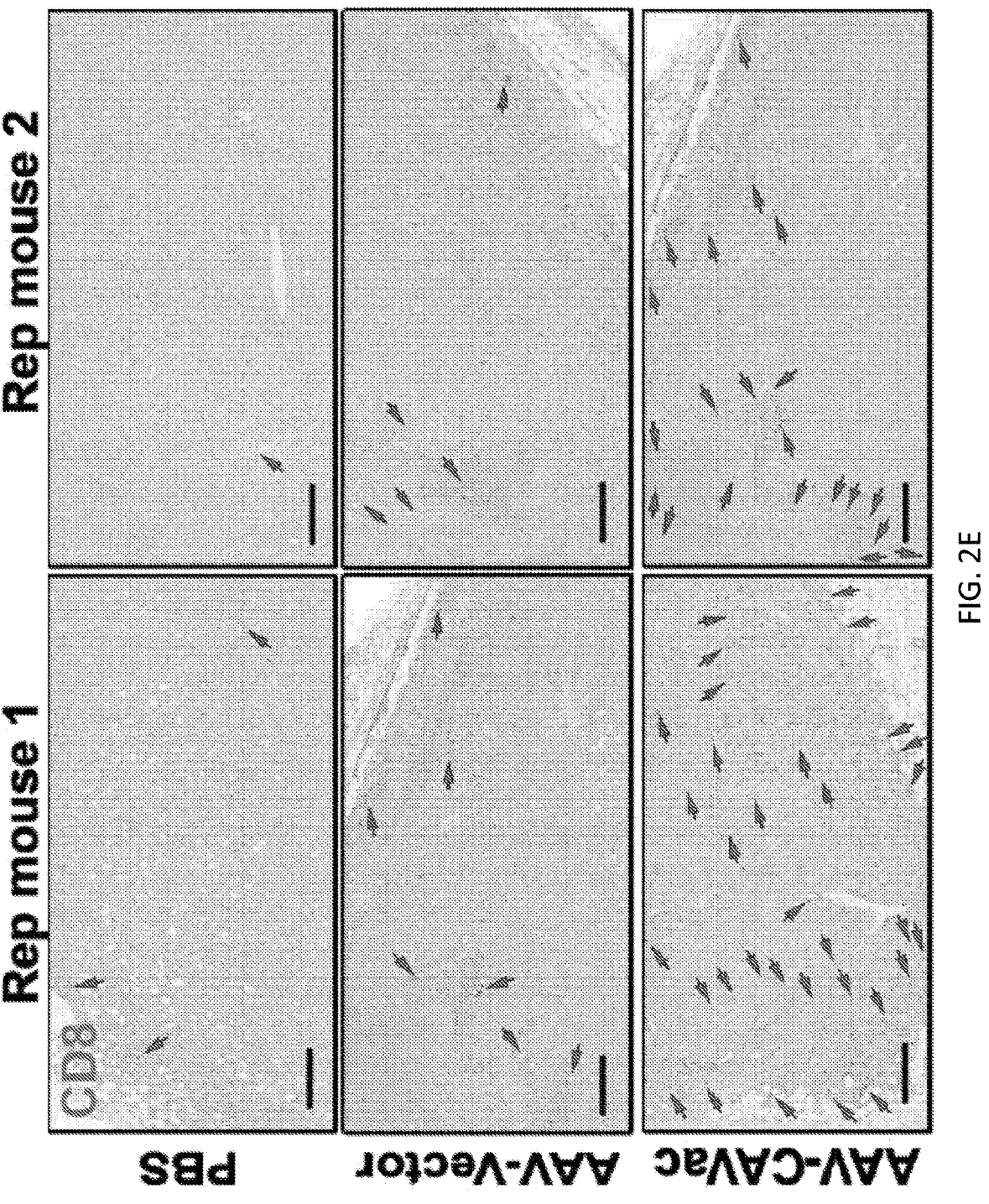
Figures 10B, 10C, 10D:
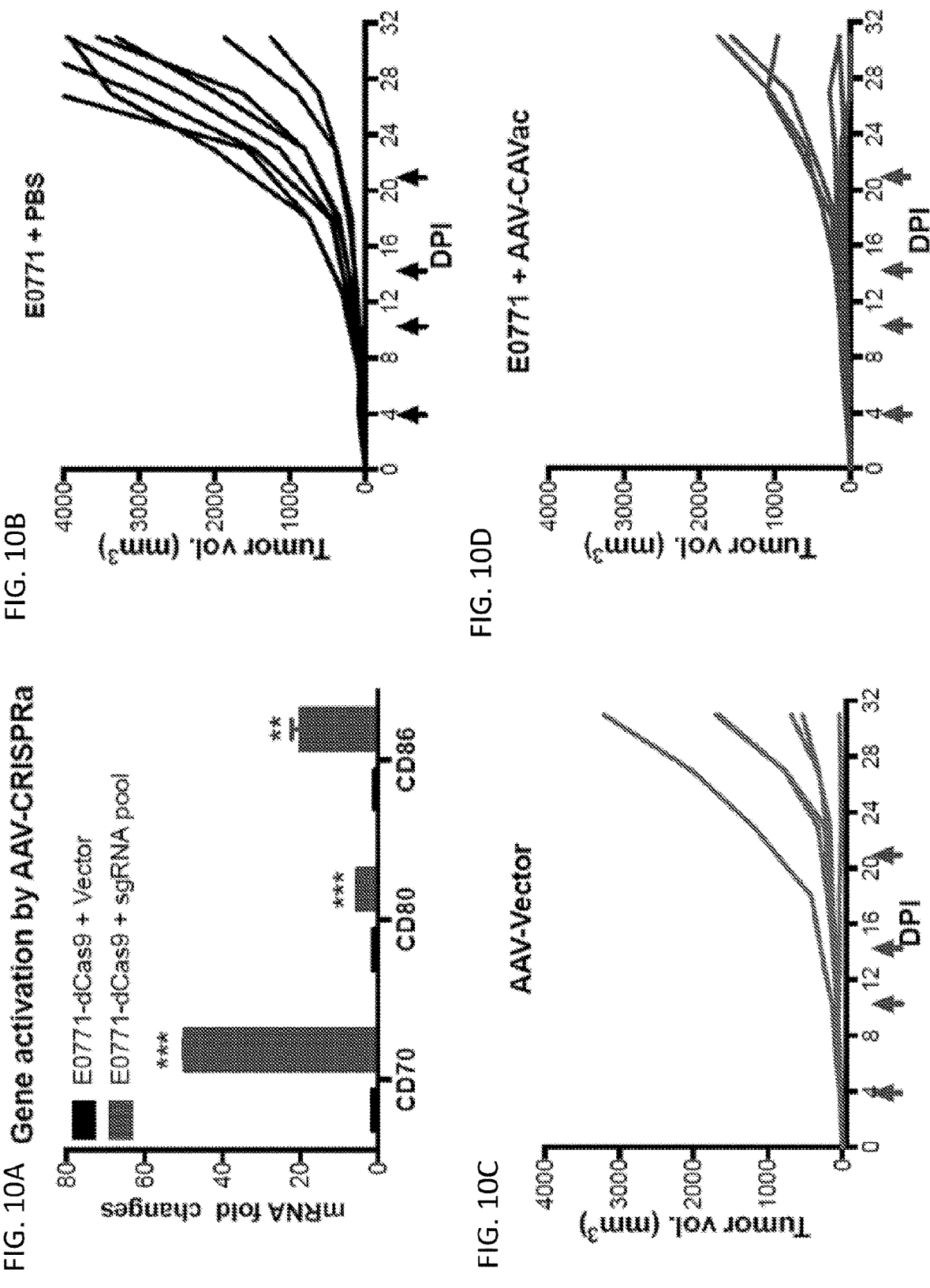

Example 3: Multiplexed In Situ Vaccination Using AAV-CAVac Against Established Tumors Because a live cell-based vaccine has clear limitations for clinical translation, a safer delivery vehicle to carry CAVac for direct in vivo tumor vaccination was investigated. Adeno-associated viruses (AAVs) are potent non-propagating viral vectors shown to mediate efficient transgene delivery into various organs in mouse models and humans. Because of these properties, AAVs have been commonly used in clinical trials for gene therapy, and recently received FDA approvals. To enable direct delivery of CAVac, an AAV version of CAVac (AAV-CAVac) was devised by generating an AAV-CRISPRa vector and cloning SAM modules as well as the genome-scale sgRNA library, then pool-packaging into AAV9 (FIG. 2A). The effectiveness of pool-packaged AAV-CRISPRa in activating endogenous genes was confirmed by infecting tumor cells with AAVs carrying a small pool of sgRNAs targeting genes including Cd70, Cd80, and CD86 (FIG. 10A). C57BL/6J mice bearing syngeneic orthotopic E0771 tumors were treated with this form of vaccine by intratumoral administration (FIG. 2A). A strong effect of AAV-CAVac alone against these tumors was observed, with a fraction of mice (3/9, 33%) exhibiting complete or near complete regression (FIG. 10D) compared to PBS (p=0.00014, FIG. 2B and FIGS. 10B-10D) and AAV-Vector (p=0.0078, FIG. 2B and FIGS. 10B-10D). Of note, AAV-vector treatment showed a moderate, yet statistically insignificant effect against tumor in the E0771 model, but significantly weaker than that of AAV-CAVac (p=0.26, FIG. 2B). To test the broader utility of AAV-CAV, similar treatment was performed on a syngeneic metastatic melanoma mouse model (B16F10), which again demonstrated significant efficacy (FIG. 2C, FIGS. 10C-10D). At the endpoint of the experiment, the histopathology of the tumors were analyzed. Large inflamed areas with CD8[+] lymphocytes and cancer cell death was observed in AAV-CAVac treated tumors, as compared to the rapid proliferation and rare CD8[+] lymphocyte infiltration in PBS or AAV-Vector treated tumors (FIGS. 2D-2E). Using ELISPOT, it was confirmed that AAV-CAVac elicited much stronger anti-tumor T cell response (in terms of IFNγ producing splenocytes) compared to PBS (p=0.0028, FIG. 2F-2G) and to AAV-Vector (p=0.005, FIGS. 2F-2G). No difference was observed in T cell IFNγ response between PBS and AAV-Vector (FIGS. 2F-2G), suggesting the moderate anti-tumor effect from AAV-Vector is unlikely to be mediated by T cells. Retrospective comparison showed that AAV-CAVac has a stronger efficacy as compared to cell-based CAVac (unpaired t test, two sided, p=0.016) in settings where PBS-treated tumors grew at similar dynamics (p=0.3). These data showed that In situ vaccination by AAV-mediated delivery of CAVac can augment specific host immune responses against established tumors.

Example 4: AAV-CAVac Remodels the Host Tumor Microenvironment

Figure 3A:
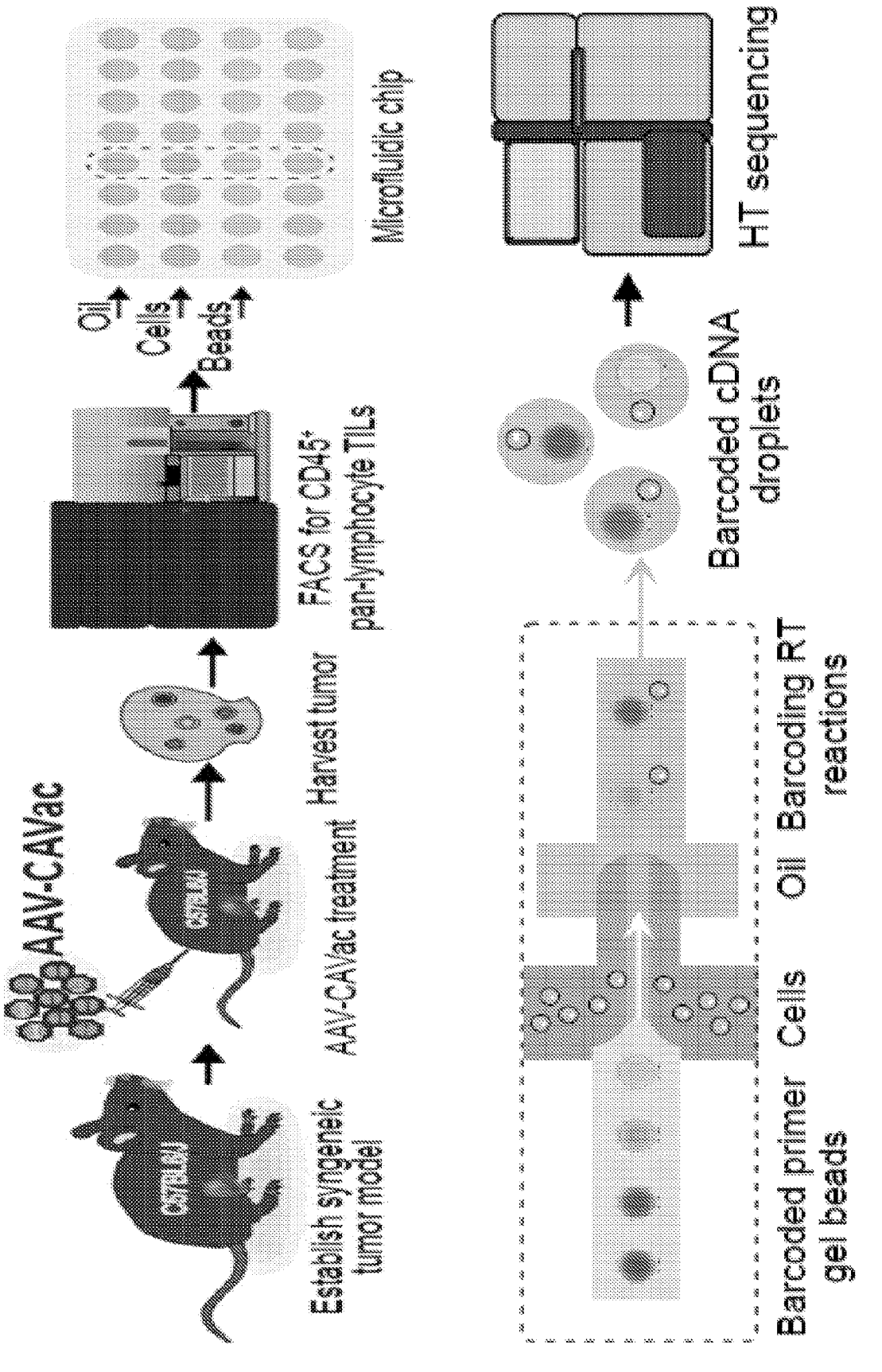
FIGS. 3A-3E illustrate results from interrogation of immune cell population, repertoire shift, and gene expression changes upon therapeutic CAVac treatment using single cell RNA-seq.
Figures 3B, 3C:
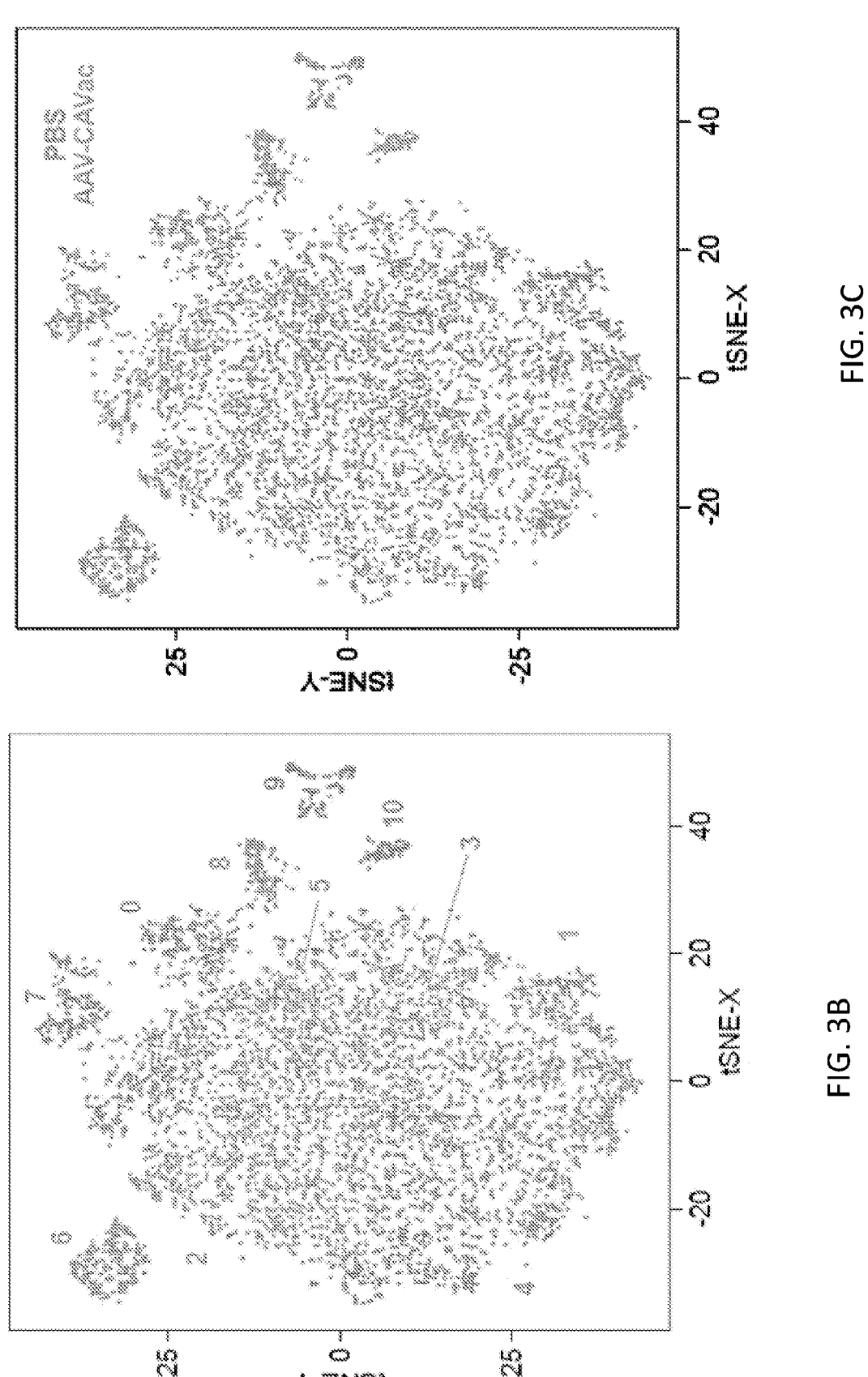
Figure 3D:
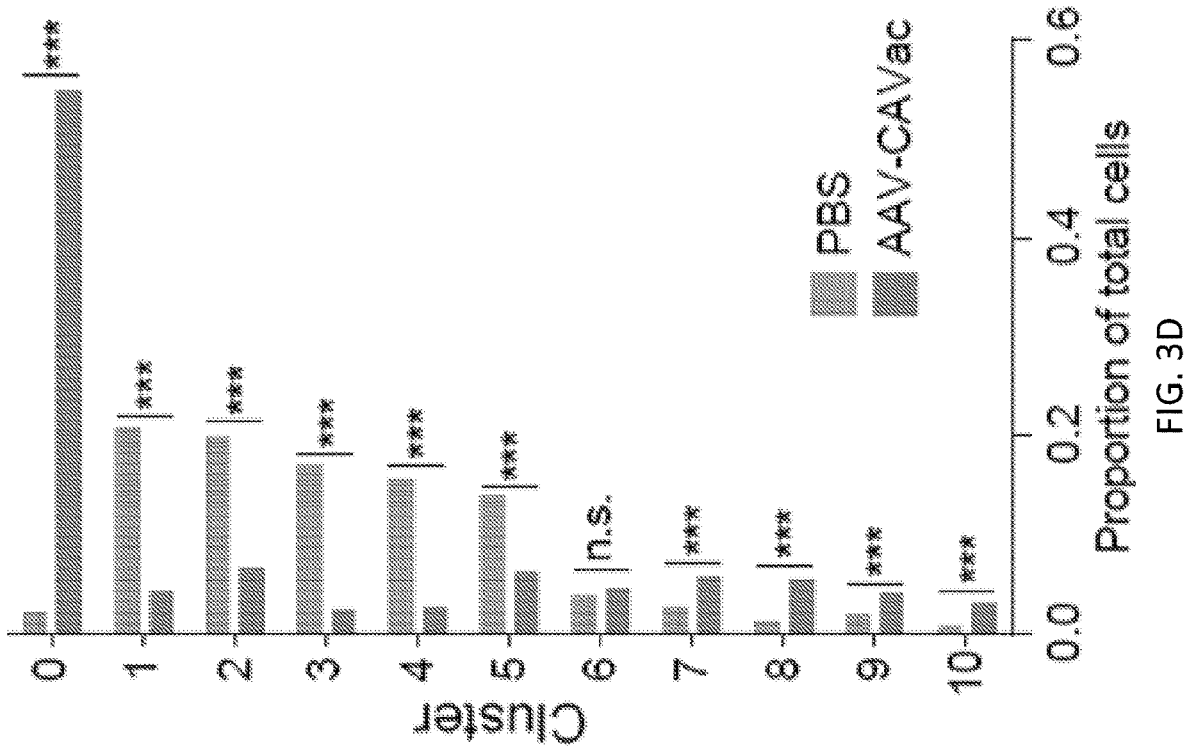
Figure 3E:
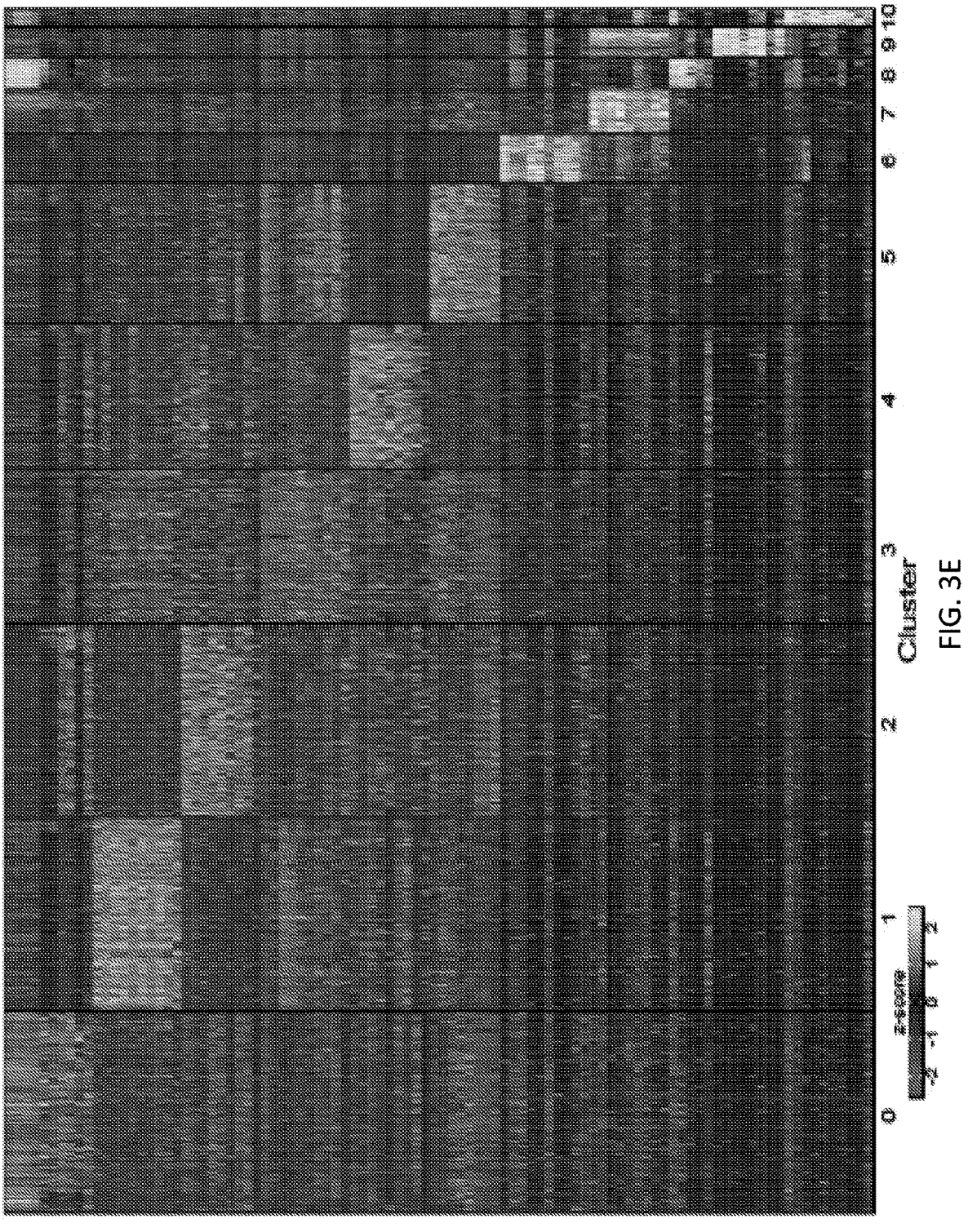

To investigate the effect of AAV-CAVac on the host tumor microenvironment, single cell RNA sequencing (scRNA-seq) was performed to simultaneously profile the whole population of tumor-infiltrating immune cells (THs) and their gene expression signatures (FIG. 3A). From single cell suspension of end-point tumors, total TIIs were isolated by fluorescence activated cell sorting (FACS) of CD45$^+$ immune cells, then a total of 2,075 CD45$^+$ cells from AAV-CAVac-treated mice, as well as 5,383 from PBS-treated mice were sequenced (FIGS. 3B-3C). Using clustering and dimensionality reduction, a total of 11 unique clusters of TIIs were identified from both AAV-CAVac and PBS group (FIGS. 3B-3C). Strikingly, most (10/11) of these clusters exhibit strong shifts in AAV-CAVac as compared to PBS (p<0.001, FIG. 3D). Cluster-specific expression analysis revealed the gene signatures specific to each cluster. Notably, the first cluster (cluster #0) was drastically increased in AAV-CAVac TH population as compared to PBS (54.75% vs. 2.23% of total cells, p<2.2*10$^{-16}$, FIG. 3D). This population possessed high levels of MHC class II transcripts (such as H2-Aa, H2-Ab1 and H2-Eb1), which is characteristic of antigen presenting cells (FIG. 3E). The second most abundant population (cluster #1) was reduced in AAV-CAVac TII population as compared to PBS (FIGS. 3D-3E). This population expressed genes associated innate immune cells such as the Ifit (Interferon induced proteins with tetratricopeptide repeats) gene family.

Figures 11A, 11B, 11C:
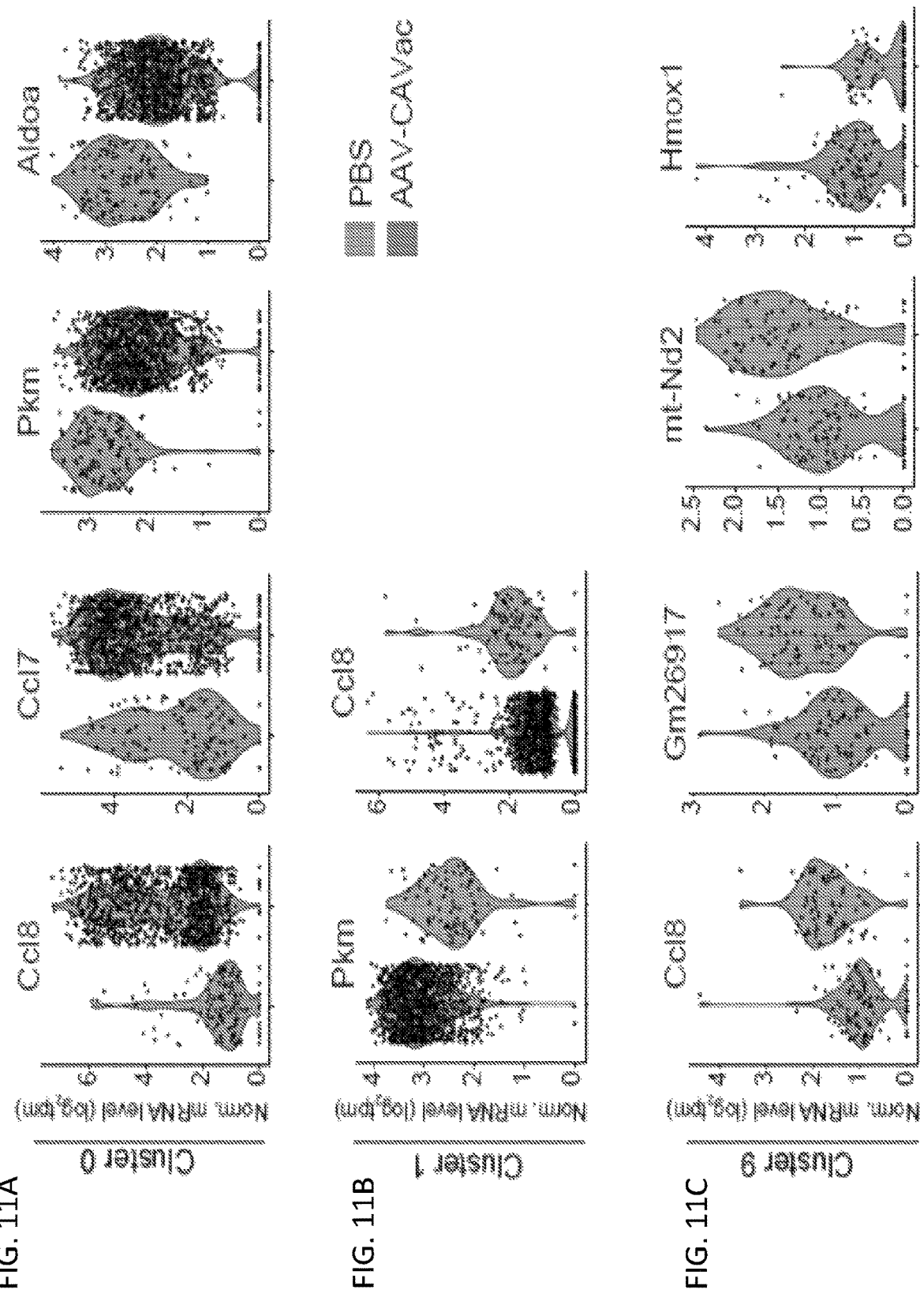
FIGS. 11A-11C are a series of Violin plots of representative cluster-specific differentially expressed genes in the scRNA-seq of TILs between AAV-CAVac and PBS treated mice.

Interestingly, cluster #9, bearing resemblance to T cells due to the highly differentiating expression of Cd3d, Cd3g and Gzmb (Granzyme B) transcripts (FIG. 3E), exhibited a significant proportional increase within the AAV-CAVac TII population (FIG. 3D). Differential expression analysis by cluster revealed significantly altered gene expression in each cell population. For example, Ccl7 and Ccl8 were significantly upregulated in cluster #0 of the AAV-CAVac TII population as compared to that of PBS, whereas Pkm and Aldoa were significantly downregulated (FIG. 11A). Tils in cluster #1 also showed upregulation of Ccl8 and downregulation of Pkm (FIG. 11B). The putative T cell cluster (#9) within the AAV-CAVac TII population showed elevated expression of genes such as Ccl8, mt-Nd2 (Mitochondrially Encoded NADH:Ubiquinone Oxidoreductase Core Subunit 2) and Gm26917 (an uncharacterized gene), and downregulated genes such as Hmox1 (Heme Oxygenase 1) (FIG. 11C).

Figure 12A:
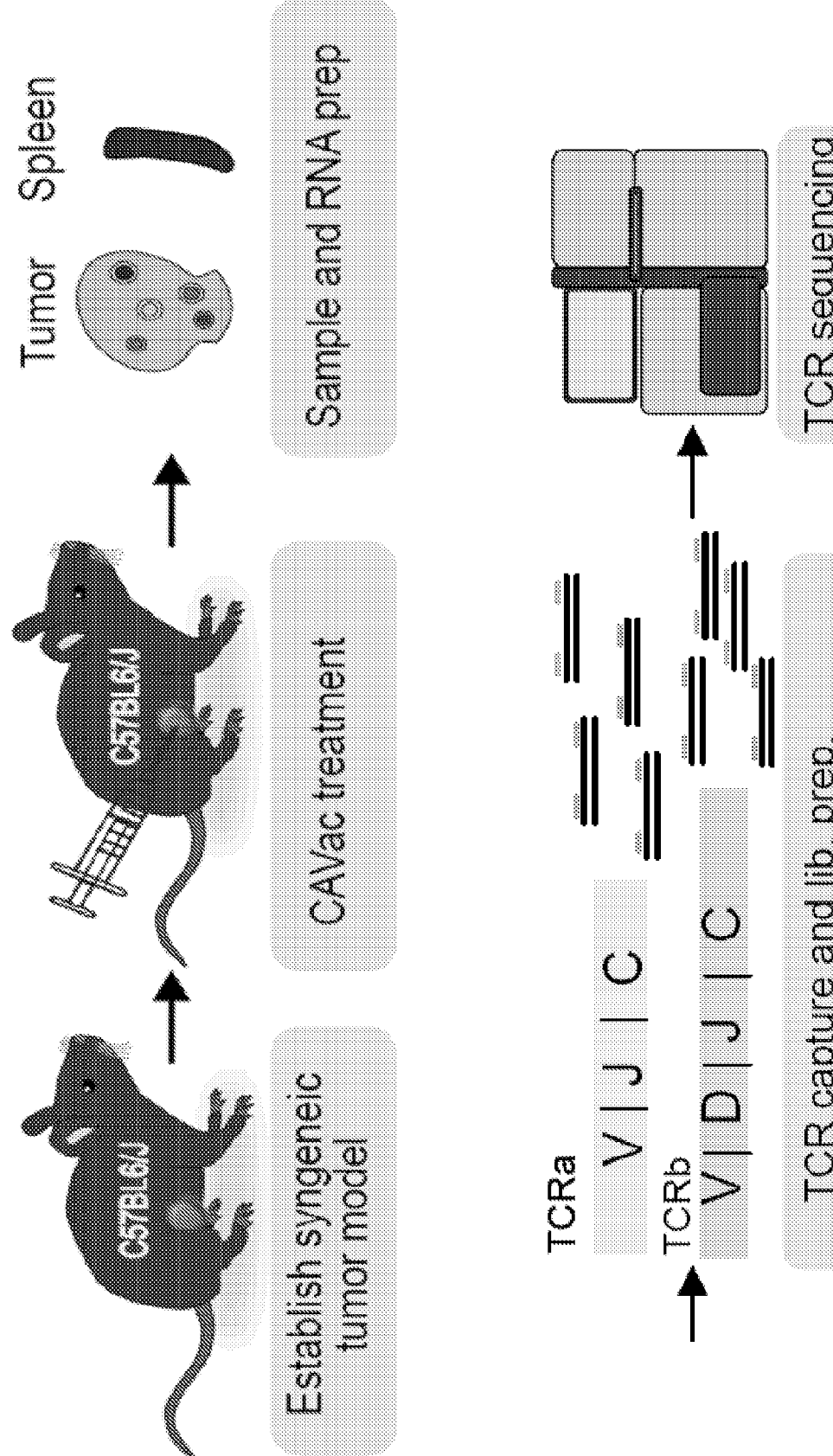
Figure 12B:
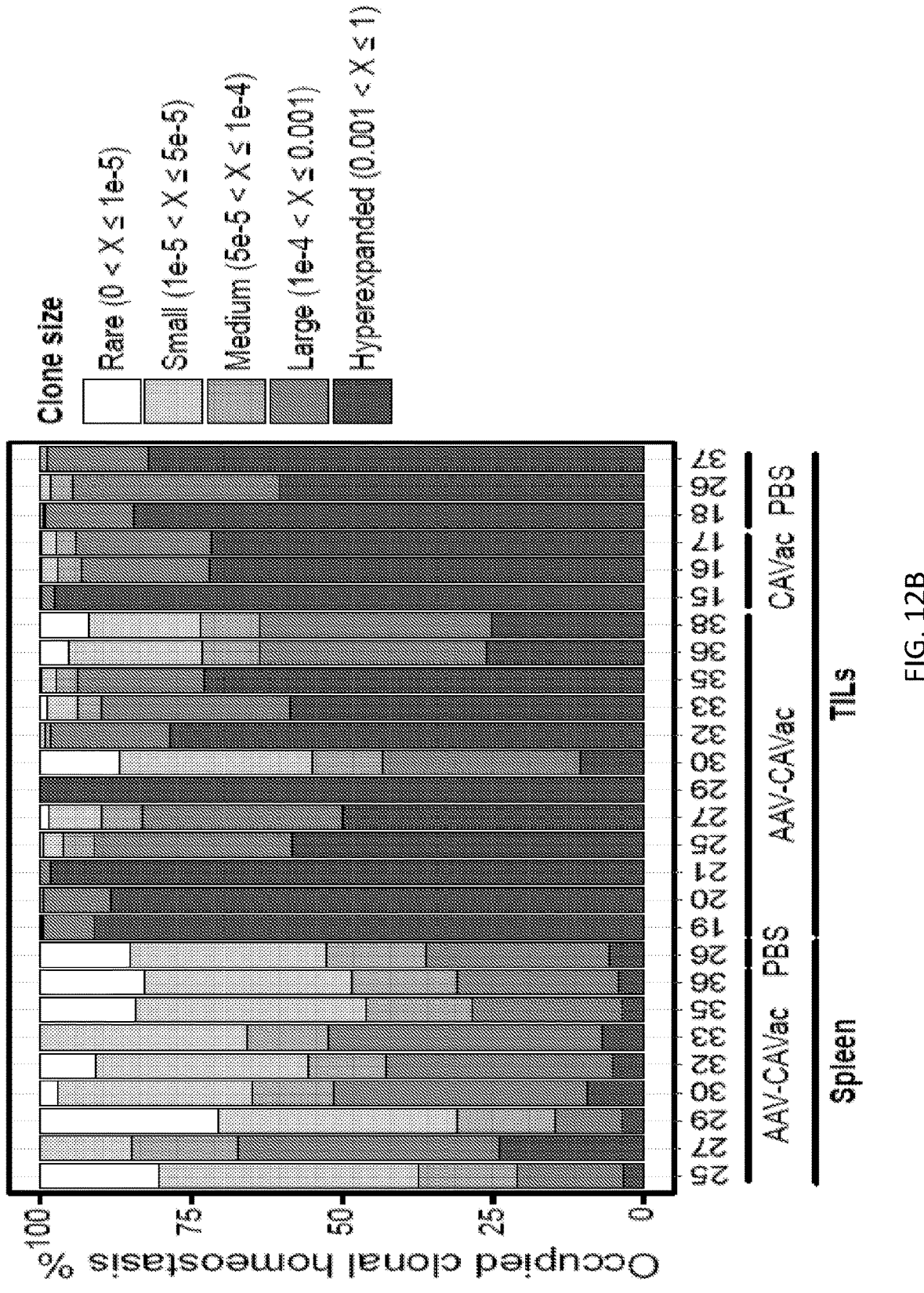
Figure 12C:
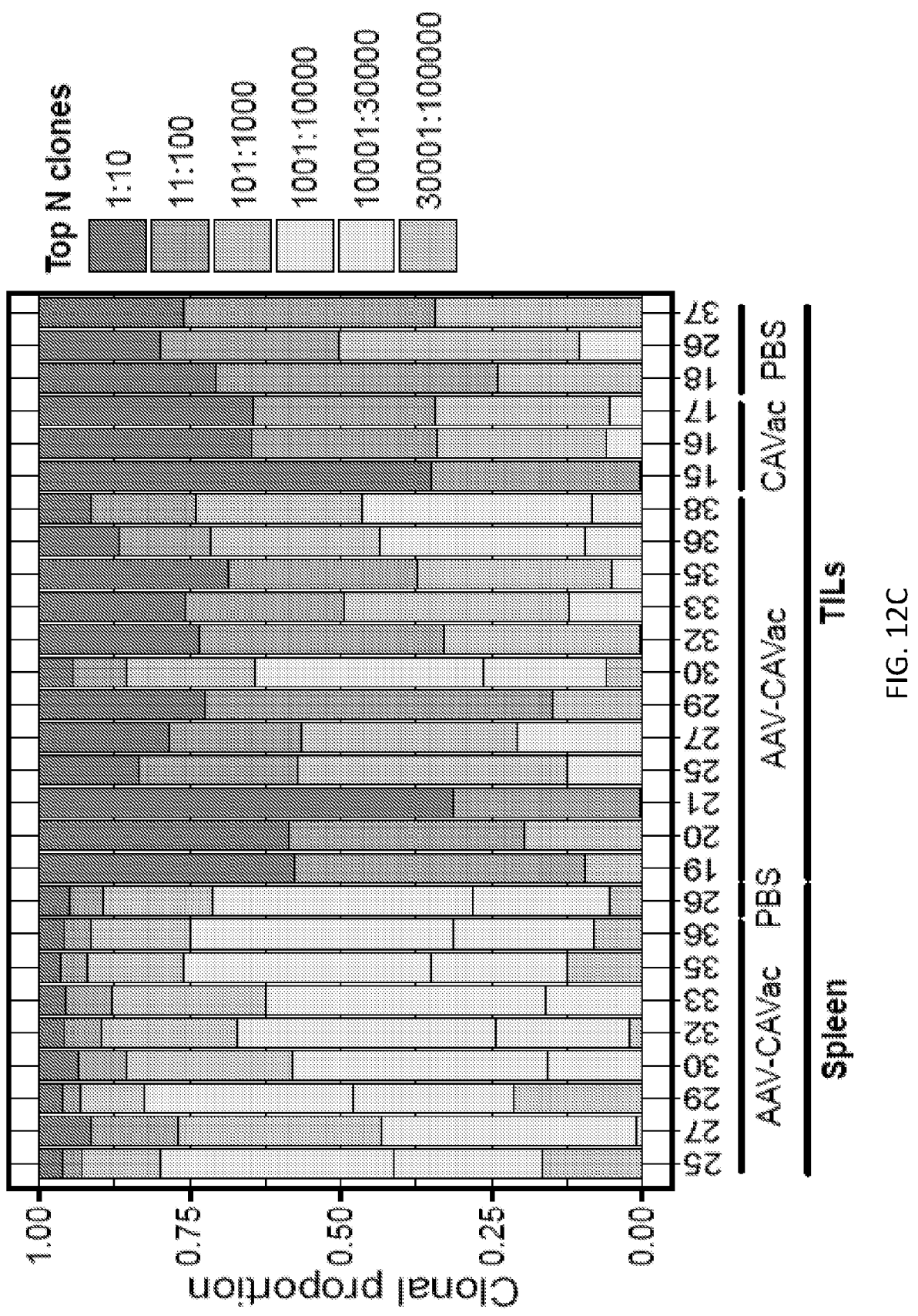
Figure 12D:
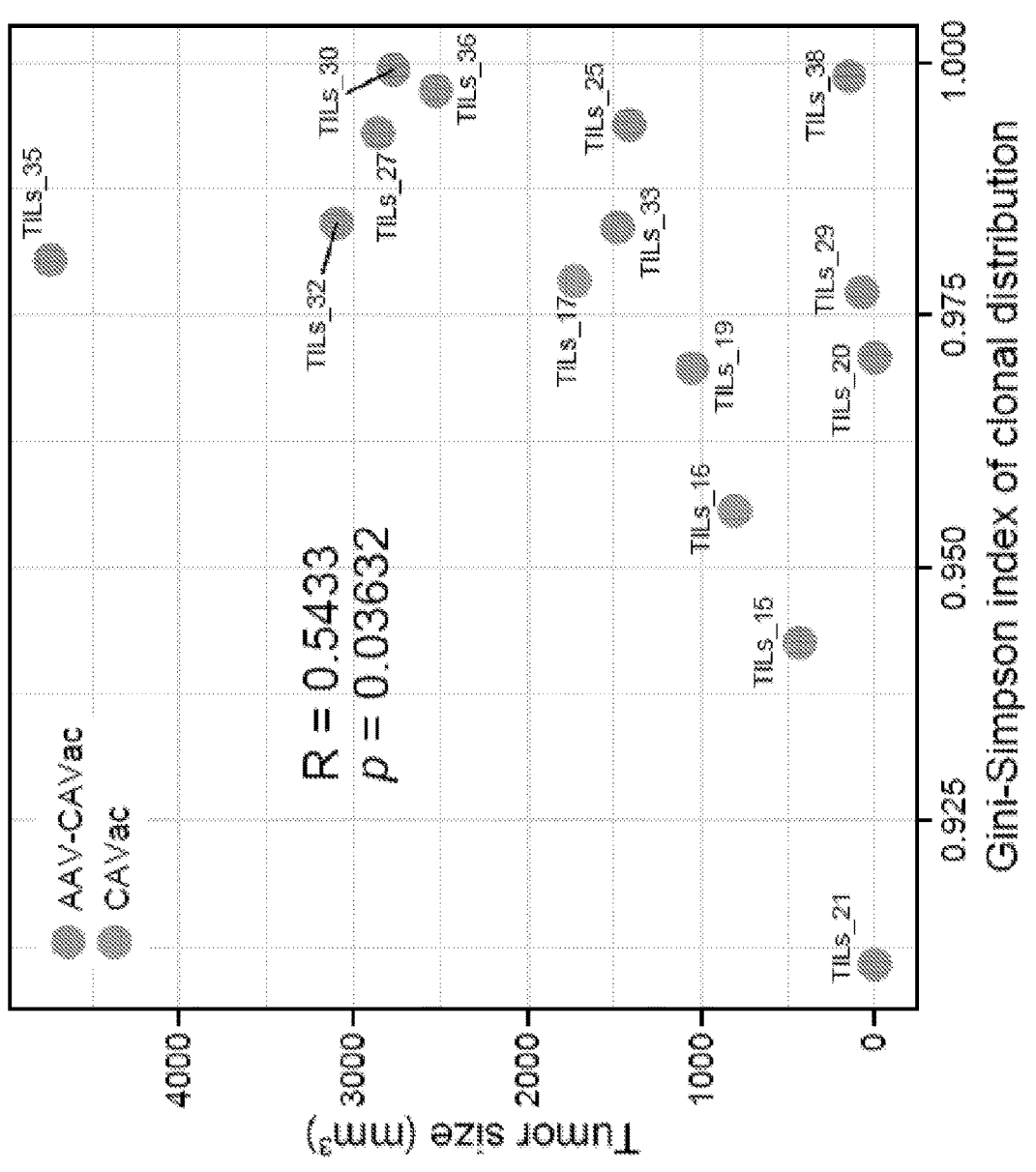

T cell receptor sequencing (TCR-seq) was performed to profile the TCR repertoire in CAVac vaccinated, AAV-CAVac vaccinated and unvaccinated mice (FIG. 12A). While the spleens preserved a highly diverse TCR repertoire, clonal expansion of a subset of clones in tumor infiltrating lymphocytes (TILs) was observed (FIGS. 12B-12C). Interestingly, across all vaccinated animals, the Gini-Simpson index of clonal distribution significantly decreased as the tumor size decreased, where a smaller Gini-Simpson index denotes greater skewness in clone size distribution (R=0.54, p=0.036, FIG. 12D). This finding implied that enhanced anti-tumor activity is associated with more potent selection in vivo. Examination of the complementarity-determination region 3 (CDR3) peptide sequences of the TILs revealed the most dominant clones in CAVac and AAV-CAVac vaccinated tumors, in which some clones can reach ultra-high frequencies of up to 20.7% (FIG. 12E). These observations together revealed that vaccination by AAV-CAVac significantly altered the host tumor microenvironment.

Example 5: Pool-Activation of Mutated Genes as Proof-of-Concept Multiplexed Precision Vaccination As each individual tumor has its unique profile of mutations, the AAV-CAVac system was also capable of activating a customized set of mutated endogenous genes, with the adaptation of a precise targeted library design (Precision AAV-CAVac, or AAV-PCAVac) (FIG. 4A). Customizing the AAV library for endogenous gene activation both enriched for potentially antigenic mutants and selectively excluded genes that potentially caused adverse effects. Whole-exome sequencing of the E0771 cancer cells was performed and all SNPs, insertions and deletions (indels) were called in all annotated genes, by comparison to healthy mammary fat pad from wildtype C57BL/6J mice (FIG. 4A). The whole E0771-specific mutation profile was revealed (FIGS. 4B-4C). These data were fed into CRISPRa sgRNA library design, generating a library of 3,839 activating sgRNAs (SEQ ID NOs: 349-4,187) targeting 1,116 E0771-mutated genes (FIGS. 4A & 4C). The library was synthesized and pool-cloned, generating an E0771-specific precision vaccine (E0771 AAV-PCAVac) (FIG. 4A). C57BL/6J mice bearing E0771 syngeneic orthotopic TNBC were treated with the AAV-PCAVac and strong efficacy was observed (p<1e-7, FIGS. 4D-4G). Of note, there was a moderate yet statistically insignificant effect in AAV-vector treated group (p=0.25, FIG. 4E). In sharp contrast, all AAV-PCAVac treated tumors either fully regressed, decrease in size towards zero, or remained as small nodules within three weeks after treatment, as compared to large and rapidly growing tumors in all mice in the PBS treated group and most mice in the AAV-Vector group (FIGS. 4D-4F). The therapeutic benefit of AAV-PCAVac persists in the mice that underwent complete regression, as no sign of relapse was detected in longer-term observations (FIG. 4F).

Figure 4G:
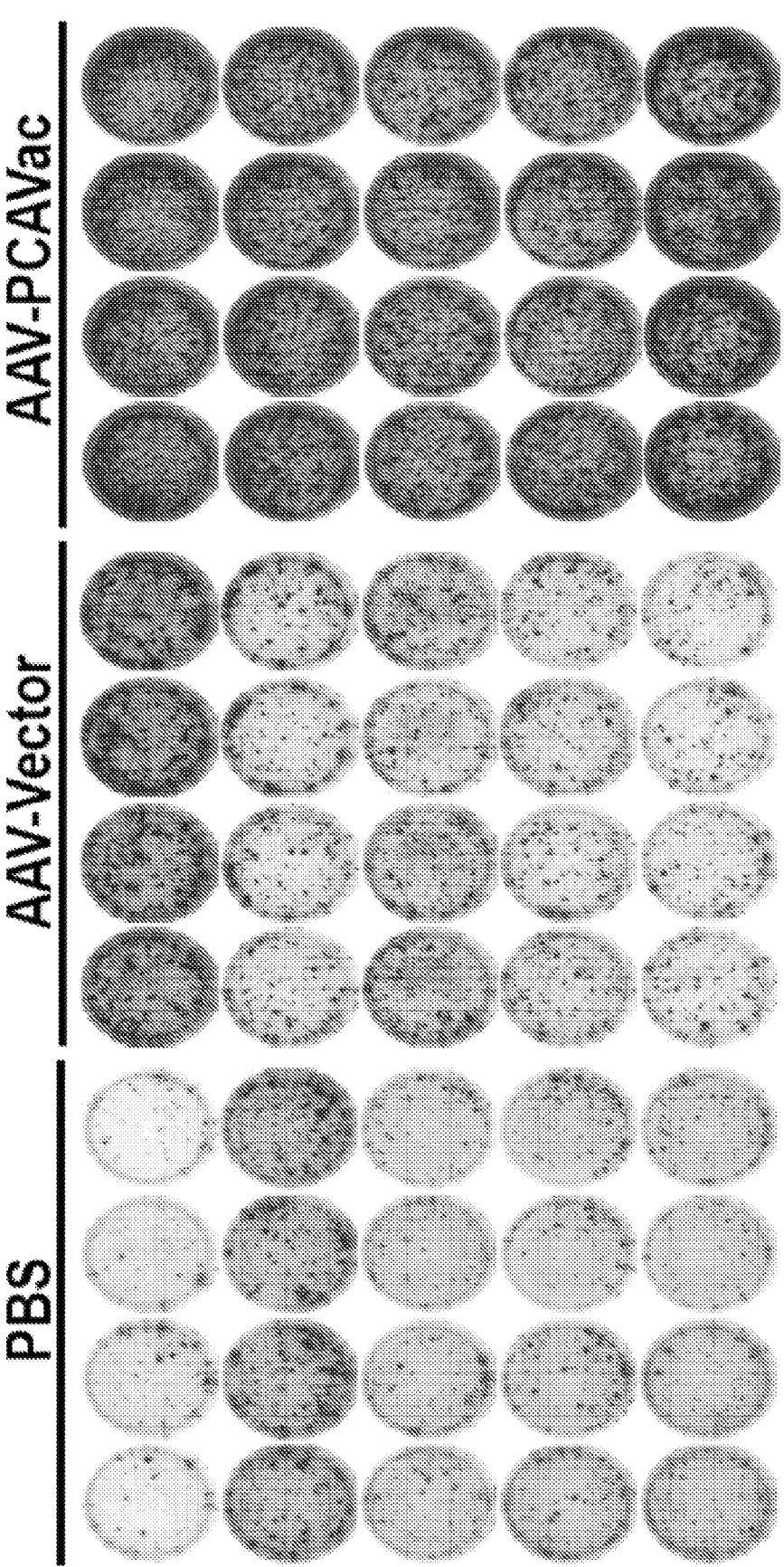
FIG. 4G shows representative pictures of spots obtained from quadruple per mouse with five mice for each treatment group (PBS, AAV-Vector, and AAV-CAVac).
Figure 4H:
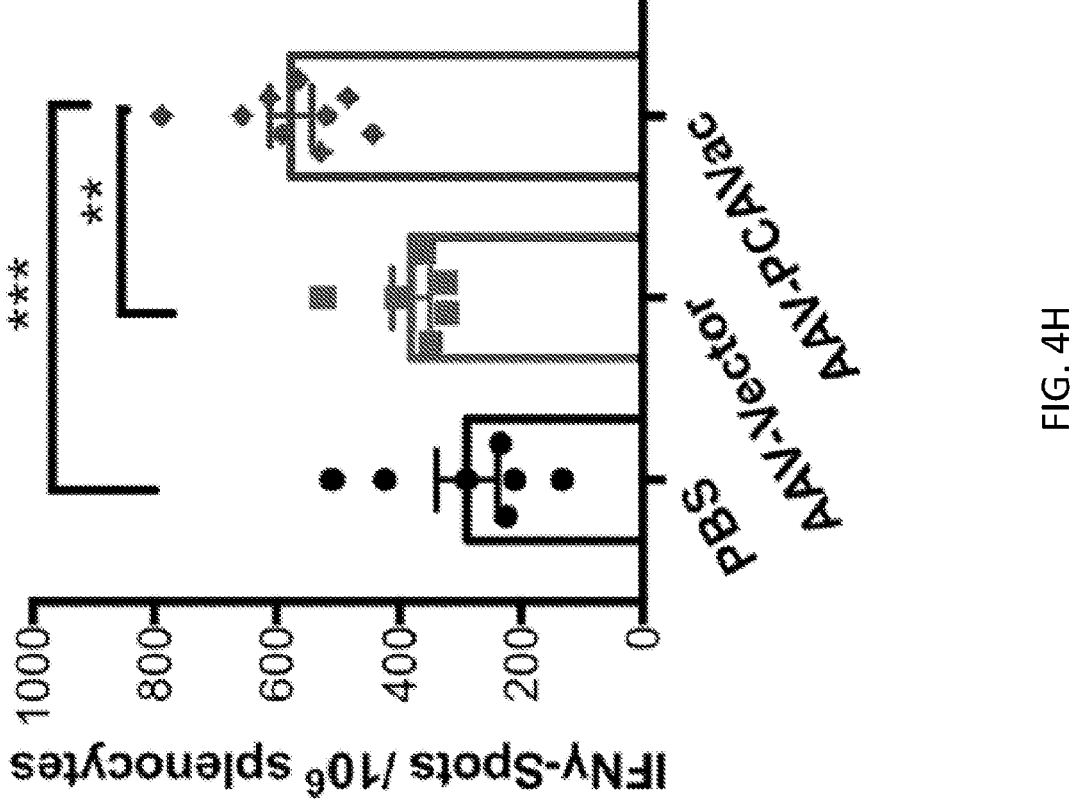
FIG. 4H shows quantification of ELISPOT experiments of PBS (n=7), AAV-Vector (n=6) and AAV-CAVac (n=9). Two sided Mann-Whitney test for AAV-CAVac vs. PBS, p=0.002; AAV-CAVac vs. AAV-Vector, p=0.002. Results were shown from the combination of 2 independent experiments. Error bars: All data points in this figure were presented as mean s.e.m. Asterisks: * p<0.05,  p<0.01, * p<0.001.
Figure 4I:
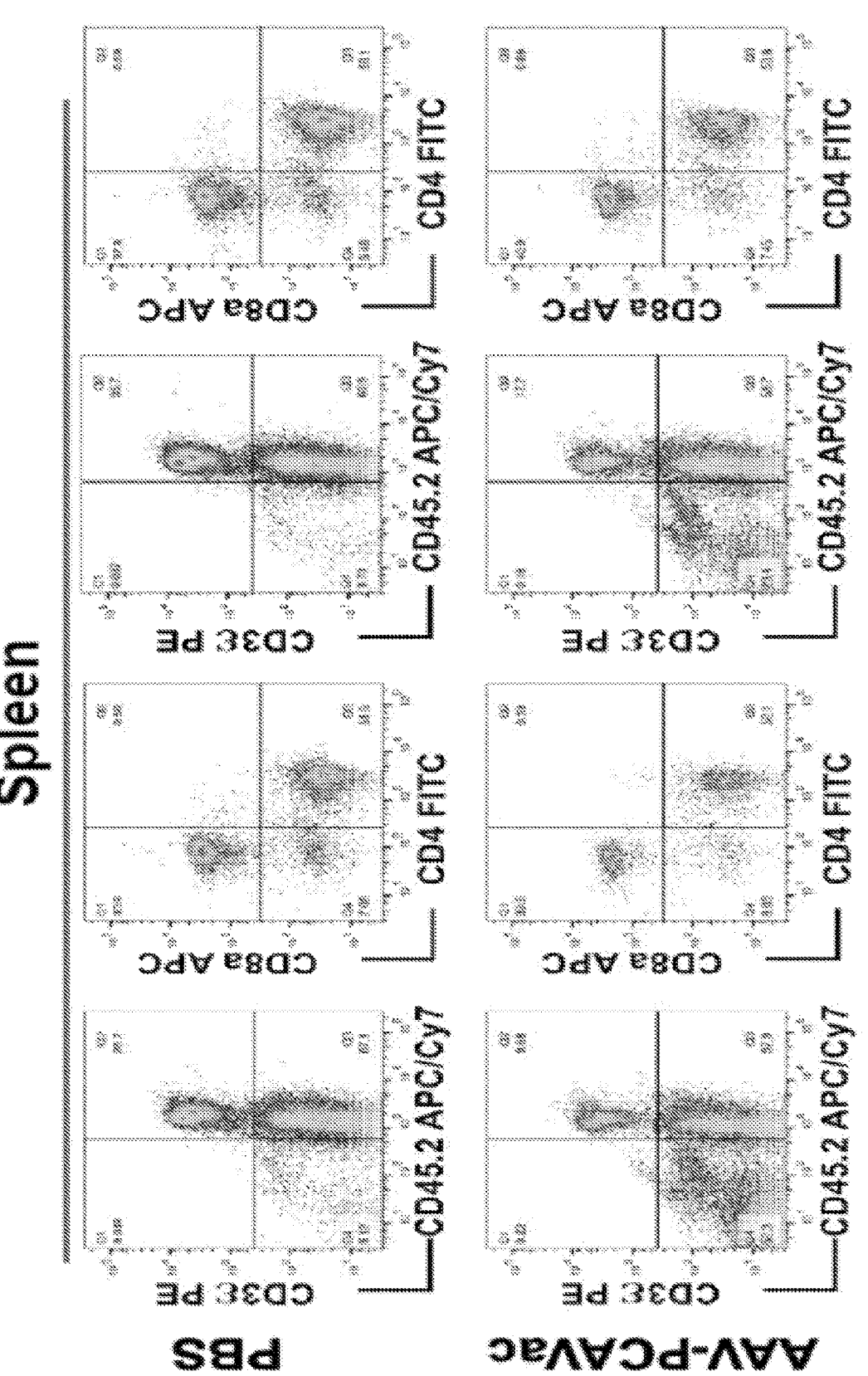
FIG. 4I shows representative flow cytometry plots and gating of $CD45^+$, $CD3^+$, $CD4^+$, and $CD8^+$ T cell populations in the spleens (splenocytes) from tumor-bearing mice treated with PBS or AAV-PCAVac.
Figure 4J:
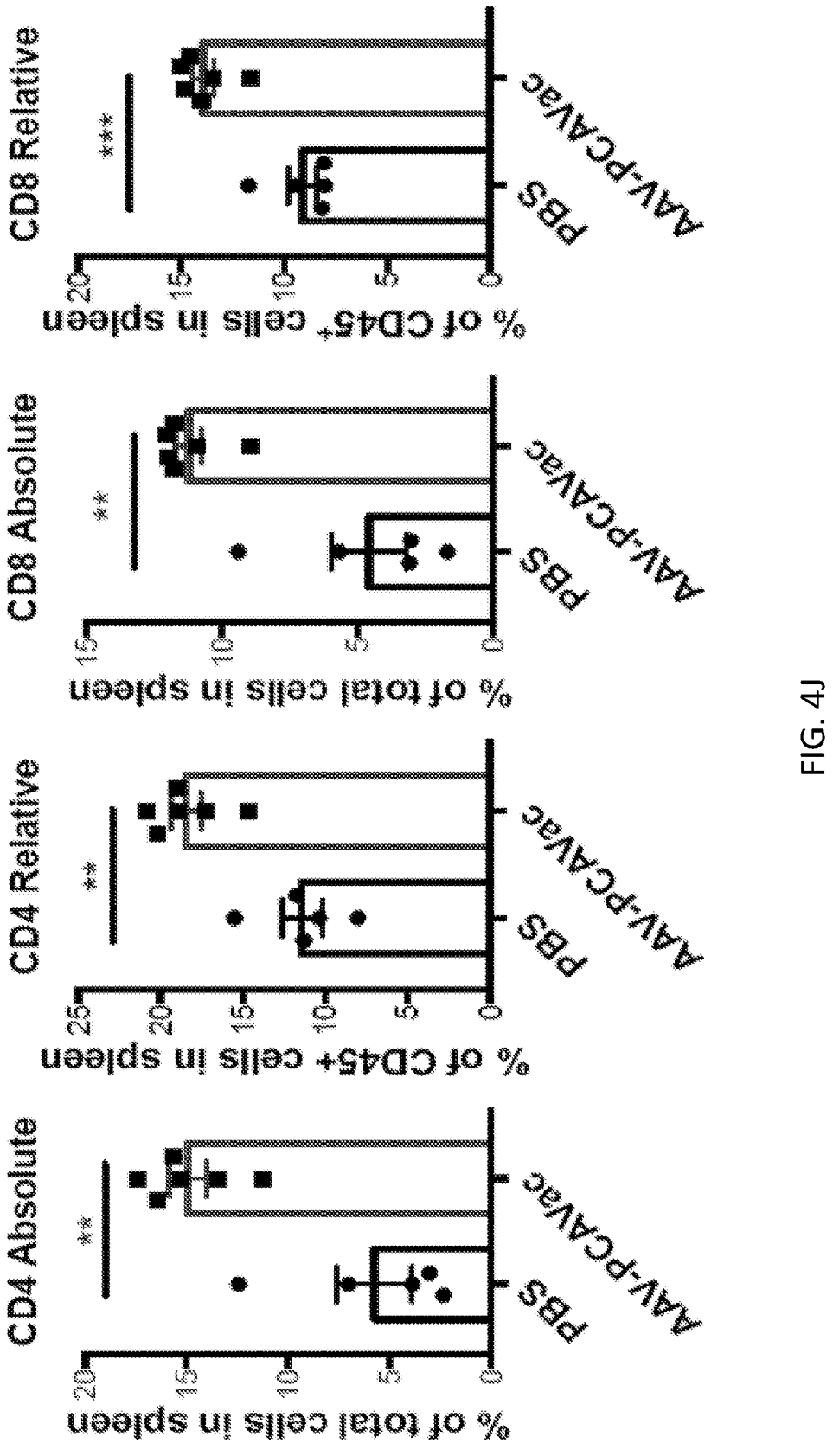
FIG. 4J shows quantification of $CD4^+$ and $CD8^+$ T cell populations from splenocytes of tumor-bearing mice treated with PBS or AAV-PCAVac. From left to right, bar-dot plots with two-sided unpaired t test for the following comparisons: Fraction of $CD4^+$ T cells in all cells in spleen (absolute fraction); AAV-PCAVac vs. PBS, p=0.0046. Fraction of $CD4^+$ T cells in all $CD45^+$ immune cells in spleen (relative fraction); AAV-PCAVac vs. PBS, p=0.0017. Fraction of $CD8^+$ T cells in all cells in spleen (absolute fraction); AAV-PCAVac vs. PBS, p=0.0059. Fraction of $CD8^+$ T cells in all $CD45^+$ immune cells in spleen (relative fraction); AAV-PCAVac vs. PBS, p=0.0007.
Figure 4K:
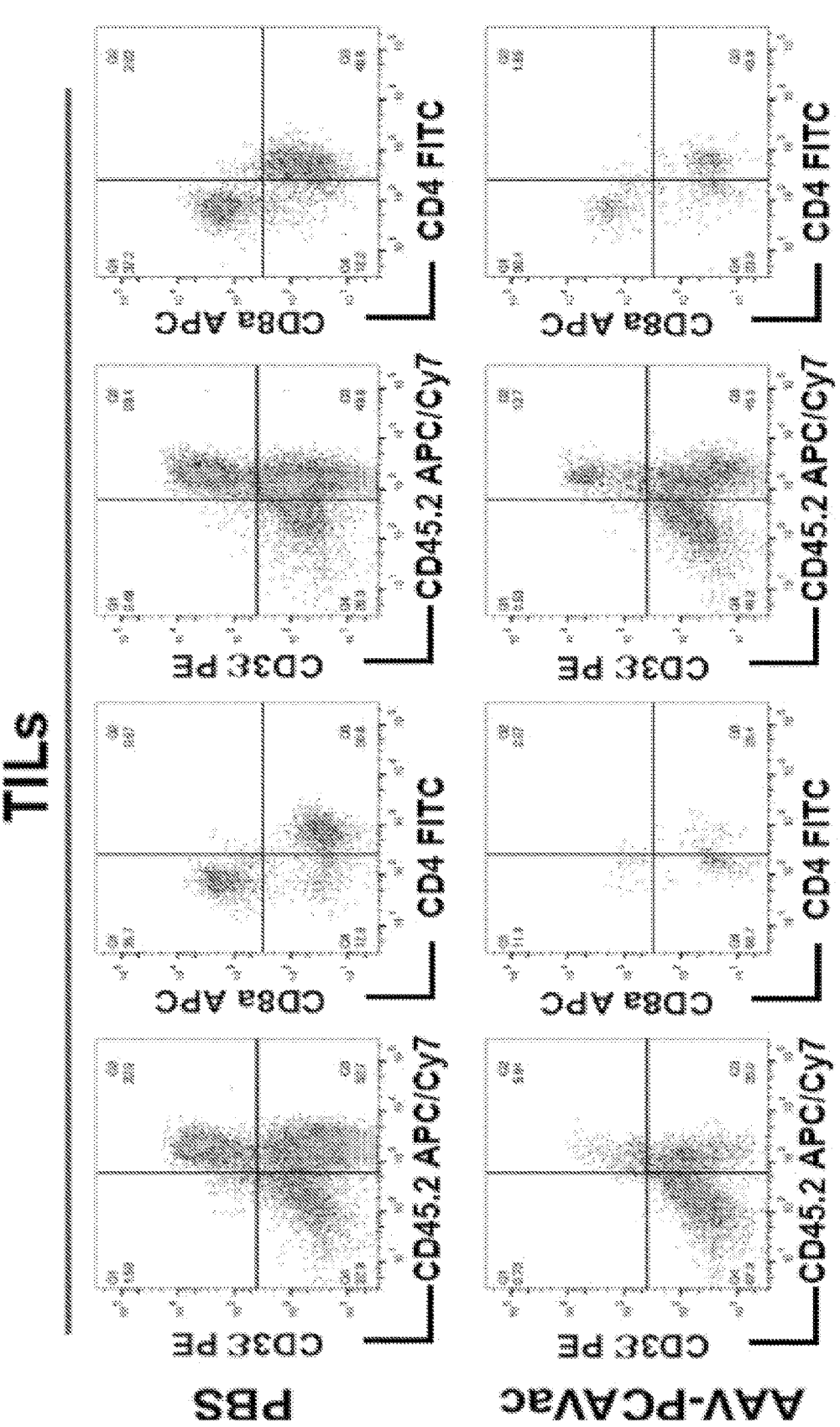
FIG. 4K shows representative flow cytometry plots and gating of $CD45^+$, $CD3^+$, $CD4^+$, and $CD8^+$ T cell populations in the tumor (TILs) from tumor-bearing mice treated with PBS or AAV-PCAVac.
Figure 4L:
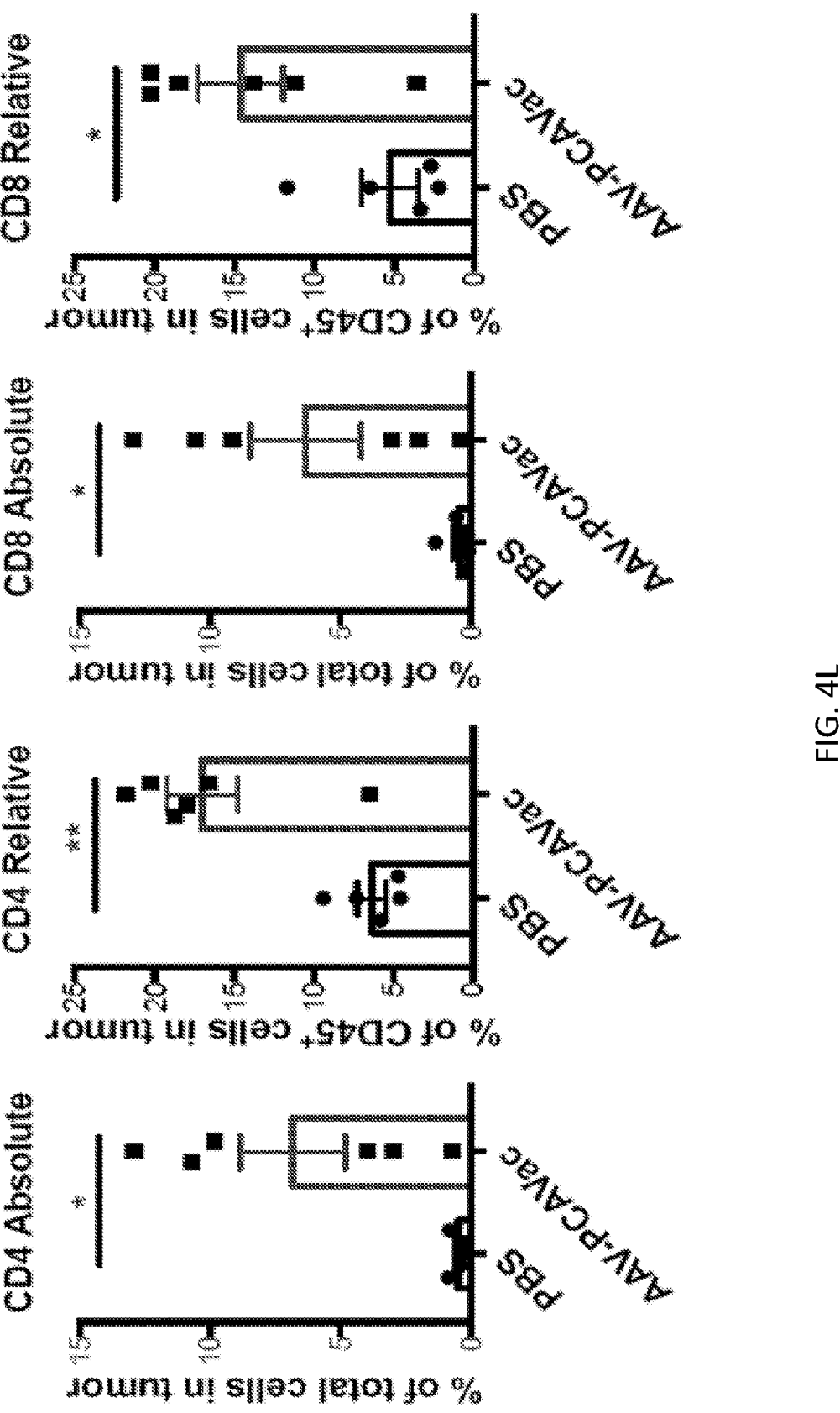
FIG. 4L shows quantification of $CD4^+$ and $CD8^+$ T cell populations from TILs of tumor-bearing mice treated with PBS or AAV-PCAVac. From left to right, bar-dot plots with two-sided unpaired t test for the following comparisons: Fraction of $CD4^+$ T cells in all cells in tumor (absolute fraction); AAV-PCAVac vs. PBS, p=0.025. Fraction of $CD4^+$ T cells in all $CD45^+$ immune cells in tumor (relative fraction); AAV-PCAVac vs. PBS, p=0.0035. Fraction of $CD8^+$ T cells in all cells in tumor (absolute fraction); AAV-PCAVac vs. PBS, p=0.039. Fraction of $CD8^+$ T cells in all $CD45^+$ immune cells in tumor (relative fraction); AAV-PCAVac vs. PBS, p=0.019. Error bars: All data points in this figure were presented as mean±s.e.m. Asterisks: * p<0.05,  p<0.01, * p<0.001.
Figure 13A:
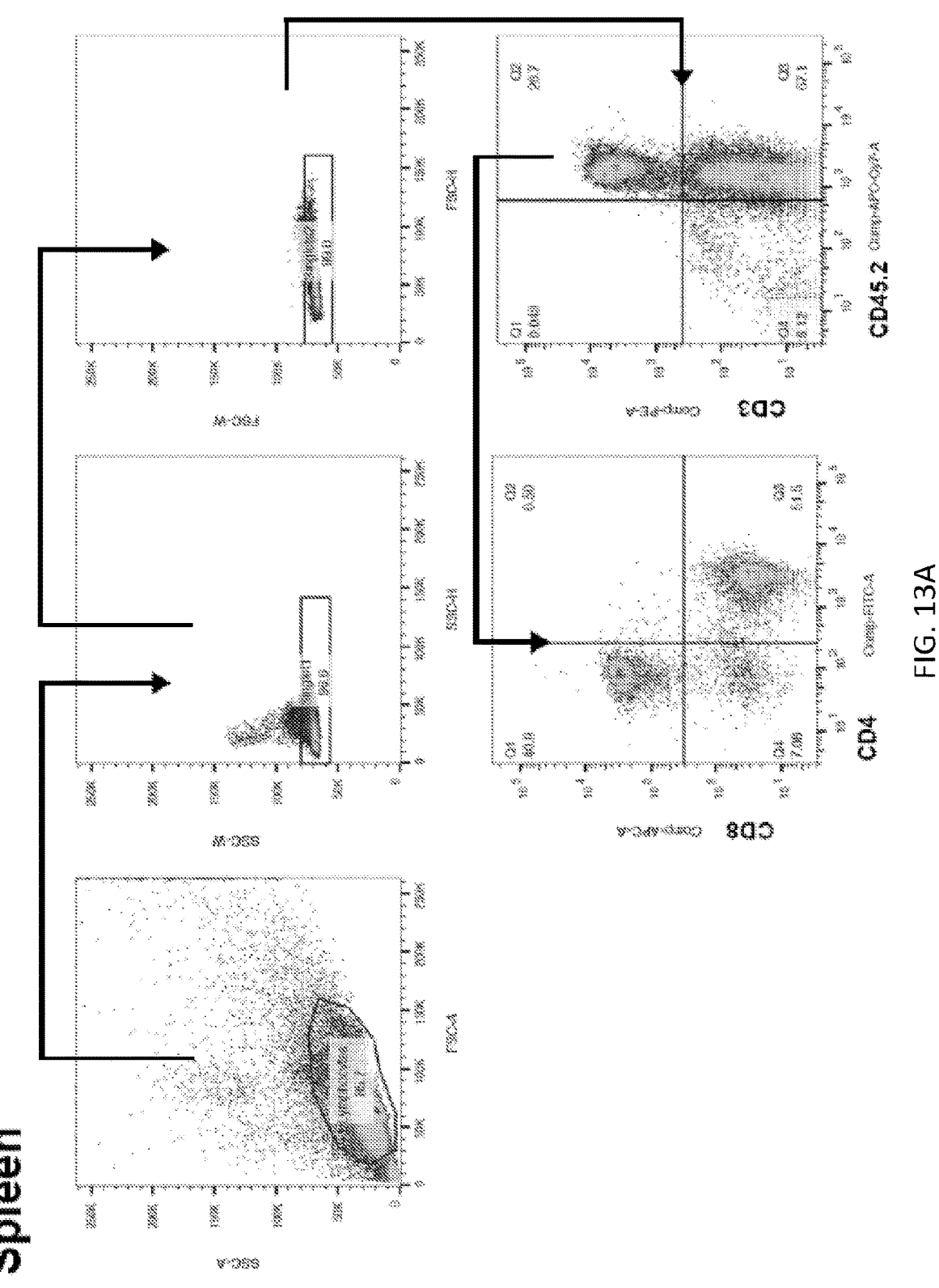
FIGS. 13A-13B illustrate FACS gating of representative spleen and tumor samples. Single cell suspension from samples were gated by FSC, SSC and then CD45$^+$, CD3$^+$, CD4$^+$, and CD8$^+$ T cell populations in the spleen (top) or tumor (bottom).
Figure 13B:
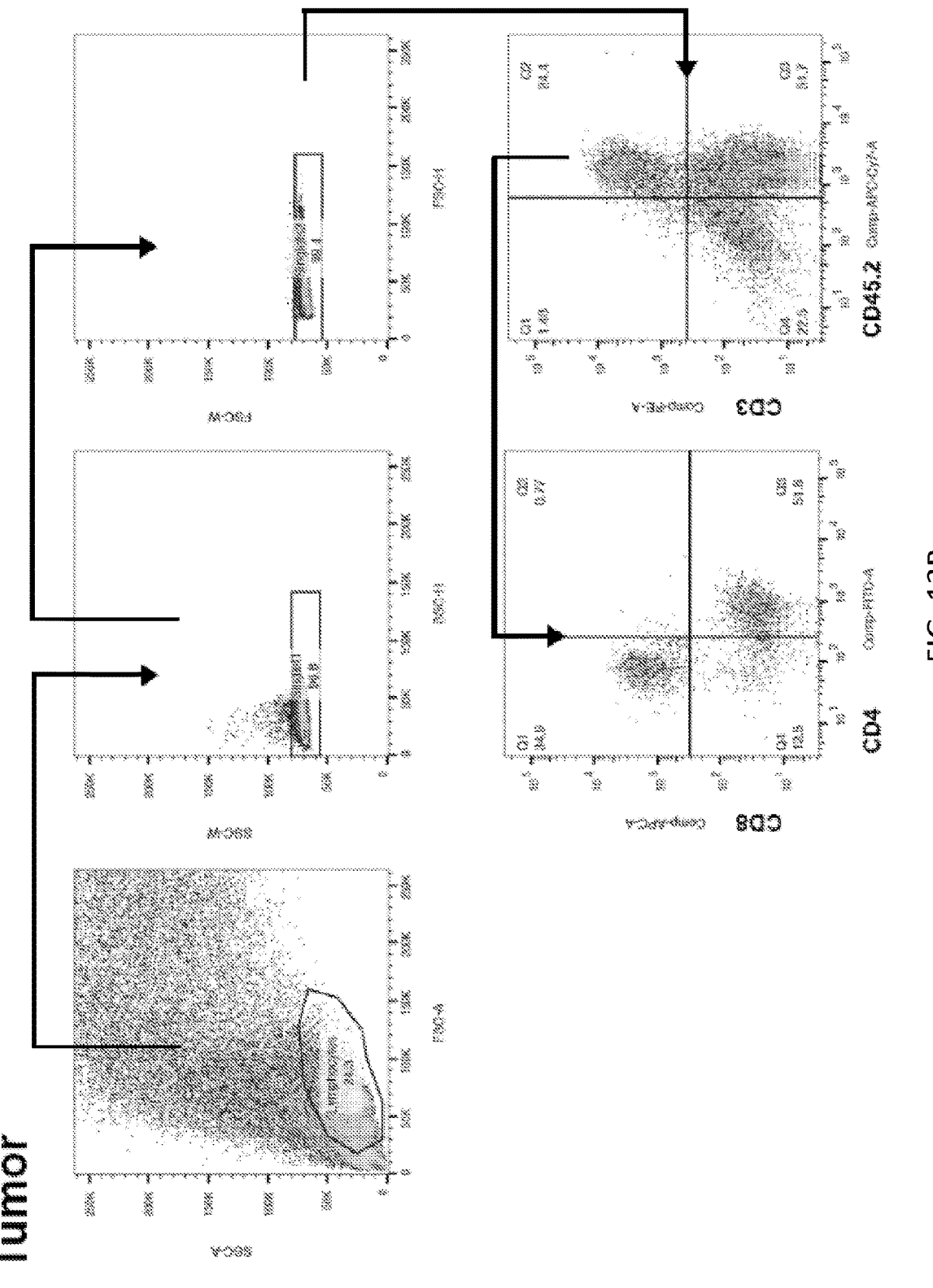
Figure 15A:
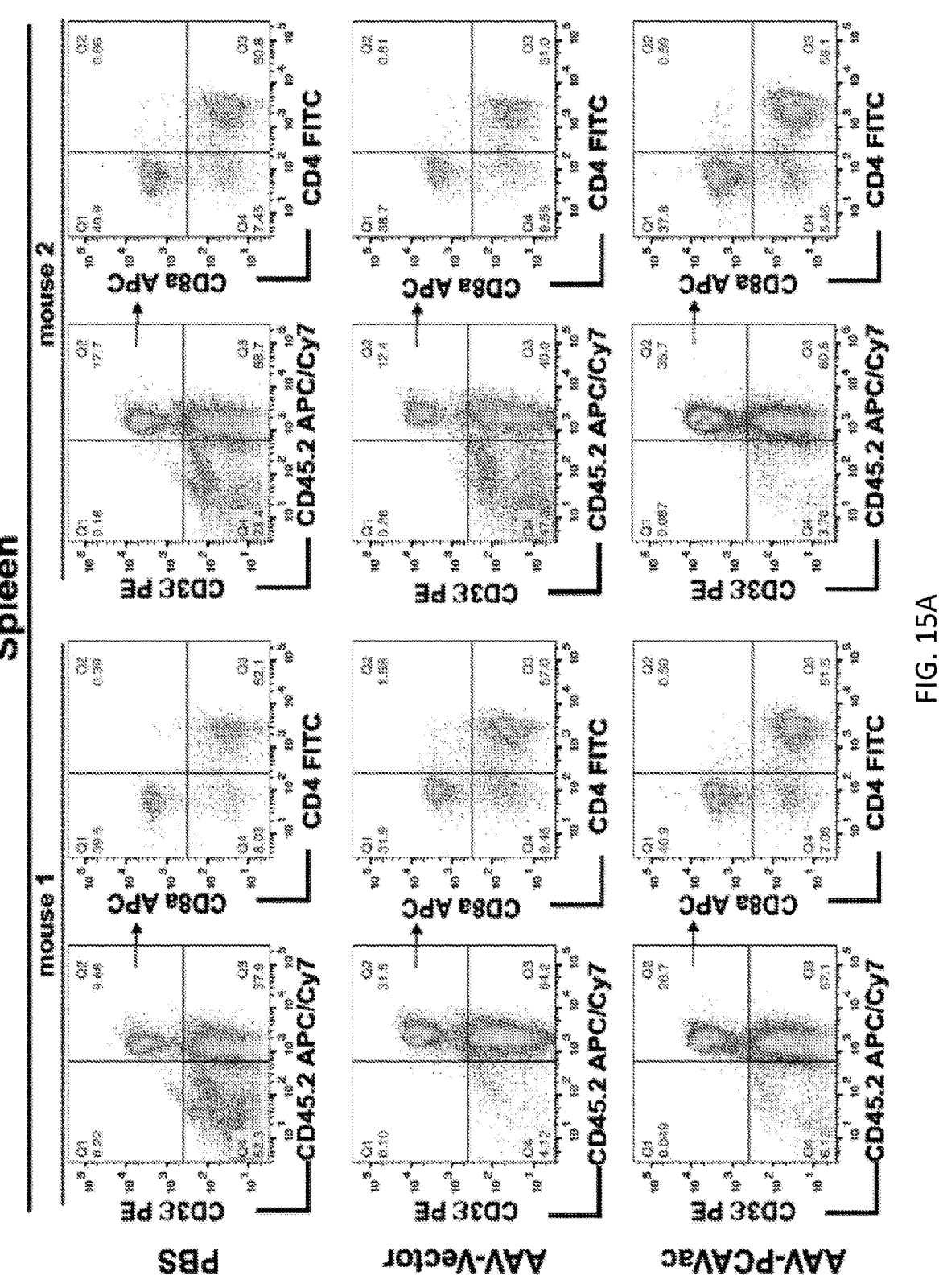
FIGS. 15A-15D illustrates CD4$^+$ and CD8$^+$ T cells in the spleen and tumors of mice treated with PBS, AAV-Vector, or AAV-PCAVac.
Figure 15B:
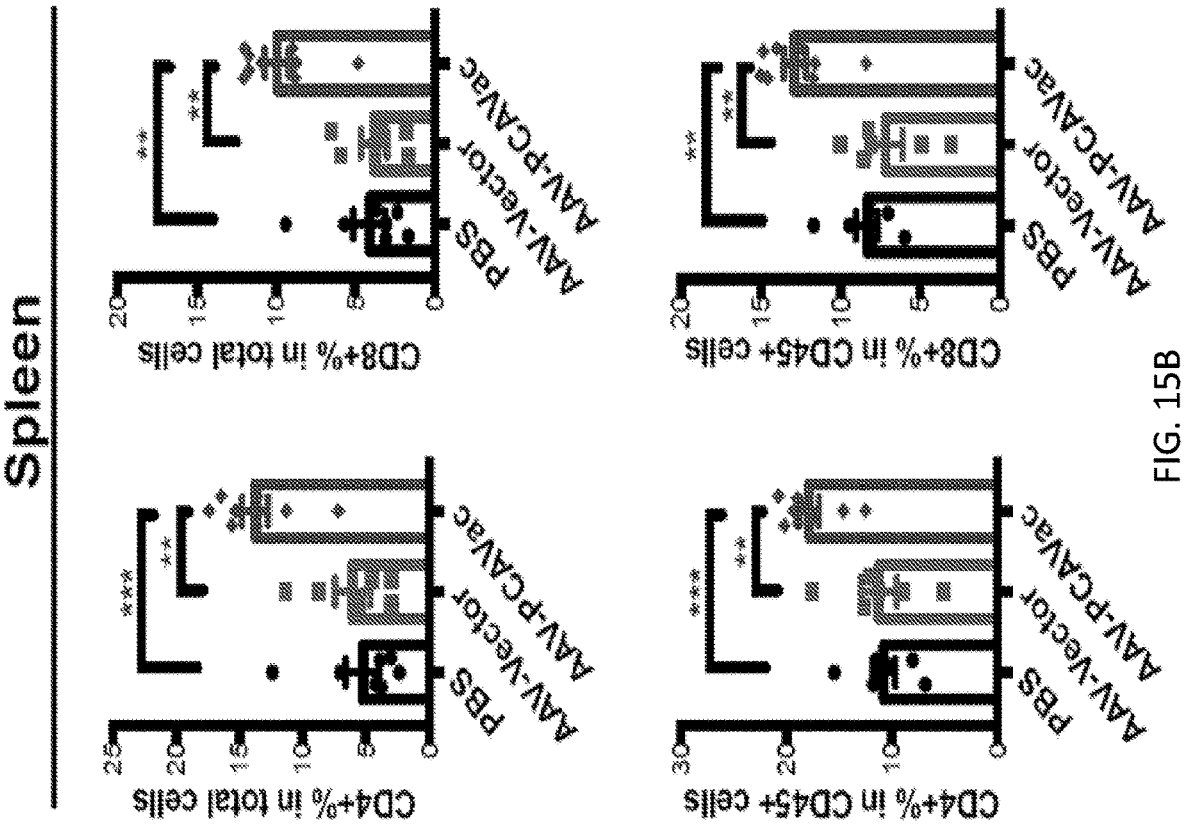
Figure 15C:
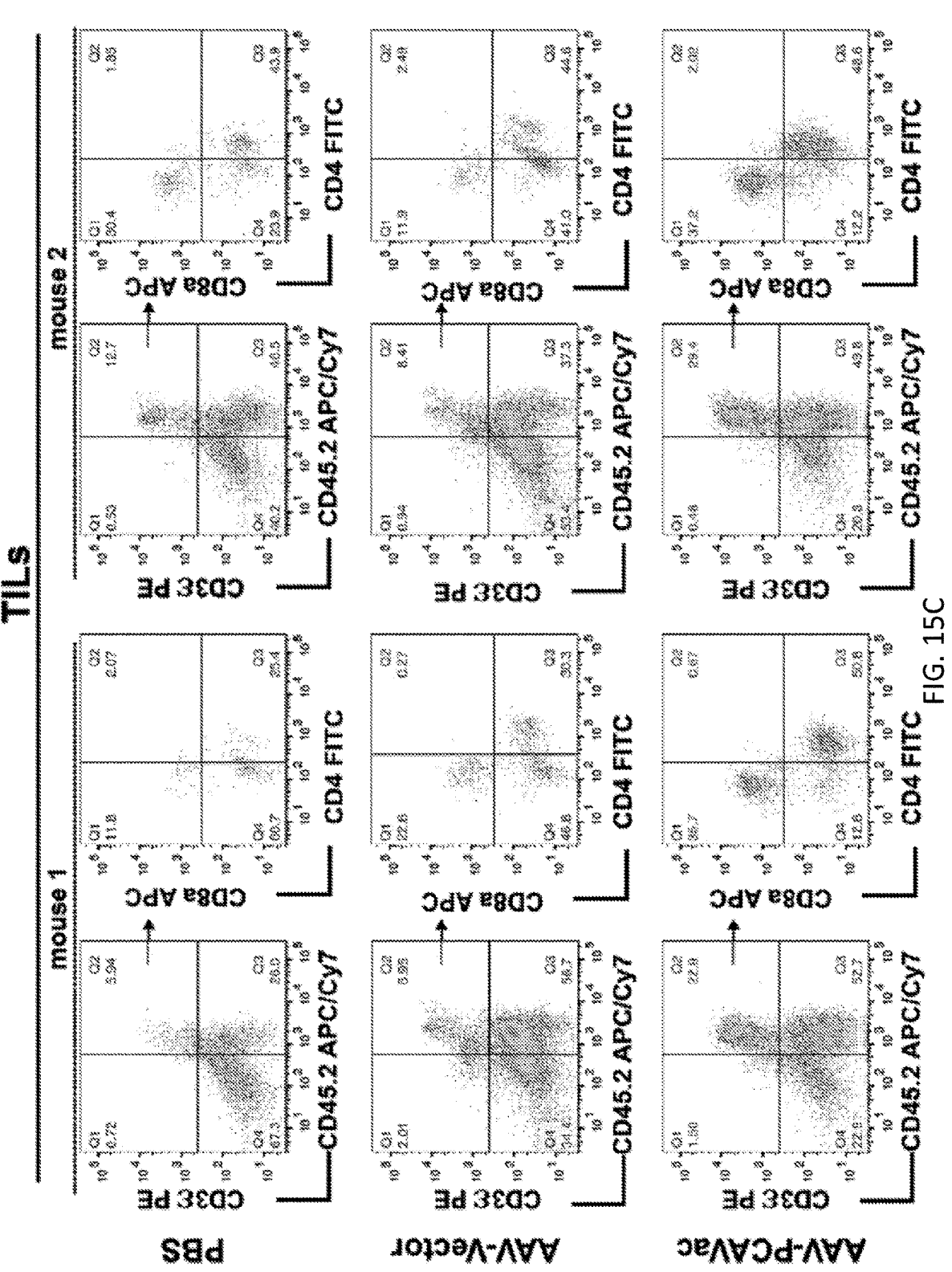
Figure 15D:
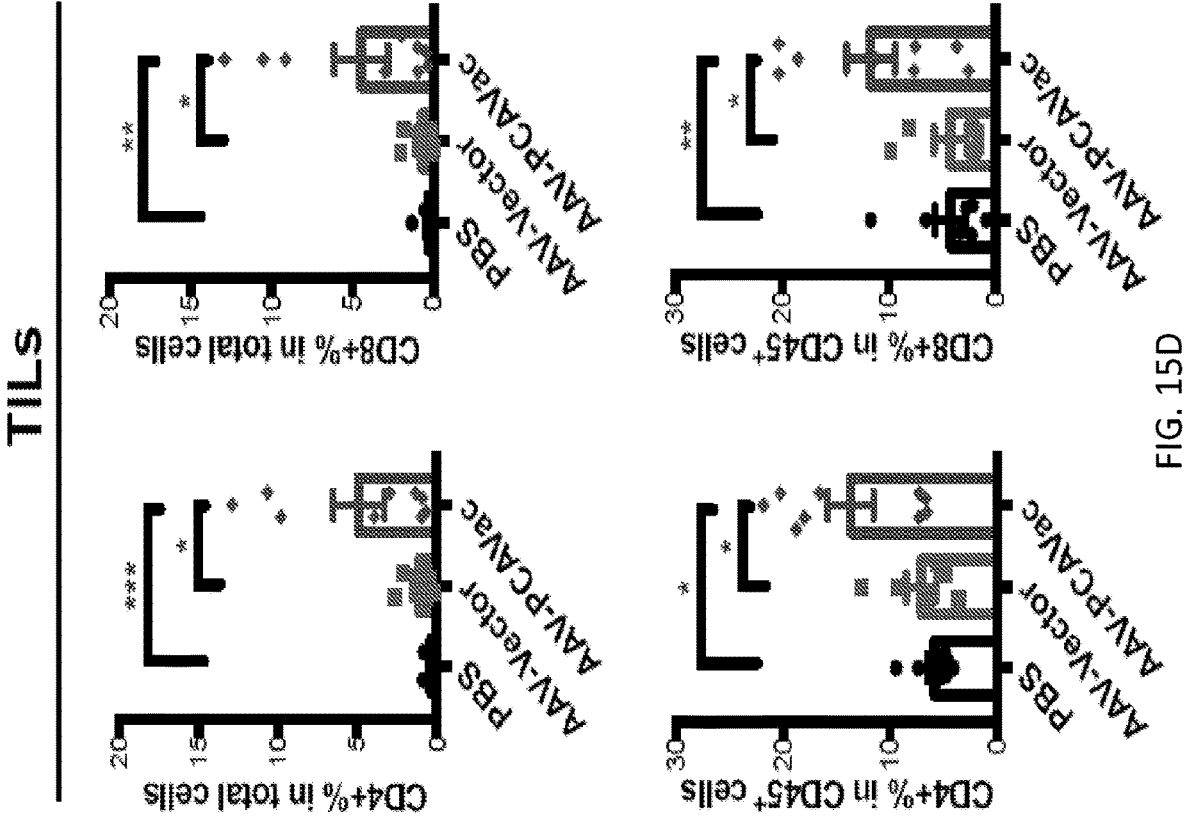
Figures 16A, 16B, 16C, 16D:
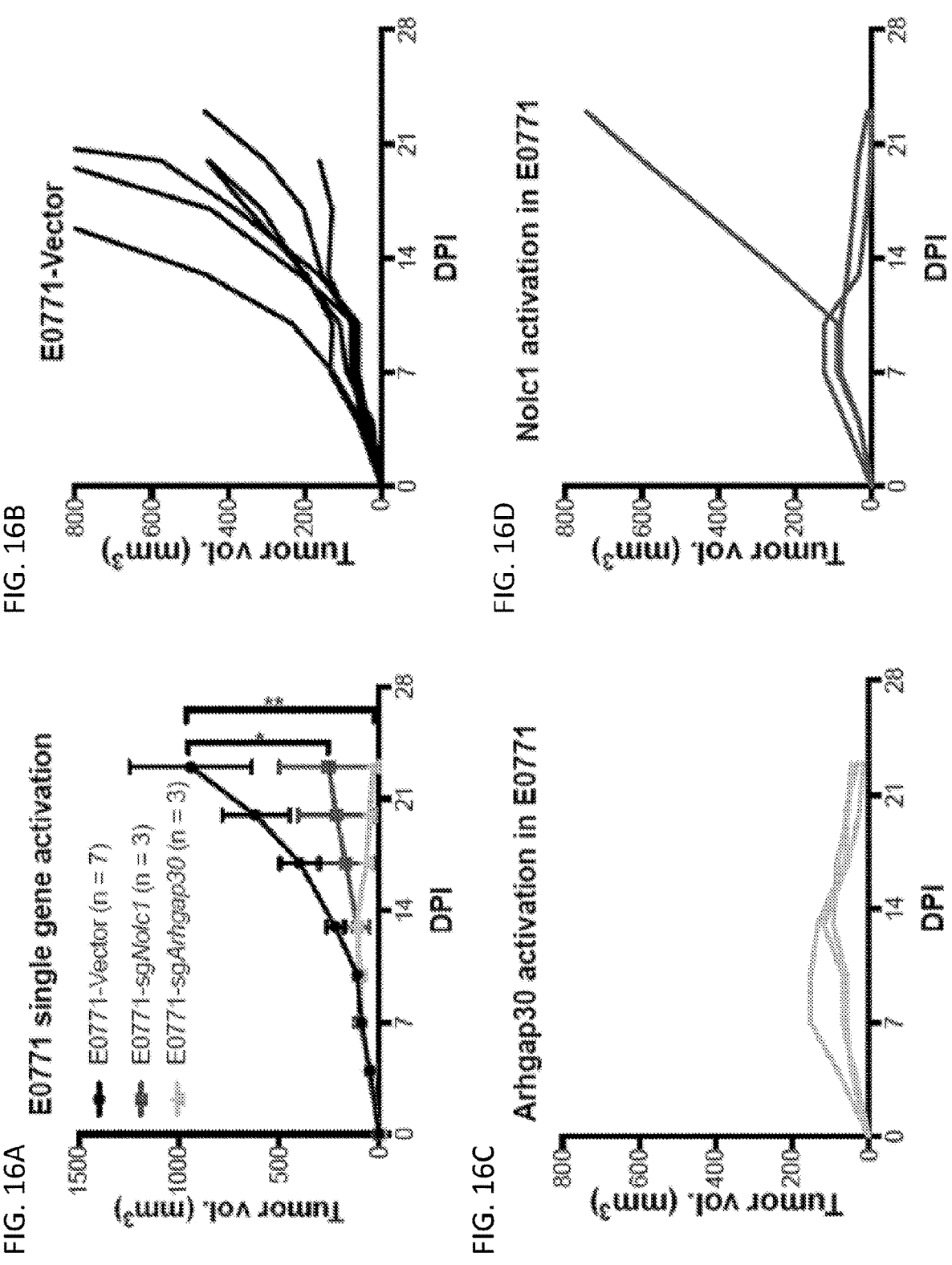

Using ELISPOT, it was observed that AAV-PCAVac significantly augmented tumor-specific Ifnγ producing splenocytes in vaccinated mice compared to PBS (p<0.001) and AAV-vector (p<0.01) (FIG. 4G-4H). To examine the adaptive immune responses, FACS analysis was performed on T cell populations from both the spleen and tumor (FIGS. 13A-13B). In the splenocyte population, AAV-PCAVac treatment significantly increased CD4$^+$ and CD8$^+$ T cells' abundance, in total cells and in CD45$^+$-relative fractions (FIGS. 4H-4I, FIGS. 15A-15B). For example, AAV-PCAVac treated mice have greater than 2.4-fold increase of CD8$^+$ T cells as compared to PBS and AAV-vector treated mice (p<0.01, FIG. 4I, FIG. 5B). These observations hold in the TIL population (FIGS. 4J-4K, FIGS. 15C-15D), for example, AAV-PCAVac treated tumors have an average 15-fold more CD8$^+$ TILs as compared to PBS treated mice (p<0.05, FIG. 4K, FIG. 5D), consistent with the strong anti-tumor immune response induced by AAV-PCAVac treatment (FIGS. 4D-4G). These data together revealed that AAV-PCAVac is a potent means to stimulate specific anti-tumor immune responses resulting in significant regression or elimination of established tumors, which represents a proof-of-concept of a cost-effective precision multiplexed vaccination approach.

Example 6: Discussion

New technologies that have harnessed the immune system to destroy malignant tumor cells have transformed cancer therapeutics. The concept of cancer immunotherapy was first proposed over a century ago, and was subsequently revitalized when it was formally proposed that the immune system could recognize and eliminate tumor cells in the immune surveillance theory. However, it is now known that cancers can rapidly adapt to these immune pressures, acquiring new alterations to escape immune elimination using many different mechanisms. Tumor cells can acquire mutations to reduce immune recognition or increase resistance to cytotoxic killing, and also foster immunosuppressive microenvironments in various different ways. Cytotoxic T lymphocytes (CTLs) play an essential role in anti-tumor immunity, most prominently by the specific killing of tumor cells in response to tumor-associated antigens (TAAs). Adoptive transfer of ex vivo expanded naturally occurring or engineered chimeric antigen T (CAR-T) cells has achieved success in immunotherapy of multiple types of liquid cancers. However, many factors including insufficient infiltration, anergy, exhaustion, and suppressive microenvironments can lead to non-responsiveness of T cell based treatments in solid tumors. Co-stimulatory and co-inhibitory receptors play a pivotal role in the status and fate of T cells. For example, CTLA-4 and PD-1 are two important receptors on T cells designed to rheostat immune responses to avoid autoimmunity, but they can be manipulated by tumors to block anti-tumor immunity. Immune checkpoint blockade therapies by blocking CTLA-4 and PD-1 with antibodies have yielded significant clinical benefits across many tumor types with durable responses even in metastatic and chemo-resistant tumors. Nevertheless, only a portion of patients show sustained clinical responses, demonstrating the need for other therapeutic approaches or combinatorial therapeutics. The present invention provides such an approach.

Vaccination has achieved exceptional success in protecting hosts from infectious agents due to its efficacy in stimulating durable adaptive immune defenses. However, approved cancer therapies based on therapeutic vaccines are scarce. Tumor antigen recognition is key to T cell mediated tumor rejection, and the load of TAAs, especially neoantigens, has been shown to be correlated with cytolytic T cell activities and patients' responsiveness to immune checkpoint blockade. However, spontaneous immune recognition of mutations and self-antigens is usually inefficient for effective tumor rejection, due to the complex in vivo cancer-immune evolution processes such as cancer immunoediting. This was also observed in a clinical setting where neoantigen landscape dynamics in human melanoma was shared by cancer cell—T cell interactions. Vaccination is potentially an effective approach to boost immune recognition of cancer specific mutants. However, many factors may contribute to the lack of efficacy of vaccines in mediating effective anti-tumor responses. Most current vaccines cannot mediate effective anti-tumor responses by T cells, or encounter tumor escape by immunoediting and other mechanisms. In particular, low-affinity of invoked T cell receptors to the peptide-MHC class I (p-MHCI) complex and the shift of antigenic repertoire in advanced cancers are potential reasons underlying the lack of efficacy for many vaccine formulations, especially those with only one or a handful of polypeptides. With high-throughput exome sequencing, the notion of personalized immunotherapy targeting patient-specific mutations has become technologically feasible, and recent studies using peptide- and RNA-based vaccines have shown that targeted delivery of mutated neoantigens can generate strong anti-tumor effects. Large-scale screening and generation of effective peptides or RNAs is expensive and time consuming. Selection of a subset of RNAs or peptides may miss other immunogenic neoantigens in the full spectra of endogenous mutations, thereby leaving the door open for continued immune evasion through tumor evolution. Furthermore, both peptides and RNAs have relatively short half-lives. For longitudinal induction of effective anti-tumor immune responses, continuous expression of antigens may prove beneficial. Direct activation of endogenous genes overcomes these challenges by providing sustained and tunable overexpression of mutated genes to amplify the signal of neoantigens (FIG. 14). Pooled gene activation using CRISPRa libraries can be customized to augment the expression of any selected set of genes, or the whole genome, thereby boosting neoantigen presentation for T cell recognition. Although the mechanism of action underlying the anti-tumor responses observed here are likely more complicated than involving T cells alone, the data demonstrate that endogenous gene activation-based therapies, including CAVac, AAV-CAVac and AAV-PCAVac, offer an orthogonal vaccination approach for cancer immunotherapy that can function in concert with other established immunotherapeutic modalities.

Example 7: Exome-Guided AAV-CRISPRa Based Mutated Gene Set Activation as Precision Multiplexed Tumor Vaccination (AAV-PCAVac) Against Human Tumors Step 1—Patient Tumor Profiling:

Genomic DNA of tumor samples from core biopsi(es) and normal samples (peripheral blood) is extracted, purified, and subjected to whole-exome sequencing. Optional: RNA of tumor samples from core biopsi(es) and normal samples (peripheral blood) is extracted, purified, and subjected to RNA sequencing to detect gene expression, which will is also used for both mutation call and expression of potential antigenic mutants.

Step 2—Mutation Mapping and Mutant Gene Ranking:

Somatic SNPs and indels in cancer cells are identified by comparison to matched normal tissues, and the mutations are mapped to each gene.

Step 3—CRISPRa sgRNA Library Design:

CRISPRa sgRNAs targeting these mutants are designed. The mutated gene set customized sgRNA library is synthesized and pool-cloned into the AAV-CRISRPa vector, which is packaged into AAV9 to generate tumor-mutation matched (precision/personalized) AAV vaccine (AAV-PCAVac).

Step 4—AAV GMP/cGMP:

The AAV-PCAVac is subjected to GMP/cGMP for production and quality check.

Step 5a—AAV-PCAVac Delivery into Unresectable Tumor:

In a clinical trial or clinical treatment setting, clinicians deliver AAV-PCAVac to the primary or metastatic tumor site which is an unresectable disease, as a treatment to elicit immune response against the residue or potentially metastasized cancer cells harboring the particular mutated genes.

Step 5b—AAV-PCAVac Delivery into Tumor as an Adjuvant of Surgery:

In a clinical trial or clinical treatment setting, clinicians deliver AAV-PCAVac to the residue tumor site after surgery as an adjuvant treatment to elicit an immune response against the residue or potentially metastasized cancer cells harboring the particular mutated genes.

Example 8: Comparison with Existing Methods and Discussion of the Uniqueness and Advantages of the Present Invention With high-throughput exome sequencing, the notion of personalized immunotherapy targeting patient-specific mutations has become technologically feasible, and recent studies using peptide- and RNA-based vaccines have shown that targeted delivery of mutated neoantigens can generate strong anti-tumor effects. However, large-scale screening and generation of effective peptides or RNAs is expensive and time consuming. On the other hand, pre-selection of a subset of RNAs or peptides will likely miss other important immunogenic neoantigens within the full landscape of endogenous mutations, thereby leaving the door open for continued immune evasion through tumor evolution. Furthermore, both peptides and RNAs have relatively short half-lives, potentially limiting the durability of such interventions, or requires more frequent re-dosing. For longitudinal induction of effective anti-tumor immune responses, continuous expression of antigens has its advantages.

As demonstrated herein, direct activation of endogenous genes overcomes these challenges by providing sustained and tunable overexpression of mutated genes to amplify the signal of neoantigens that may not be expressed at baseline (FIG. 14). Since CRISPR activation works on the endogenous genes themselves, if a new mutation encoding a potential neoantigen is acquired, the CRISPR activation library will automatically drive the expression of the new mutant gene. Due to the nature of endogenous gene activation, this vaccination approach will continue to evolve alongside the tumor itself, which will naturally lockdown mutated cancer cells and thereby eliminate an avenue of immune escape. Importantly, pooled gene activation using CRISPRa libraries can be customized to augment the expression of any selected set of genes, or the whole genome, thereby boosting neoantigen presentation for T cell recognition. Although the mechanism of action underlying the anti-tumor responses observed here are likely more complicated than involving T cells alone, the data herein demonstrate that endogenous gene activation-based therapies, including CAVac, AAV-CAVac and AAV-PCAVac, offer an orthogonal vaccination approach for cancer immunotherapy that can function in concert with other established immunotherapeutic modalities.

Example 9: Compositions and Methods for Off-the-Shelf and Customizable Endogenous Gene Vaccination Cancer Vaccine Presented herein are two modes of multiplexed vaccination with endogeneous gene activation using the CRISPRa system. In an unvaccinated individual, a tumor cell contains tumor-specific mutated genes that are transcribed, translated, then presented as peptides (neoantigens) on MHC class I molecules (FIG. 17A). Oftentimes these neoantigens are expressed at a low level, and thus elicit a weak response upon binding to a TCR of a CD8+ T cell. In one approach described herein, Multiplexed Vaccination by Mutated Gene CRISPR Activation (MGCA), a plurality of mutant endogenous genes are activated by the CRISPRa system using sgRNAs specific for these mutant endogenous genes (see Examples 4, 5, and 6). This leads to high expression of neoantigens on MHC class I molecules yielding a robust CD8+ T cell response (FIG. 17B). In a second approach utilized herein, Multiplexed Vaccination by Antigen Presentation CRISPR Manipulation (APCM), a plurality of antigen presentation genes are activated by the CRISPRa system using sgRNAs specific for these antigen presentation genes (see Example 10 below). This leads to augmentation of antigen presentation machinery, increased expression of cytokines and/or immunological modulators, increased presentation of neoantigens on MHC class I molecules, and a robust CD8+ T cell response (FIG. 17C).

The precision ("Personalized") AAV-PCAVac system was proven effective as a therapeutic vaccine. The AAV-PCAVac was designed to target a set of the most highly mutated genes in E0771 cells as compared to normal mammary fatpad of C57BL/6J female mice (SEQ ID NOs: 349-4,187; Table 4). The efficacy of the AAV-PCAVac multiplexed endogeneous gene activation was tested using a syngeneic orthotopic model in C57BL/6J hosts. E0771 triple-negative breast cancer (TNBC) cells were engrafted in the mammary fatpad of female C57BL/6J mice. Mice were treated with PBS, AAV-Vector, or the AAV-PCAVac library (SEQ ID NOs. 349-4,187). Survival over time was monitored for all treatment groups (FIG. 18). Efficacy was seen in both AAV-Vector and AAV-PCAVac, however AAV-PCAVac had a stronger anti-tumor effect (FIGS. 18-19).

A two-sided tumor induction was performed, wherein tumors (E0771 TNBC) were induced at two locations, a primary and a distal site, in C57BL/6J mice. Mice were treated at the primary site with either PBS, AAV-Vector, or AAV-PCAV. Regression of both the primary and distant tumors was observed in the AAV-PCAVac treated mice (FIG. 20).

Using the syngenic orthotopic TNBC model, C57BL/6J mice were re-challenged with E0771 tumor cells after complete regression of a first E0771 tumor following AAV-PCAVac treatment. No growth was seen in the AAV-PCAVac treated mice following re-challenge (FIG. 21).

The Precision ("Personalized") AAV-PCAVac system was further validated as a therapeutic vaccine against TNBC. E0771 TNBC were engrafted in the mammary fatpad of C57BL/6J female mice. Mice were treated with PBS, AAV-Vector, AAV-Emut11 library or AAV-PCAVac library. The Emut11 library targets a set of the topmost 11 mutated genes in E0771 cells (Tekt2, RSC1a1, Acer2, Sc36a1, Tmem106b, Gabrg2, Ago4, G3bp1, FAT2, Hmmr, Trp53). Efficacy was seen in both AAV-Vector, AAV-Emut11 and AAV-PCAVac, however AAV-PCAVac had the strongest anti-tumor effect (FIG. 22).

SgRNAs were designed to target a set of the most highly mutated genes in B16F10 (melanoma), GL261 (glioma), Hepa1-6 (hepatoma), MC38 (colon cancer), and Pan02 (pancreatic cancer) cells (SEQ ID NOs. 11,809-23,776). The sgRNAs were cloned into an adeno-associated viral vector and packaged, as described elsewhere herein.

Example 10: Antigen Presentation CRISPR Manipulation (AAV-APCM) System

An off-the-shelf Antigen Presentation CRISPR Manipulation (AAV-APCM) system was designed and tested as a therapeutic vaccine. An AAV-Apcm library was designed by first selecting a small set of genes that elicit immune responses: B2M, B7-H2 (ICOSL), Calnexin, Calreticulin, CCL5, CD30L(TNFSF8), CD40L, CD70, CD80, CD83, CD86, CXCL10, CXCL3, CXCL9, Cystatin B, Cystatin C (x), ERAP1, ERp57(PDIA3), Flt3L, GITRL(TNFSF18), IFNa4, IFNb1, IFNg, IL-2, LIGHT (TNFRSF14), NLRC5/

CITA, OX40L/TNFSF4, Sec61a1, Sec61b, Sec61g, TAP1, TAP2, Tapasin, TAPBPR, TL1A (TNFSF15), and TNFSF9 (4-1BBL). SgRNA sequences were designed to target these genes in mice, yielding a library of 107 sgRNAs (SEQ ID NOs. 23,779-23,885) (FIG. 27). Because the composition is fixed, by definition this APCM library is also an "Off"-the-shelf vaccine, while it can definitively be combined with personalized vaccine. The sgRNAs were cloned into an adeno-associated viral vector and packaged, as described elsewhere herein. Efficacy of the AAV-APCM multiplexed endogenous gene activation was tested in a syngeneic ortho-topic model in C57BL/6J hosts. E0771 TNBC cells were engrafted in the mammary fatpad of C57BL/6J female mice. Mice were treated with PBS, AAV-Vector, or the AAV-Apcm library. Efficacy was seen in both AAV-Vector and AAV-Apcm treatment, however the AAV-Apcm treatment had a stronger anti-tumor effect (FIG. 23).

A second AAV-APCM library (AAV-Apch) was generated that was designed/optimized specifically for human genes. SgRNAs were designed to target the same set of antigen presentation genes as above, yielding a library of 219 sgRNAs (SEQ ID NOs: 23,886-24,104) (FIGS. 28A-28B). The sgRNAs were cloned into an adeno-associated viral vector and packaged, as described elsewhere herein.

Example 11: "Off-the-Shelf" Whole-Genome Libraries

An off-the-shelf whole-genome AAV-CAVac system was designed and tested as a therapeutic vaccine against mela-noma. Therapeutic efficacy of whole-genome gene activa-tion AAV-CAVac (i.e. AAV-SAM) against established ortho-topic syngeneic B16F10 tumors by intratumoral administration was demonstrated. Growth curves of ortho-topic transplanted B16F10 tumors in C57BL/6J mice treated with PBS and AAV-CAVac at indicated times (days post-injection; arrows) are shown in FIG. 24.

The off-the-shelf whole-genome AAV-CAVac system was also established as a therapeutic vaccine against pancreatic cancer. Therapeutic efficacy of whole-genome gene activa-tion AAV-CAVac (i.e. AAV-SAM) against established ortho-topic syngeneic Pan02 tumors by intratumoral administra-tion was demonstrated. Growth curves of subcutaneous transplanted Pan02 tumors in C57BL/6J mice treated with PBS and AAV-CAVac at indicated times (arrows) are shown in FIG. 25.

An off-the-shelf AAV-SingleCAVac system was proven effective as a prophylatic vaccine (FIG. 26). Efficacy of AAV-SingleCAVac endogenous gene activation in a synge-neic orthotopic model in C57BL/6J host was demonstrated. Shown are growth curves of Arhgap30 or Nolc1 activated E0771 cell induced syngeneic orthotopic tumor. As com-pared to vector transduced cells, sg-Arhgap30 or sg-Nolc1 transduced E0771 cells generated tumors that grew slower and often got rejected by the C57B/6J host.

A human version of the AAV-CAVac (i.e. AAV-SAM) system is designed for therapeutic and prophylactic use against different cancer types. SgRNAs are designed against endogeneous human genes expressed in different cancer types. SgRNAs are cloned and packaged into viral vectors as described herein.

Example 12: Multiplexed Endogenous Gene Activation Leads to Tumor Rejection Through an Immune-Mediated Mechanism The CRISPRa system uses a catalytically dead Cas9 without nuclease activity (dCas9), enabling simple and flexible regulation of gene expression through dCas9—transcriptional activation domain fusion. This system can be further enhanced by the recruitment of other effectors such as synergistic activation mediators (SAM). Herein, broad genome-wide CRISPRa libraries were utilized for initial experiments, since activation of all coding genes in the genome includes activation of all mutated genes.

To test the effect of endogenous gene activation on the immunogenicity of cancer cells, it was essential to utilize fully immunocompetent tumor models. The E0771 synge-neic mouse model of triple-negative breast cancer (TNBC), in which E0771 cancer cells are transplanted into the mam-mary fat pad of fully immunocompetent C57BL/6 mice, was used. E0771 cells were transduced with CRISPRa lentiviral vectors expressing dCas9-VP64 and MS2-p65-HSF1 (E0771-dCas9-VP64-MPH) (FIG. 29A and FIG. 30A). Observing that dCas9-VP64 alone has a moderate effect on tumor growth (FIG. 30B), all subsequent experiments were performed using E0771-dCas9-VP64 cells. Next, a mouse genome-scale lentiviral SAM CRISPRa sgRNA library (mSAM, or SAM for short) (Konermann et al. (2015) Nature 517, 583-588) was transduced into E0771-dCas9-VP64-MPH cells, generating a highly diverse population of cells encompassing the entire library (E0771-dCas9-VP64-MPH-SAM cell pool, or E0771-SAM for short). This was con-firmed by Illumina sequencing for 6 independent replicates (FIG. 30C). For controls, E0771-dCas9-VP64-MPH cells transduced with the empty lentiviral vector expressing an inert sgRNA and a MS2-loop-tracrRNA chimeric backbone (E0771-Vector for short) were used.

The E0771-SAM cell pool was transplanted into C57BL/6J mice to test their ability to form syngeneic tumors (FIG. 29A). In sharp contrast to E0771-Vector cells (0/8 rejection, i.e. 8/8 engrafted, all with large tumors), the E0771-SAM cell pool was rejected in most (42/50, 84%) of the mice, with the remaining mice (8/50, 16%) developing small tumors (FIG. 29B). To examine the contribution of innate and adaptive immune responses towards rejection of E0771-SAM cells, E0771-SAM cells were transplanted into the mammary fat pad of immunodeficient Nu/Nu and Rag1$^{-/-}$ mice. Unlike in immunocompetent C57BL/6J hosts (5/5 either completely rejected or only with small modules), all immunodeficient Nu/Nu (4/4) and Rag1$^{-/-}$ (5/5) mice rap-idly grew large tumors from E0771-SAM cells (FIG. 29C). Notably, E0771-SAM cells formed significantly larger tumors in Rag1$^{-/-}$ mice compared to in Nu/Nu mice (FIG. 29C). When both CD4$^+$ and CD8$^+$ T cells were pharmaco-logically depleted in C57BL/6J mice by treatment with α-CD4 and α-CD8 monoclonal antibodies, all mice that received E0771-SAM transplantation formed large tumors (4/4), in contrast to untreated mice (0/11 with tumors) (FIG. 29D). Of note, the E0771-SAM outgrown "escaper" tumors were sensitive to immune checkpoint blockade (ICB), with rapid complete regression upon treatment with antibodies against programmed death-1 (PD-1) or cytotoxic T-lympho-cyte associated antigen-4 (CTLA-4) (FIGS. 30D-30G). Together, these results indicated that pooled activation of endogenous genes using the CRISPRa system in a genome-scale manner induced potent tumor rejection in vivo only in immunocompetent hosts.

Figures 5C, 5D:
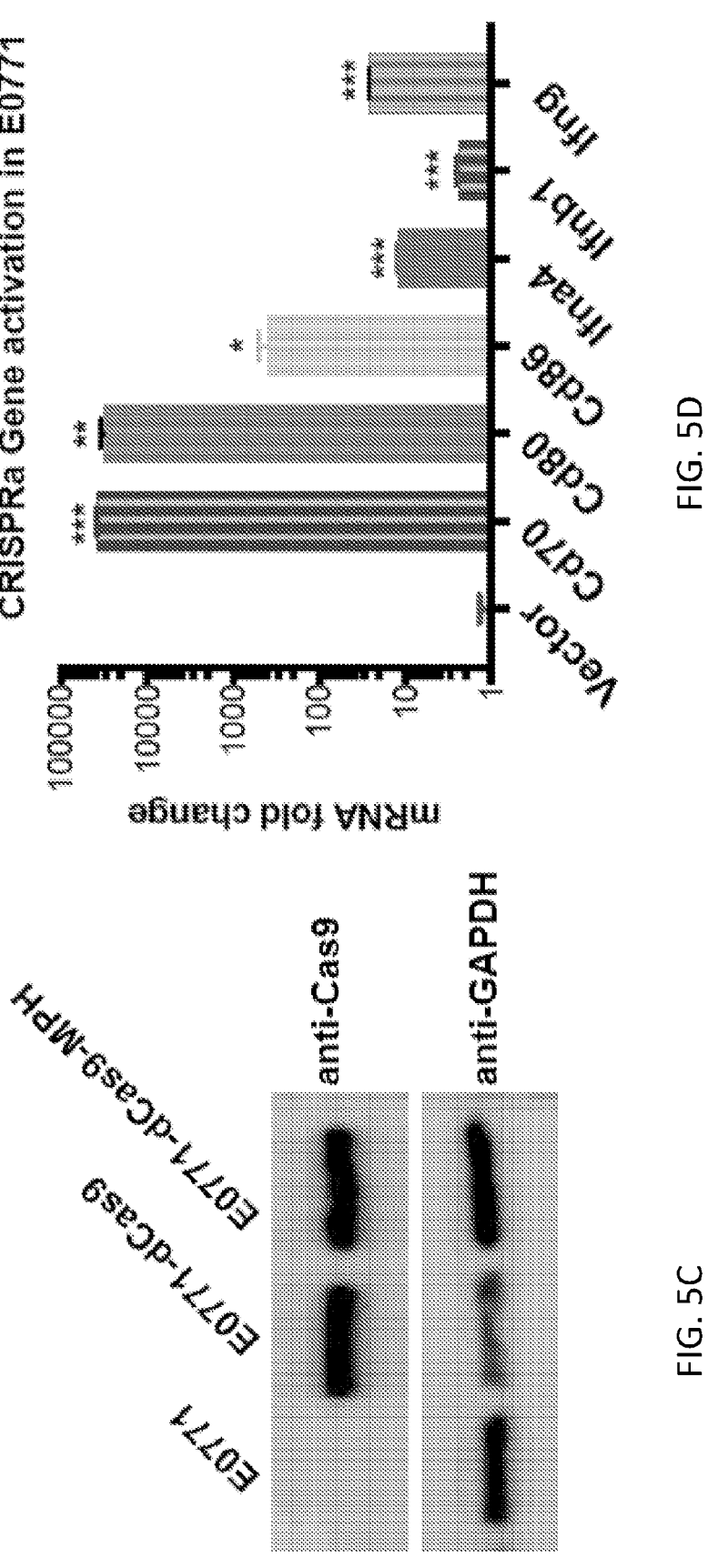
Figures 7A, 7B, 7C, 7D:
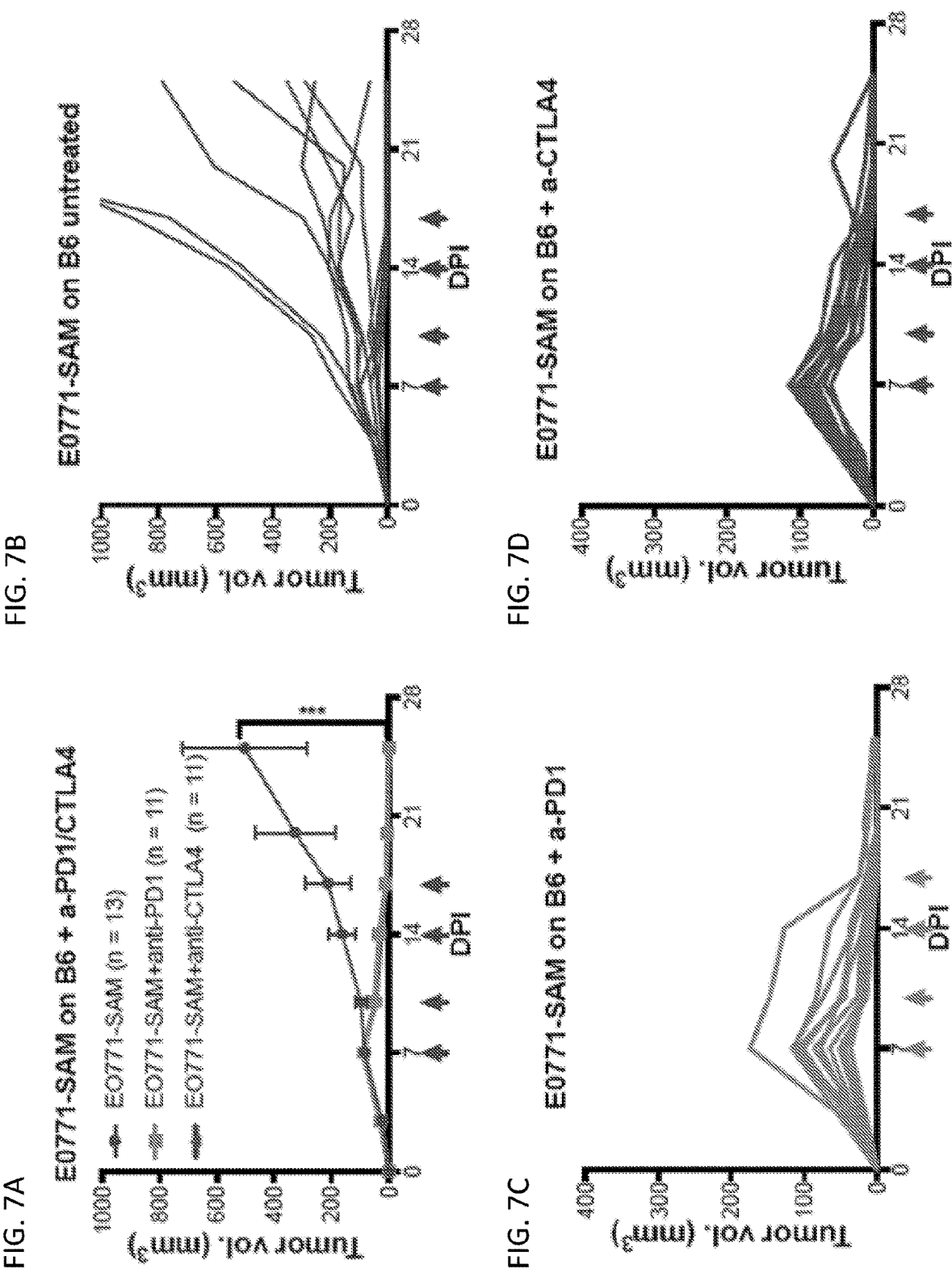
FIGS. 7A-7D illustrate the finding that tumors from E0771 with genome-scale activation of endogenous genes are sensitive to checkpoint blockade.

Example 13: Cell-Based Multiplexed Activation of Endogenous Genes as an Immunotherapy (MAEGI) has Prophylactic and Therapeutic Efficacy in Syngeneic Tumor Models Intrigued that the host immune system consistently rejected the E0771-SAM cells, it was next investigated whether CRISPRa-mediated activation of endogenous genes within tumor cells could stimulate broad anti-tumor immune responses. It was hypothesized that multiplexed activation of endogenous genes can be harnessed as a new approach of immunotherapy (MAEGI or CAVac, used interchangeably herein) distinct from all existing modalities. To test this experimentally, CRISPR-mediated gene activation was confirmed in the system (FIG. 5D). The SAM lentiviral-sgRNA library was then transduced into E0771-dCas9-VP64-MPH cells to generate E0771-SAM cells, followed by mitomycin treatment to induce senescence while maintaining the integrity of peptide-MHC-I complex on cell surface. This procedure generated the cell-based MAEGI (c-MAEGI or cell-based CAVac, which are used interchangeably herein). As a control, E0771-Vector cells that were treated with mitomycin in parallel (Cell-Vector control) were used. c-MAEGI was inoculated into C57BL/6J mice prior to E0771 tumor induction. In sharp contrast to untreated mice or Cell-Vector control treated mice (both 0% tumor free), c-MAEGI treated mice had complete protection (100% tumor free) against a subsequent tumor challenges with the unmodified parental cancer cell line (E0771). This held true across two vaccination regiments, i.e. 7 or 14 days prior to tumor challenge, while vaccination 3 days prior to tumor challenge granted near-complete protection (1/6 mice with a small nodule, 5/6 tumor-free). The results demonstrated that genome-scale activation of endogenous genes using CRISPRa (c-MAEGI) is an effective approach for prophylaxis against tumors with otherwise identical genetic background.

Given its efficacy as a prophylactic agent, it was postulated that c-MAEGI could also be used as a therapeutic intervention in established tumors. To test this, orthotopic syngeneic E0771 tumors were induced before treating the mice with c-MAEGI. Using a three-dose treatment scheme, tumors in c-MAEGI treated mice were significantly smaller than those in mice treated with Cell-Vector control or PBS. No efficacy was observed using heat-inactivated lysates of E0771 parental cells, or heat-inactivated c-MAEGI (FIGS. 31A-31B), suggesting the importance of maintaining the integrity of cellular components for immune stimulation in this setting. To examine the contribution of T cell-mediated immunity in driving the anti-tumor response, CD8 T lymphocytes were specifically depleted in C57BL/6J mice with an α-CD8 antibody. CD8$^+$ T cell depletion abolished the therapeutic efficacy of c-MAEGI (FIGS. 31C-31F), indicating that CD8$^+$ T cells are essential for the c-MAEGI mediated anti-tumor responses.

Figures 1I, 1J, 1K:
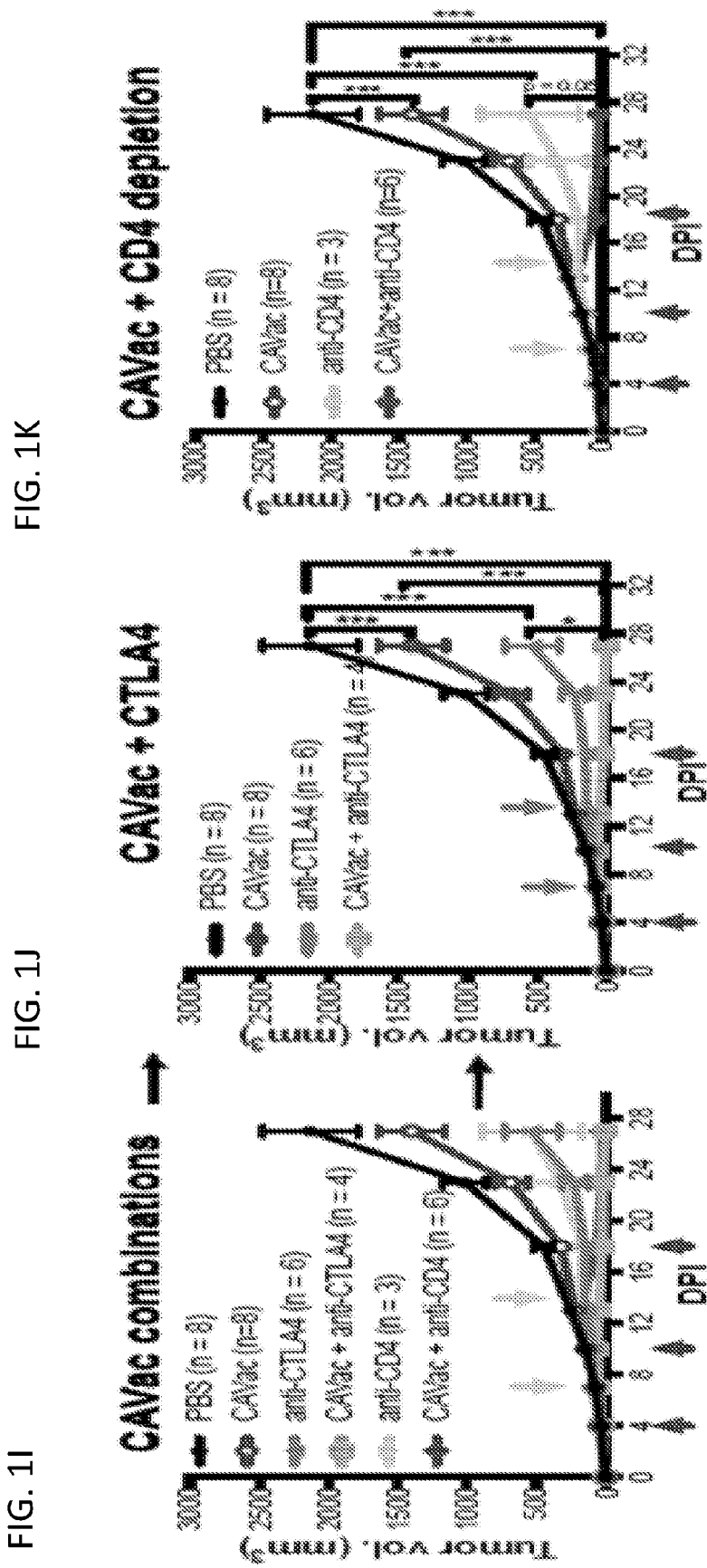

It was then investigated whether c-MAEGI could be used in conjunction with other immunotherapies or immunomodulatory agents. Interestingly, the combination of c-MAEGI+α-CTLA4 was significantly more effective than c-MAEGI alone (p<0.0001) or anti-CTLA4 alone (p=0.0005), leading to complete regression of established tumors (FIG. 1J). Moreover, the mice that underwent complete responses were completely resistant to tumor rechallenges (FIG. 31G), suggesting long-term protective memory in treated mice.

Example 14: AAV-Mediated In Situ Activation of Endogenous Genes as an Immunotherapeutic Agent (AAV-MAEGI)

Although the cell-based MAEGI showed significant anti-tumor efficacy, it was reasoned that direct in vivo delivery of MAEGI with viral vehicles to the target tumors can yield a deliverable therapeutic modality and might also further improve efficacy. Adeno-associated viruses (AAVs) are potent viral vectors capable of mediating efficient transgene delivery into various organs in mice and humans. They are non-replicative without helper adenovirus, have serotype-specified tropism and cause minimal toxicity or undesired immune responses. Because of these properties, AAVs have been commonly used in clinical studies of gene therapy, and an AAV-based treatment recently received FDA approval. To enable direct delivery of MAEGI to tumors, an AAV version of MAEGI was devised by generating an AAV-CRISPRa vector with the CRISPRa modules (EF1α-MPH and U6-sgRNABackbone-MS2) and cloning in the genome-scale SAM sgRNA library (AAV-g-MAEGI or AAV-CAVac, used interchangeably herein). The resultant library was then pool-packaged into AAV (FIG. 2A). The effectiveness of pool-packaged AAV-CRISPRa in activating endogenous genes was confirmed by infecting E0771-dCas9-VP64 cells with CRISPRa AAVs carrying a small pool of sgRNAs targeting genes including Cd70, Cd80, and Cd86 (FIG. 32A). Furthermore, by introducing a model antigen transgene (chicken ovalbumin, OVA) driven by a PGK promoter into E0771-dCas9-VP64 cells, it was confirmed that PGK promoter-targeted sgRNAs delivered by AAV can significantly increase the presentation of processed antigenic peptide on the cell surface, as revealed by flow cytometry staining with antibody specific to the complex of SIINFEKL peptide bound to class I major histocompatibility complex (pMHC-I) (FIG. 32B-32C).

Figure 2F:
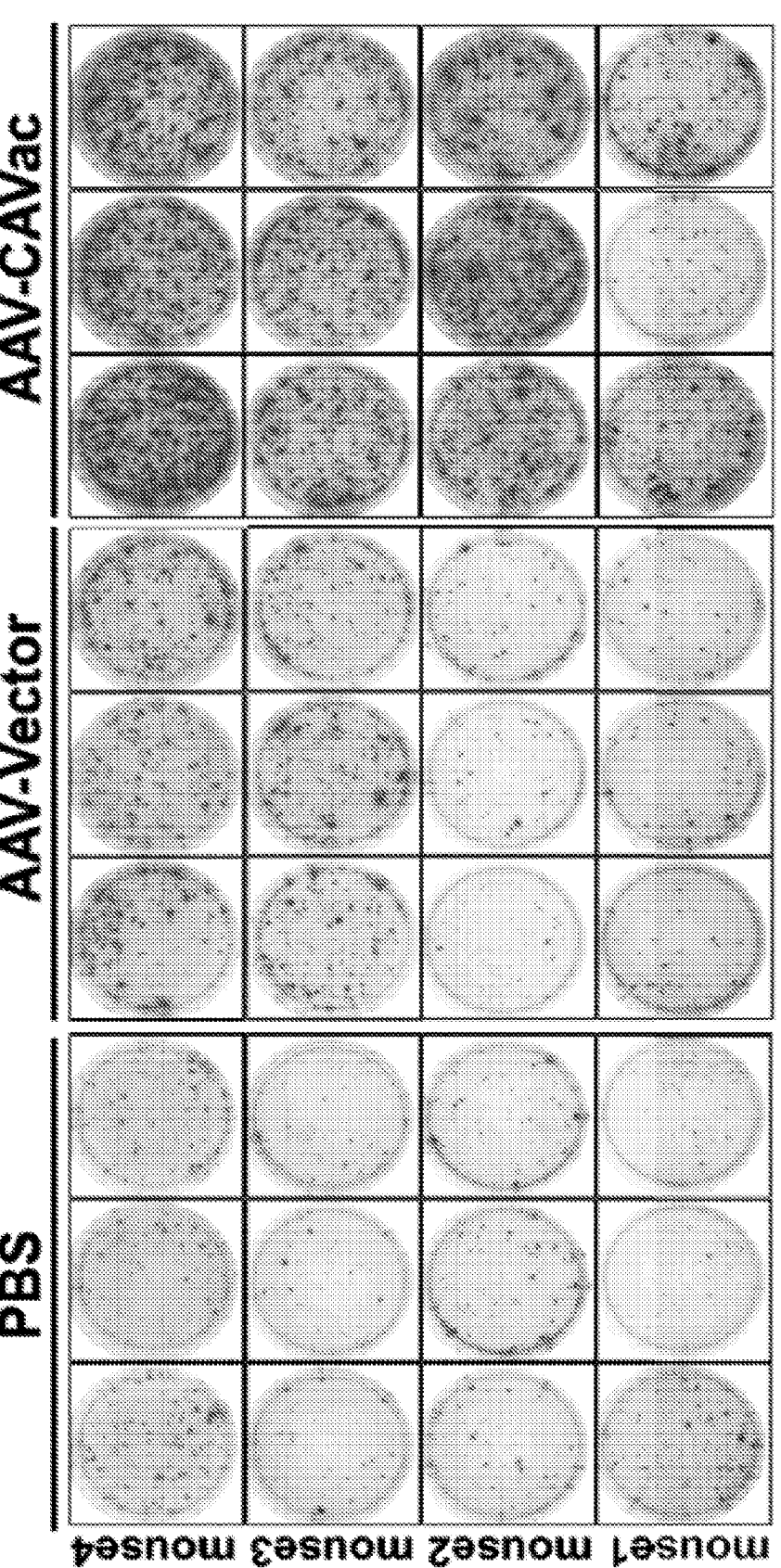
Figure 2G:
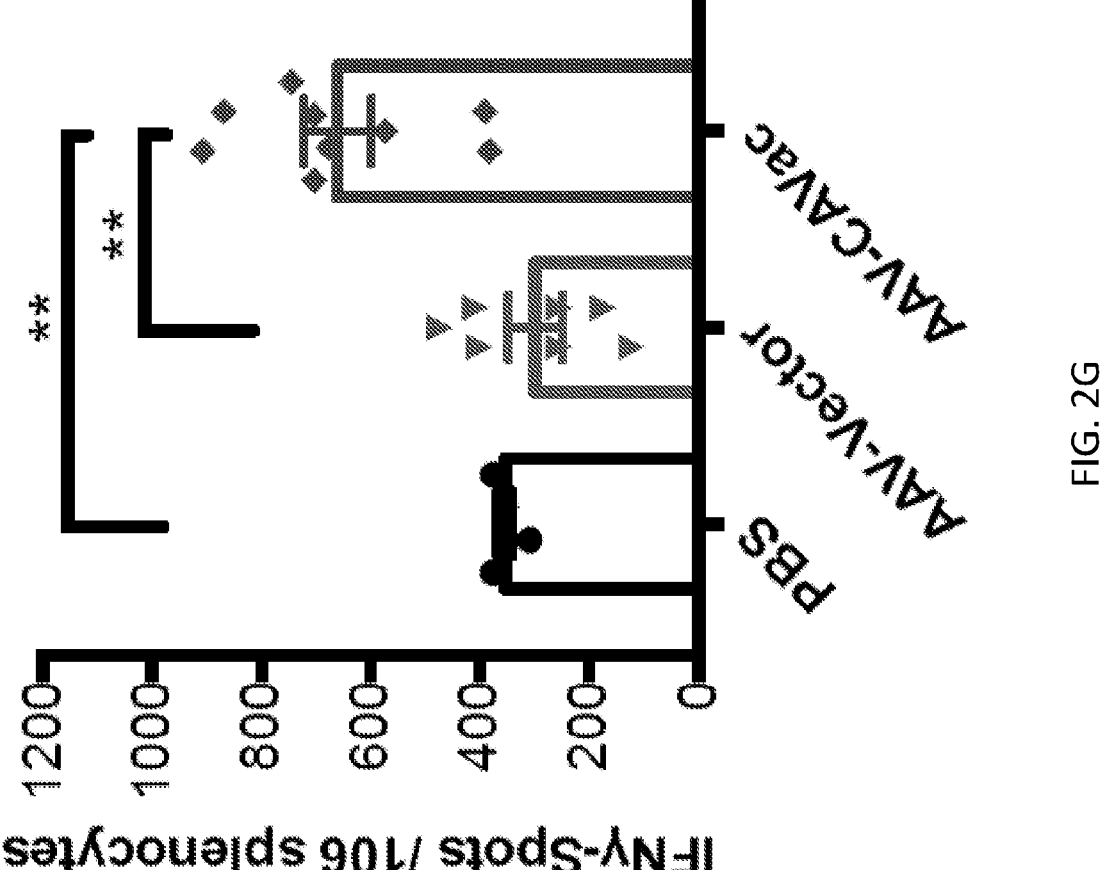

C57BL/6J mice bearing syngeneic orthotopic E0771 tumors were then treated with AAV-g-MAEGI by intratumoral administration (FIG. 2A). AAV-g-MAEGI was significantly more efficacious compared to either AAV-Vector or PBS (FIG. 2B). Of note, the AAV-Vector treatment also showed a significant effect against tumors in the E0771 model (viral vector with EF1α-MPH and U6-sgRNABackbone-MS2), but was nevertheless significantly weaker than AAV-g-MAEGI (FIG. 2A). CD8$^+$ T cell infiltration into the tumors was observed by histology and immunohistochemistry (FIG. 33A-33B). AAV-g-MAEGI elicited higher frequencies of tumor-reactive immune cells in treated mice (in terms of the frequencies of IFNγ producing splenocytes stimulated by tumor antigens) compared to AAV-Vector or PBS (FIGS. 2F-2G). No difference was observed in the frequencies of tumor-reactive IFNγ-secreting splenocytes between PBS and AAV-Vector (FIG. 2G). These data demonstrated that multiplexed in situ activation of endogenous genes by AAV-g-MAEGI can elicit robust and specific anti-tumor immune responses.

To test the broader utility of MAEGI, the same modality for treatment of other highly aggressive tumor types was tested. On a syngeneic melanoma mouse model (B16F10, expressing dCas9-VP64), AAV-g-MAEGI again demonstrated significant efficacy (FIG. 2C). Additionally, the efficacy of AAV-g-MAEGI in a syngeneic model of pancreatic cancer was tested using the Pan02 cell line. Against established Pan2-dCas9-VP64 tumors, AAV-Vector again had an anti-tumor effect compared to PBS, while AAV-g-MAEGI had significantly stronger efficacy against these tumors, both compared to AAV-Vector and to PBS (FIG. 25). To assess the infection rate of intratumoral AAV delivery, the experiments were repeated using titer-matched AAVs containing a GFP reporter. Four days following intratumoral AAV injection, tumor cells, tumor-infiltrating immune cells (TIICs, CD45$^+$), and cells from non-tumor organs were harvested. Analysis of GFP expression by flow cytometry revealed that the cancer cells were transduced by AAV in all tumors injected (12/12, 100%), with an infection rate of 4.2±0.51% (mean±s.e.m.) for tumor cells, reflecting a local injection (FIG. 33C). In contrast, 25% (4/12) of injected tumors showed above-background transduction in pan-immune (CD45$^+$) cells, with an infection rate of 0.74±0.25% (FIG. 33C). The off-target infection rate for the spleen, liver, lung and heart in the same cohort of mice was 0±0%, 0.04±0.04%, 0.18±0.06% and 0.11±0.08%, respectively (FIG. 33D). These data together demonstrated that in situ MAEGI by AAV-mediated delivery of a genome-scale CRISPRa library elicits host immune responses against established tumors across multiple aggressive cancer types, with minimal effect on non-cancer cells and other off-target organs.

Example 15: Multiplexed In Situ Activation of Tumor-Specific Mutated Gene Sets as a Precision Immunotherapy Since individual tumors have their own unique mutation profiles that distinguish them from normal tissues, the MAEGI approach was customized to tumor-specific mutated gene sets. This approach was termed precision MAEGI (p-MAEGI or PCAVac, which are used interchangeably herein) (FIG. 4A). By customizing the AAV library to tumor-specific mutant genes, it was hypothesized that the precision version could both enrich for potentially antigenic mutants as well as exclude genes that could cause adverse effects. Whole-exome sequencing of the E0771 cancer cells was performed and all SNPs, insertions and deletions (indels) in annotated genes were called, by comparison to healthy mammary fat pad cells from wildtype C57BL/6J mice that were sequenced in parallel (FIG. 4A). The exome sequencing data revealed the E0771-specific mutation profile (FIGS. 4B-4C). The differential mutation data was then harnessed for CRISPRa sgRNA library design, generating a library of 3,839 activating sgRNAs (SEQ ID NOs: 349-4, 187) targeting 1,116 E0771-mutated genes. The library was synthesized and pool-cloned. Successful cloning was verified by Illumina sequencing, and the AAV pool was produced as an E0771-specific precision MAEGI (E0771 AAV-p-MAEGI or E0771 AAV-PCAVac, used interchangeably herein).

Figures 4M, 4N, 4O:
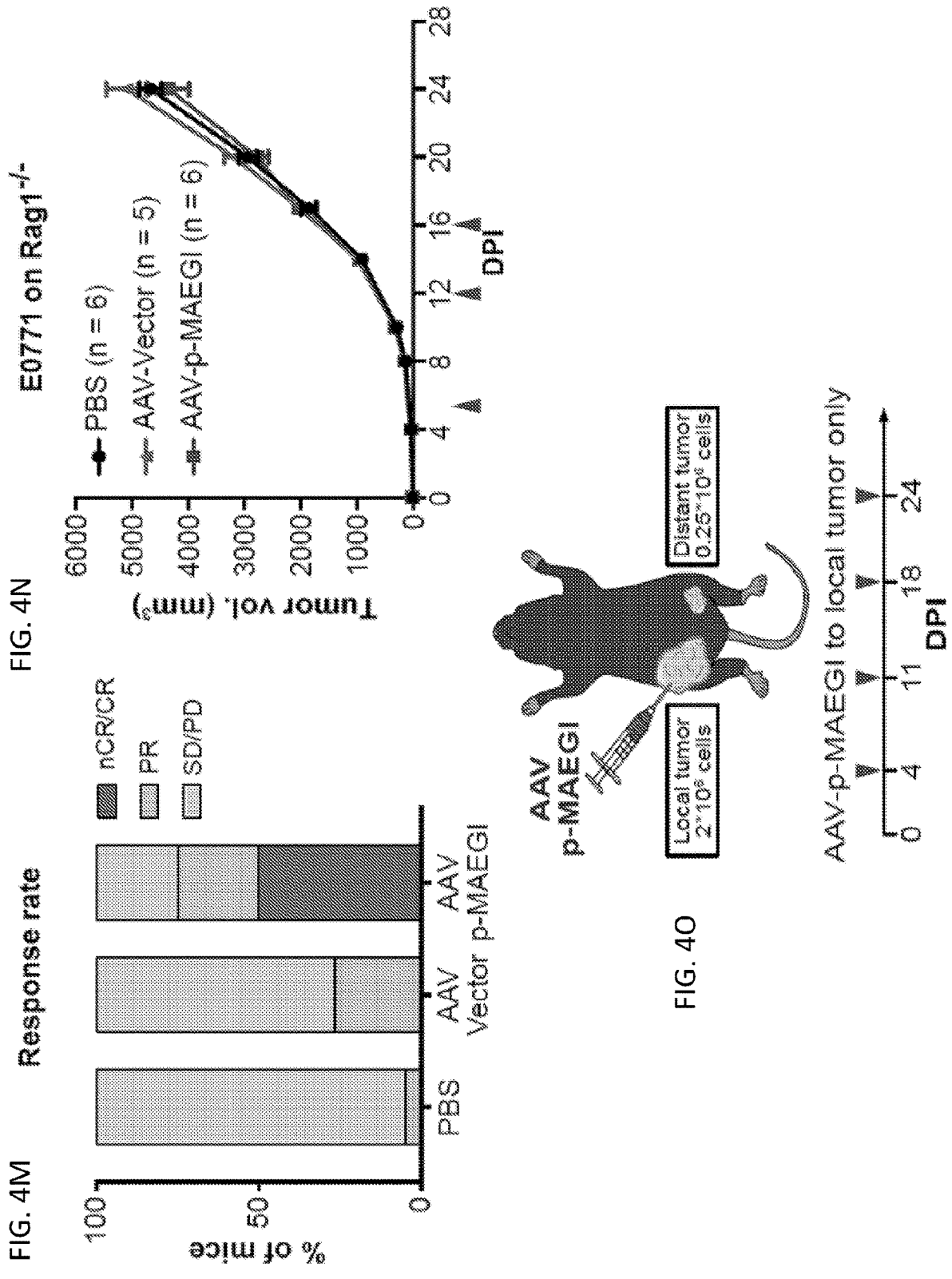
FIG. 4M shows response rates for PBS, AAV-Vector, or AAV-PCAVac (AAV-p-MAEGI) treatments, categorized by near-complete or complete response (nCR/CR), partial response (PR), or stable/progressive disease (SD/PD).
FIG. 4N shows growth curves of E0771 syngeneic tumors in $Rag1^{-/-}$ mice treated by PBS (n=6), AAV-Vector (n=5), or AAV-PCAVac (AAV-p-MAEGI) (n=6). AAV-PCA- Vac (AAV-p-MAEGI) was ineffective against established E0771 tumors in immunodeficient $Rag1^{-/-}$ mice by intratumoral administration at indicated times (arrows). Two-way ANOVA: AAV-Vector vs. PBS, p=0.0653; AAV-PCAVac vs. PBS, p=0.6982; AAV-p-MAEGI vs. AAV-Vector, p=0.0634.
FIG. 4O is a schematic of an experimental design for evaluating the induction of systemic anti-tumor immunity by AAV-p-MAEGI. $2\times10^6$ or $0.25\times10^6$ E0771 tumor cells were respectively transplanted into the left or right flank of C57BL/6J mice to model a local and a distant tumor. AAV-p-MAEGI was administered only into the local tumors at the indicated times (arrows).

C57BL/6J mice bearing E0771 syngeneic orthotopic TNBC were treated with AAV-p-MAEGI, along with AAV-Vector and PBS controls. While the AAV-vector itself showed anti-tumor effects as compared to PBS, AAV-p-MAEGI exhibited dramatic efficacy compared to both AAV-Vector and PBS (FIG. 4E), indicating that the mutant gene-specific CRISPRa sgRNAs generated potent anti-tumor responses. The complete response (CR) and near-complete (nCR) rates were determined for each treatment, which revealed a combined nCR/CR rate of 0% for PBS, 0% for AAV-Vector, and 50% for AAV-p-MAEGI (FIG. 4M). Three months after the initial tumor transplantation, 9 AAV-p-MAEGI treated mice that had undergone complete response were re-challenged. All (9/9) mice completely rejected the E0771 tumor re-challenges (FIG. 4F). The complete response of AAV-p-MAEGI treated mice retained a long-term benefit for over 180 days as the end of experiment (FIG. 4F). These data indicated that AAV-p-MAEGI had induced potent and durable anti-tumor responses.

The efficacy of AAV-p-MAEGI was completely abolished in immunodeficient hosts, as evidenced by near-identical growth curves of all treatment groups in Rag1−/− mice (FIG. 4N), indicating that the adaptive immune system is essential for the anti-tumor effect of AAV-p-MAEGI. Consistent with this, CD8$^+$ T cell infiltration into tumors was observed by histology and immunohistochemistry (FIGS. 34A-34B).

Figures 4P, 4Q:
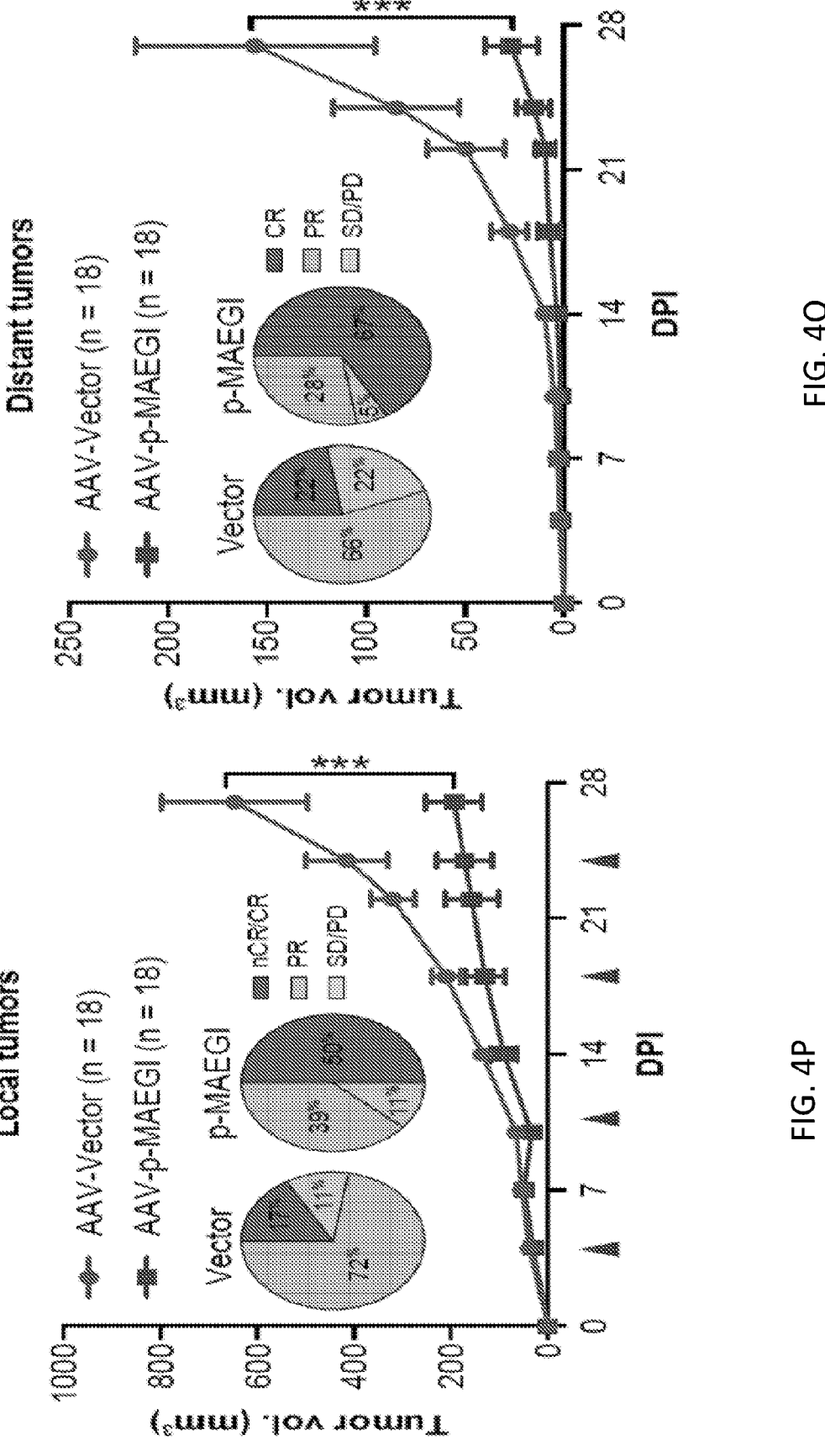

AAV-p-MAEGI treated tumors also showed reduced proliferation (FIGS. 34C-34D). Given the importance of adaptive immunity in driving these anti-tumor responses, it was investigated whether intratumoral delivery of AAV-p-MAEGI could elicit systemic anti-tumor immunity to affect distant sites (FIG. 4O). In a syngeneic model of E0771 TNBC where mice bear both local and distant mammary fat pad tumors, after administration of AAV-p-MAEGI only to local tumors, significant anti-tumor effects against both local tumors and distant tumors were observed, which had not been directly infected by AAV-p-MAEGI (FIGS. 4P-4Q). A 67% complete response rate was observed at distant tumors under AAV-p-MAEGE treatment (FIG. 4Q). These data demonstrated that AAV-p-MAEGI treatment had successfully galvanized systemic anti-tumor immune responses.

Example 16: AAV-p-MAEGI Recruits Active T Effector Cells into Tumors

To examine the T cell adaptive immune responses over a time-course, flow cytometry analysis of tumor-infiltrating T cell populations was performed at several time points (FIG. 35A). AAV-p-MAEGI treatment significantly augmented CD4$^+$ and CD8$^+$ T cell tumor infiltration as compared to AAV-Vector or PBS treatment, with significantly increased CD8$^+$ T cells and CD4$^+$ T cells from day 29 onwards (FIGS. 36A-36B). Other immune cell populations were examined at day 19, as this is the time point with initial observation of striking tumor regression (FIG. 35B). The results showed that AAV-p-MAEGI treatment increased the fraction of MHC-II$^+$ antigen-presenting cells over AAV-Vector treatment (FIG. 36C), with a trend of increased dendritic cells (FIG. 36D), but no significant changes in macrophages, monocytes, or neutrophil abundance (FIGS. 36E-36G). These data together revealed that AAV-p-MAEGI treatment increased T cell infiltration into tumors and changed the composition of certain infiltrating immune cells, ultimately resulting in tumor regression.

Given these findings, it was next investigated whether the adaptive immune responses induced by AAV-p-MAEGI were tumor-specific. By performing ELISPOT on splenocytes taken from E0771 tumor-bearing mice, it was observed that AAV-p-MAEGI significantly augmented the frequencies of tumor-reactive IFNγ producing splenocytes compared to PBS and AAV-vector treated mice (FIG. 36H-36J). To test whether these stimulated immune cells are specific to the endogenous tumor antigens but not healthy normal tissues, E0771 tumor-bearing mice were again treated with AAV-p-MAEGI or AAV-Vector. ELISPOT assays were performed on both splenocytes and fluorescence activated cell sorting (FACS)-isolated tumor-infiltrating immune cells (TIICs), stimulated with either E0771 cancer cells or matched normal tissues (primary C57BL/6J wildtype cells isolated from mammary fat pad)(FIG. 36H). In both AAV-Vector and AAV-p-MAEGI conditions, the ELISPOT assays showed significantly higher IFNγ-producing splenocytes and TIICs after stimulation by E0771 tumor cells, as compared to stimulation with normal primary cells (FIG. 36K-36N). Importantly, within the E0771-stimulated experimental groups, AAV-p-MAEGI treated mice had significantly higher frequencies of IFNγ-secreting immune cells than AAV-Vector treated mice. This effect was particularly pronounced in TIICs, where AAV-p-MAEGI significantly augmented the frequencies of IFNγ-secreting immune cells in response to E0771 stimulation, but not to matched normal cells (FIG. 36M-36N). The anti-tumor specificity of AAV-p-MAEGI was similarly observed in splenocytes (FIG.

36K-36L). These results demonstrated that tumor-antigen specific immune responses were elicited by AAV-p-MAEGI.

Example 17: AAV-p-MAEGI Remodels the Host Tumor Microenvironment

To understand the repertoire of T cells recruited by MAEGI, T cell receptor sequencing (TCR-seq) was performed to profile the TCR repertoire in mice treated with AAV-p-MAEGI, AAV-g-MAEGI, AAV-Vector or PBS (FIG. 37A). TCR clonal proportion was assessed and various metrics were calculated (FIG. 37B-37D). In comparison to PBS or AAV-Vector, AAV-p-MAEGI significantly increased TCR diversity in both spleens and TILs as measured by the Chao1 index (FIG. 37C). In comparison to AAV-g-MAEGI treated mice (genome-wide AAV-MAEGI), splenocytes from AAV-p-MAEGI treated mice (precision AAV-MAEGI) had higher Chao1 indices, with no significant difference among TILs (FIG. 37C). Next, the Gini-Simpson indices were calculated, which quantify the evenness of TCR clonal abundances. While there were no significant differences among spleen samples from differing treatment conditions, TILs from AAV-p-MAEGI treated mice had significantly higher Gini-Simpson indices compared to PBS or AAV-Vector treated mice, but not compared to AAV-g-MAEGI treated mice. Intrigued by the increased TCR diversity and clonal evenness among TILs from AAV-p-MAEGI treated mice, it was investigate whether these changes were due to differences in T cell infiltration. The number of unique CDR3 clonotypes identified in each sample (i.e. TCR richness) were examined (FIG. 35C). AAV-p-MAEGI mice had significantly more unique clonotypes than PBS or AAV-Vector samples in both spleen and TIL samples (FIGS. 37E-37F). Collectively, the TCR-sequencing data affirmed the conclusion from the flow cytometry analysis that AAV-p-MAEGI significantly enhanced T cell infiltration into tumors, while additionally revealing the richness and diversity of these tumor-infiltrating T cells.

To further investigate the effect of AAV-p-MAEGI on the tumor microenvironment, single cell RNA sequencing (scR-NAseq) was performed to profile the composition of TIICs, and simultaneously, their gene expression signatures (FIG. 38A). From single cell suspension of tumors, total TIICs were isolated by FACS of CD45$^+$ cells and scRNAseq was performed, recovering a total of 4,381 cells from AAV-p-MAEGI and 3,482 cells from AAV-Vector treated mice (n=3 mice pooled for each condition). After filtering low-quality cells and lowly-expressed genes, imputation and k-means clustering were performed to identify a total of 9 distinct clusters. Analysis of differentially expressed genes in each cluster revealed the cell type identities of each cluster (FIG. 38B and FIGS. 39A-39F). After excluding a population of cells (k-means cluster 7, or k7) that were negative for Cd45 gene expression (encoded by Ptprc) (FIG. 39A-39B), the final dataset of TIICs comprised the transcriptomes of 4,065 single cells from AAV-p-MAEGI and 2,799 cells from AAV-Vector treated mice (FIG. 38C).

Given that the flow cytometry data and TCR-seq analyses had both identified increased T cell tumor infiltration with AAV-p-MAEGI compared to AAV-Vector, it was investigated whether these findings were recapitulated by scR-NAseq at a global scale. To perform in silico analysis on T cell populations, mRNA transcript expression levels were filtered ("mRNA-gated") on cells in k6 or k9, as these clusters comprise the cells that robustly express Cd3e, Cd4, and Cd8a (FIG. 39C). Examining the Cd3e+ cells within k6 and k9, the cells were mRNA-gated into Cd8a$^+$Cd4$^-$ and Cd4$^+$Cd8a$^-$ populations. Visualization of these cell groups by t-SNE dimensional reduction revealed clear separation of putative CD8$^+$ T cells (defined by Cd8a$^+$Cd3e$^+$Cd4$^-$ mRNA gating) from CD4$^+$ T cells (defined by Cd4$^+$Cd3e$^+$Cd8a$^-$ mRNA gating) (FIG. 38D). The relative abundance of these different T cell populations in k6 and k9 were quantified, revealing that AAV-p-MAEGI mice had significantly more Cd3e$^+$ T cells, putative CD8$^+$ T cells, and putative CD4$^+$ T cells (FIG. 38E). Furthermore, among these putative CD4$^+$ T cells, AAV-p-MAEGI treated mice had increased abundance of Tbx21$^+$, Ifng$^+$, and Tbx21$^+$Ifng$^+$ cells, indicative of anti-tumor Th1 cells (FIG. 38F). Thus, the single cell transcriptomic analyses on the global TIICs reaffirmed the earlier cell type specific observations by FACS and TCR-seq, that AAV-p-MAEGI promotes T cell tumor infiltration.

To investigate whether AAV-p-MAEGI treatment led to transcriptomic changes in tumor-infiltrating T cells, differential expression analyses were performed to compare T cells from AAV-p-MAEGI and AAV-Vector treated mice. Among the putative CD8$^+$ T cells in k6 (characterized by higher Gzmb expression compared to k9) (FIG. 39C), 267 upregulated and 753 downregulated genes were identified in AAV-p-MAEGI treated mice compared to AAV-Vector (FIG. 40A). Gene ontology analysis revealed enrichment of several T cell signatures within the upregulated gene set, including adaptive immunity, T cell activation, and the T cell receptor complex. Interestingly, the strongest enriched gene set was the AIG1 family of GTPases, particularly Gimap genes (GTPases of immunity-associated protein). Gimap proteins are known to play critical roles in T cell activation and survival. As for the putative CD8$^+$ T cells in k9, 665 genes were upregulated and 80 genes downregulated with AAV-p-MAEGI treatment (FIG. 40B). Enriched gene ontologies in the upregulated gene set included mitochondrion, exosome, proteasome, RNA-binding, adaptive immunity, ribonucleoprotein, AIG1/Gimaps, and rRNA processing. The same analysis was performed on putative CD4$^+$ T cells, revealing 335 upregulated and 65 downregulated genes with AAV-p-MAEGI treatment (FIG. 40C). AAV-p-MAEGI upregulated gene ontologies in putative CD4$^+$ T cells included the proteasome, extracellular exosome, poly (A) RNA binding, mitochondrion, splicosome, and ribonucleoprotein. Collectively, the scRNAseq data further refined the mechanism of action that AAV-p-MAEGI increased T cell tumor infiltration, additionally revealing significant transcriptomic changes in TILs following MAEGI treatment.

Example 18: Comparison to RNA or Peptide Neoantigen Vaccines

Current state-of-the-art approaches to target tumor neoantigens are largely focused on delivering mutant RNAs or peptides to lymphatic tissues. The AAV-MAEGI approach is not directly comparable to these neoantigen vaccines, as AAV-MAEGI directly amplifies tumor immunogenicity by intratumoral injection. Nevertheless, under the intratumoral/in situ treatment scheme, experiments were performed to compare AAV-mediated CRISPRa gene activation with AAV-mediated mutant mini-ORF expression (the closest analog to RNA or peptide vaccines while still maintaining the mode of delivery). Notably, the mutant mini-ORF strategy has been adopted by some biotech startups, using viral vectors such as oncolytic viruses.

Interestingly, in the same E0771 syngeneic model (FIG. 41), the data indicates that while AAV-MAEGI is highly efficacious (FIG. 41, left panel), intratumoral delivery of the predicted top 20 mutant mini-ORFs by AAV (AAV-20Mu-tORF) is not more effective than AAV-Vector alone. One may wonder if >1,000 mutant ORFs could be used for a closer comparison to AAV-p-MAEGI, but doing so is currently impractical because ~50 different AAV-ORF constructs each with 20 peptide-encoding CDSs would have to be created. Similar issues regarding scalability would apply to mRNA ORFs (also needs ~50 mRNA constructs) or synthetic peptides (>1000 constructs)—both well beyond the realm of clinical feasibility. However, the AAV-MAEGI approach is highly scalable, because sgRNAs can be synthesized as a pool and generated as one mixed product, as demonstrated herein. This supports the promise of AAV-MAEGI as a new approach, with multiple advantages over existing neoantigen-based approaches.

Example 19: Comparison to Other Intratumoral Approaches to Amplify Tumor Cell Immunogenicity Several other approaches for directly amplifying tumor cell immunogenicity have been described in the literature. However, none can match the flexibility and scalability of the CRISPR-based MAEGI approach. To evaluate the importance of library size (and hence scalability) in the anti-tumor efficacy of AAV-MAEGI, AAV-g-MAEGI (exome-wide library) was directly compared with a mini-pool MAEGI (AAV-mini-MAEGI) in the B16F10 syngeneic model. AAV-g-MAEGI outperformed AAV-mini-MAEGI (targeting the same 15 genes chosen based on predicted antigenicity for prior B16F10 melanoma vaccines) (FIG. 42). Indeed, the antigen/expression-based mini-pool showed some initial efficacy, but the effect rapidly disappeared as the tumors grew (with similar growth curves as AAV-Vector), possibly due to immune escape of the 15 selected antigens. In contrast, the broader AAV-g-MAEGI library showed stronger and more sustained efficacy.

Moreover, experiments targeting a small set of mutated genes for the E0771 model (Emut11, carrying an sgRNA library targeting the top 11 mutant genes in E0771) were also performed. As the data in FIG. 43 illustrates, reduced efficacy was observed with Emut11 (right panel, only 20% nCR/CR rate), as compared to strong efficacy with E0771-p-MAEGI carrying an sgRNA library targeting 1,116 mutant genes (left panel, 50% nCR/CR rate).

Therefore, the ability to target a larger number of mutant genes is key for optimally accessing the maximal efficacy space. While this quickly becomes impractical for traditional mRNA/peptide/CDS approaches, it is readily feasible with the CRISPRa approaches disclosed herein by scaling the desired number of sgRNAs in the library, up to the entire genome.

Example 20: Dual-AAV Delivery

It was demonstrated herein that dual-AAV delivery into fully un-modified parental E0771 cells can mediate activation of endogenous genes (FIGS. 44A-44B). This was achieved using two different AAV serotypes: both AAV9 and AAV-DJ (FIGS. 44A-45).

A dual AAV system for in vitro and in vivo delivery of MAEGI was developed herein. The dual AAV vector system of CRISPR activation (AAV-dCas9, i.e. EFs-dSpCas9-spA; and AAV-CRISPRa vector, i.e. U6p-sgSapI-EF1a-MS2-p65-HSF1-WPRE), was generated by restriction cloning and Gibson assembly. Individual sgRNA or sgRNA libraries were cloned into the AAV-CRISPRa plasmid. dCas9 or U6-sgRNA-EF1a-MS2-p65-HSF1 expressing AAVs produced using the methods as described in detail elsewhere herein. For in vitro and in vivo delivery, AAV-dCas9 and AAV-CRISPRa were simultaneously added into cultured cells or co-injected into tumors at a ratio of 1:1.

Syngeneic TNBC were established by orthotopic transplantation of $2 \times 10^6$ E0771 cells into the mammary fat pad of 5-8 weeks old female C57BL/6J mice. 4, 9 (or 11) and 18 days after tumor induction, $1-5 \times 10^{10}$ GCs of AAV-dCas9, together with same titers of AAV-p-MAEGI or AAV-Vector, or PBS were intratumorally administrated into tumor-bearing mice. Tumors were measured every 3-4 days using caliper and sizes were calculated with the formula: $Vol = \pi / 6 * x * y * z$. Two-way ANOVA was used to compare growth curves between treatment groups.

Dual-AAV delivery of a personalized library (AAV-PCA-Vac, i.e. AAV-p-MAEGI) into fully un-modified parental E0771 cells mediated anti-tumor activity in vivo in C57B/6 mice (FIG. 46).

It was also demonstrated that dual-AAV delivery of an APCM library into fully un-modified parental E0771 cells can mediate anti-tumor activity in vivo in C57BL/6 mice (FIG. 47).

Example 21: AAV Infectivity In Vivo by Serotypes

AAV infection efficiency across serotypes was assessed by intratumoral delivery of GFP-expressing AAVs and flow cytometry analysis (FIG. 48). Percentage of GFP$^+$ cells within tumors from mice 4 days after intratumoral injection of PBS (n=3) or AAV-GFP (n=12), was grouped by CD45+ and CD45$^-$ cells. The background GFP fluorescence was set as the maximum % GFP positivity in PBS samples, denoted by a dashed line. Fractions above AAV conditions denote the number of samples with % GFP positivity above background in the indicated cell population. The data demonstrated that in vivo infectivity across different AAV serotypes was similar (FIG. 48).

Other Embodiments

The recitation of a listing of elements in any definition of a variable herein includes definitions of that variable as any single element or combination (or subcombination) of listed elements. The recitation of an embodiment herein includes that embodiment as any single embodiment or in combination with any other embodiments or portions thereof.

It is to be understood that wherever values and ranges are provided herein, all values and ranges encompassed by these values and ranges, are meant to be encompassed within the scope of the present invention. Moreover, all values that fall within these ranges, as well as the upper or lower limits of a range of values, are also contemplated by the present application.

The disclosures of each and every patent, patent application, and publication cited herein are hereby incorporated herein by reference in their entirety. While this invention has been disclosed with reference to specific embodiments, it is apparent that other embodiments and variations of this invention may be devised by others skilled in the art without departing from the true spirit and scope of the invention. The appended claims are intended to be construed to include all such embodiments and equivalent variations.

Lengthy table referenced here

US12678493-20260714-T00001

Please refer to the end of the specification for access instructions.

Lengthy table referenced here

US12678493-20260714-T00002

Please refer to the end of the specification for access instructions.

LENGTHY TABLES

The patent contains a lengthy table section. A copy of the table is available in electronic form from the USPTO web site (https://seqdata.uspto.gov/docdetail?docId=US12678493B2). An electronic copy of the table will also be available from the USPTO upon request and payment of the fee set forth in 37 CFR 1.19(b)(3).

SEQUENCE LISTING (24116 sequences)

SEQ ID NO: 1 - DNA, 20 bp, Artificial Sequence
  sgRNA
ggcggggaggggttgggggc

SEQ ID NO: 2 - DNA, 20 bp, Artificial Sequence
  sgRNA
atgtctcctgcctgaaggtc

SEQ ID NO: 3 - DNA, 20 bp, Artificial Sequence
  sgRNA
caggatgcaggcagtggccc

SEQ ID NO: 4 - DNA, 20 bp, Artificial Sequence
  sgRNA
caactgcctccacccacttt

SEQ ID NO: 5 - DNA, 20 bp, Artificial Sequence
  sgRNA
atgtccggccggtcgagggg

SEQ ID NO: 6 - DNA, 20 bp, Artificial Sequence
  sgRNA
tcagactggcagcggttgga

SEQ ID NO: 7 - DNA, 20 bp, Artificial Sequence
  sgRNA
ggcaactctgaggctcaccc

SEQ ID NO: 8 - DNA, 20 bp, Artificial Sequence
  sgRNA
gggacttgagcaattggcga

SEQ ID NO: 9 - DNA, 20 bp, Artificial Sequence
  sgRNA
ttctcctcccctaggccgcc

SEQ ID NO: 10 - DNA, 20 bp, Artificial Sequence
  sgRNA
gcctccctcaccaccgtgca

SEQ ID NO: 11 - DNA, 20 bp, Artificial Sequence
  sgRNA
gcttttgtagaggctgtggc

SEQ ID NO: 12 - DNA, 20 bp, Artificial Sequence
  sgRNA
caaacaccctgtccaactcc

SEQ ID NO: 13 - DNA, 20 bp, Artificial Sequence
  sgRNA
tagaagaagacggcagcaga

SEQ ID NO: 14 - DNA, 20 bp, Artificial Sequence
  sgRNA
aatggtgcccgagaagagtg

SEQ ID NO: 15 - DNA, 20 bp, Artificial Sequence
  sgRNA
catgaaacaccacgagcacc

SEQ ID NO: 16 - DNA, 20 bp, Artificial Sequence
  sgRNA
ttaaagaaagttagctgggt

SEQ ID NO: 17 - DNA, 20 bp, Artificial Sequence
  sgRNA
gagtttaaactgcaaggaaa

SEQ ID NO: 18 - DNA, 20 bp, Artificial Sequence
  sgRNA
tcaaaatctgtagagaaaag

SEQ ID NO: 19 - DNA, 20 bp, Artificial Sequence
  sgRNA
ttaaatttcttcctcaagtg

SEQ ID NO: 20 - DNA, 20 bp, Artificial Sequence
  sgRNA
gctcatcttaacgtcatgtc

SEQ ID NO: 21 - DNA, 20 bp, Artificial Sequence
  sgRNA
ctccctttgggggtttccca

SEQ ID NO: 22 - DNA, 20 bp, Artificial Sequence
  sgRNA
agagaaacaacaccacagcc

SEQ ID NO: 23 - DNA, 20 bp, Artificial Sequence
  sgRNA
ctttgtcatgtttgtggatg

SEQ ID NO: 24 - DNA, 20 bp, Artificial Sequence
  sgRNA
ccaagcaagagcactgtccc

SEQ ID NO: 25 - DNA, 20 bp, Artificial Sequence
  sgRNA
tccaaataacttctgccggc

SEQ ID NO: 26 - DNA, 20 bp, Artificial Sequence
  sgRNA
tttgtagtcattctcatcag

SEQ ID NO: 27 - DNA, 20 bp, Artificial Sequence
  sgRNA
gctttacactcatgctccga

SEQ ID NO: 28 - DNA, 20 bp, Artificial Sequence
  sgRNA
gaagactttgctctgtgcat

SEQ ID NO: 29 - DNA, 20 bp, Artificial Sequence
  sgRNA
tatttttcacctgcactcaa

SEQ ID NO: 30 - DNA, 20 bp, Artificial Sequence
  sgRNA
caactagggaatttagaaaa

SEQ ID NO: 31 - DNA, 20 bp, Artificial Sequence
  sgRNA
tgaaagggagaagtgaaagt

SEQ ID NO: 32 - DNA, 20 bp, Artificial Sequence
  sgRNA
atggtcctctctctattcag

SEQ ID NO: 33 - DNA, 20 bp, Artificial Sequence
  sgRNA
agagtttcctttagactcct

SEQ ID NO: 34 - DNA, 20 bp, Artificial Sequence
  sgRNA
taaataccagcagccagagg

SEQ ID NO: 35 - DNA, 20 bp, Artificial Sequence
  sgRNA
atcctcaggagacttcaatt

SEQ ID NO: 36 - DNA, 20 bp, Artificial Sequence
  sgRNA
aactaaggttttgtggcatt

SEQ ID NO: 37 - DNA, 20 bp, Artificial Sequence
  sgRNA
aagatgagatggtgacagat

SEQ ID NO: 38 - DNA, 17 bp, Artificial Sequence
  primer
cgggttccgtggaaagg

SEQ ID NO: 39 - DNA, 25 bp, Artificial Sequence
  primer
ttctattctaagcctcatgttggcc

SEQ ID NO: 40 - DNA, 18 bp, Artificial Sequence
  primer
gtttatcgggcggaaagg

SEQ ID NO: 41 - DNA, 24 bp, Artificial Sequence
  primer
ggtacagtaagtctcatgttggcc

SEQ ID NO: 42 - DNA, 19 bp, Artificial Sequence
  primer
accgatgttgacggaaagg

SEQ ID NO: 43 - DNA, 23 bp, Artificial Sequence
  primer
gctattacgagctcatgttggcc

SEQ ID NO: 44 - DNA, 21 bp, Artificial Sequence
  primer
gaggtctttcatgcggaaagg

SEQ ID NO: 45 - DNA, 21 bp, Artificial Sequence
  primer
tatgttgtgctcatgttggcc

SEQ ID NO: 46 - DNA, 60 bp, Artificial Sequence
  primer
taacttgaaagtatttcgatttcttggctttatatatcttgtggaaaggacgaaacaccg

SEQ ID NO: 47 - DNA, 60 bp, Artificial Sequence
  primer
actttttcaagttgataacggactagccttattttaacttgctatttctagctctaaaac

SEQ ID NO: 48 - DNA, 60 bp, Artificial Sequence
  primer
attttaacttgctaggccctgcagacatgggtgatcctcatgttggcctagctctaaaac

SEQ ID NO: 49 - DNA, 6167 bp, Artificial Sequence
  vector
cctgcaggcagctgcgcgctcgctcgctcactgaggccgcccgggcaaagcccgggcgtcgggcgacctttggtcgcccggcctcagtgagcgagcgagcgcgcagagagggagtggccaactccatcactaggggttcctgcggccgcagggacccagagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccggaagagcgagctcttctgttttagagctaggccaacatgaggatcacccatgtctgcagggcctagcaagttaaaataaggctagtccgttatcaacttggccaacatgaggatcacccatgtctgcagggccaagtggcaccgagtcggtgcttttttggatccaagcttggcgtaactagatcttgagacaaatgggacagcagagatccagtttggttaattagctagctgcaaagatggataaagttttaaacagagaggaatctttgcagctaatggaccttctaggtcttgaaaggagtgggaattggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatgaaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgacgtacggccaccatggcttcaaactttactcagttcgtgctcgtggacaatggtgggacaggggatgtgacagtggctccttctaatttcgctaatggggtggcagagtggatcagctccaactcacggagccaggcctacaaggtgacatgcagcgtcaggcagtctagtgcccagaagagaaagtataccatcaaggtggaggtccccaaagtggctacccagacagtgggcggagtcgaactgcctgtcgccgcttggaggtcctacctgaacatggagctcactatcccaattttcgctaccaattctgactgtgaactcatcgtgaaggcaatgcaggggctcctcaaagacggtaatcctatcccttccgccatcgccgctaactcaggtatctacagcgctggaggaggtggaagcggaggaggaggaagcggaggaggaggtagcggacctaagaaaaagaggaaggtggcggccgctggatccccttcagggcagatcagcaaccaggccctggctctggcccctagctccgctccagtgctggcccagactatggtgccctctagtgctatggtgcctctggcccagccacctgctccagcccctgtgctgaccccaggaccaccccagtcactgagcgctccagtgcccaagtctacacaggccggcgaggggactctgagtgaagctctgctgcacctgcagttcgacgctgatgaggacctgggagctctgctggggaacagcaccgatcccggagtgttcacagatctggcctccgtggacaactctgagtttcagcagctgctgaatcagggcgtgtccatgtctcatagtacagccgaaccaatgctgatggagtaccccgaagccattacccggctggtgaccggcagccagcggccccccgaccccgctccaactcccctgggaaccagcggcctgcctaatgggctgtccggagatgaagacttctcaagcatcgctgatatggactttagtgccctgctgtcacagatttcctctagtgggcagggaggaggtggaagcggcttcagcgtggacaccagtgccctgctggacctgttcagcccctcggtgaccgtgcccgacatgagcctgcctgaccttgacagcagcctggccagtatccaagagctcctgtctccccaggagccccccaggcctcccgaggcagagaacagcagcccggattcagggaagcagctggtgcactacacagcgcagccgctgttcctgctggaccccggctccgtggacaccgggagcaacgacctgccggtgctgtttgagctgggagagggctcctacttctccgaaggggacggcttcgccgaggaccccaccatctccctgctgacaggctcggagcctcccaaagccaaggaccccactgtctcctaagaattcgatatcaagcttaataaaagatctttattttcattagatctgtgtgttggttttttgtgtggtaaccacgtgcggaccgagcggccgcaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcaggggcgcctgatgcggtattttctccttacgcatctgtgcggtatttcacaccgcatacgtcaaagcaaccatagtacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgatttgggtgatggttcacgtagtgggccatcgccctgatagacggtttttcgccctttgacgttggagtccacgttctttaatagtggactcttgttccaaactggaacaacactcaaccctatctcgggctattcttttgatttataagggattttgccgatttcggcctattggttaaaaaatgagctgatttaacaaaaatttaacgcgaattttaacaaaatattaacgtttacaattttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgt

SEQ ID NO: 50 - DNA, 6628 bp, Artificial Sequence
  vector
cctgcaggcagctgcgcgctcgctcgctcactgaggccgcccgggcaaagcccgggcgtcgggcgacctttggtcgcccggcctcagtgagcgagcgagcgcgcagagagggagtggccaactccatcactaggggttcctgcggccgcacgcgttctagaagagggcctatttcccatgattccttcatatttgcatatacgatacaaggctgttagagagataattggaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccggaagagcgagctcttctgttttagagctaggccaacatgaggatcacccatgtctgcagggcctagcaagttaaaataaggctagtccgttatcaacttggccaacatgaggatcacccatgtctgcagggccaagtggcaccgagtcggtgcttttttggatccaagcttggcgtaactagatcttgagacaaatgggacagcagagatccagtttggttaattagggacccagagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccgagagttctgaatcagggtggttttagagctaggccaacatgaggatcacccatgtctgcagggcctagcaagttaaaataaggctagtccgttatcaacttggccaacatgaggatcacccatgtctgcagggccaagtggcaccgagtcggtgcttttttggatccaagcttggcgtaactagatcttgagacaaatggctagctgcaaagatggataaagttttaaacagagaggaatctttgcagctaatggaccttctaggtcttgaaaggagtgggaattggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatgaaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgacgtacggccaccatggcttcaaactttactcagttcgtgctcgtggacaatggtgggacaggggatgtgacagtggctccttctaatttcgctaatggggtggcagagtggatcagctccaactcacggagccaggcctacaaggtgacatgcagcgtcaggcagtctagtgcccagaagagaaagtataccatcaaggtggaggtccccaaagtggctacccagacagtgggcggagtcgaactgcctgtcgccgcttggaggtcctacctgaacatggagctcactatcccaattttcgctaccaattctgactgtgaactcatcgtgaaggcaatgcaggggctcctcaaagacggtaatcctatcccttccgccatcgccgctaactcaggtatctacagcgctggaggaggtggaagcggaggaggaggaagcggaggaggaggtagcggacctaagaaaaagaggaaggtggcggccgctggatccccttcagggcagatcagcaaccaggccctggctctggcccctagctccgctccagtgctggcccagactatggtgccctctagtgctatggtgcctctggcccagccacctgctccagcccctgtgctgaccccaggaccaccccagtcactgagcgctccagtgcccaagtctacacaggccggcgaggggactctgagtgaagctctgctgcacctgcagttcgacgctgatgaggacctgggagctctgctggggaacagcaccgatcccggagtgttcacagatctggcctccgtggacaactctgagtttcagcagctgctgaatcagggcgtgtccatgtctcatagtacagccgaaccaatgctgatggagtaccccgaagccattacccggctggtgaccggcagccagcggccccccgaccccgctccaactcccctgggaaccagcggcctgcctaatgggctgtccggagatgaagacttctcaagcatcgctgatatggactttagtgccctgctgtcacagatttcctctagtgggcagggaggaggtggaagcggcttcagcgtggacaccagtgccctgctggacctgttcagcccctcggtgaccgtgcccgacatgagcctgcctgaccttgacagcagcctggccagtatccaagagctcctgtctccccaggagccccccaggcctcccgaggcagagaacagcagcccggattcagggaagcagctggtgcactacacagcgcagccgctgttcctgctggaccccggctccgtggacaccgggagcaacgacctgccggtgctgtttgagctgggagagggctcctacttctccgaaggggacggcttcgccgaggaccccaccatctccctgctgacaggctcggagcctcccaaagccaaggaccccactgtctcctaagaattcgatatcaagcttaataaaagatctttattttcattagatctgtgtgttggttttttgtgtggtaaccacgtgcggaccgagcggccgcaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcaggggcgcctgatgcggtattttctccttacgcatctgtgcggtatttcacaccgcatacgtcaaagcaaccatagtacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgatttgggtgatggttcacgtagtgggccatcgccctgatagacggtttttcgccctttgacgttggagtccacgttctttaatagtggactcttgttccaaactggaacaacactcaaccctatctcgggctattcttttgatttataagggattttgccgatttcggcctattggttaaaaaatgagctgatttaacaaaaatttaacgcgaattttaacaaaatattaacgtttacaattttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgt

SEQ ID NO: 51 - DNA, 20 bp, Artificial Sequence
  sgRNA
cagtctgaagatcctaaagt

SEQ ID NO: 52 - DNA, 20 bp, Artificial Sequence
  sgRNA
tctgaagatcctaaagtggg

SEQ ID NO: 53 - DNA, 20 bp, Artificial Sequence
  sgRNA
aatccctaataaatgtgcag

SEQ ID NO: 54 - DNA, 20 bp, Artificial Sequence
  sgRNA
tacttgcttcaacctgtcag

SEQ ID NO: 55 - DNA, 20 bp, Artificial Sequence
  sgRNA
ggacttgagcaattggcgag

SEQ ID NO: 56 - DNA, 20 bp, Artificial Sequence
  sgRNA
ccactttaggatcttcagac

SEQ ID NO: 57 - DNA, 20 bp, Artificial Sequence
  sgRNA
gaagatcctaaagtgggtgg

SEQ ID NO: 58 - DNA, 20 bp, Artificial Sequence
  sgRNA
tccccgcccgaccttcaggc

SEQ ID NO: 59 - DNA, 20 bp, Artificial Sequence
  sgRNA
tcagactggcagcggttgga

SEQ ID NO: 60 - DNA, 20 bp, Artificial Sequence
  sgRNA
atcttcagactggcagcggt

SEQ ID NO: 61 - DNA, 20 bp, Artificial Sequence
  sgRNA
tgggccccagaagaatgagg

SEQ ID NO: 62 - DNA, 20 bp, Artificial Sequence
  sgRNA
gcaactctgaggctcacccg

SEQ ID NO: 63 - DNA, 20 bp, Artificial Sequence
  sgRNA
ctctccacctcattcttctg

SEQ ID NO: 64 - DNA, 20 bp, Artificial Sequence
  sgRNA
cggggccactgcctgcatcc

SEQ ID NO: 65 - DNA, 20 bp, Artificial Sequence
  sgRNA
tctcctgcctgaaggtcggg

SEQ ID NO: 66 - DNA, 20 bp, Artificial Sequence
  sgRNA
ggccggacatccccagagag

SEQ ID NO: 67 - DNA, 20 bp, Artificial Sequence
  sgRNA
gggacttgagcaattggcga

SEQ ID NO: 68 - DNA, 20 bp, Artificial Sequence
  sgRNA
attgaatgtctcctgcctga

SEQ ID NO: 69 - DNA, 20 bp, Artificial Sequence
  sgRNA
ccctaataaatgtgcagtgg

SEQ ID NO: 70 - DNA, 20 bp, Artificial Sequence
  sgRNA
gaatgggccccagaagaatg

SEQ ID NO: 71 - DNA, 20 bp, Artificial Sequence
  sgRNA
agggacttgagcaattggcg

SEQ ID NO: 72 - DNA, 20 bp, Artificial Sequence
  sgRNA
gggcaggctggtcccctgac

SEQ ID NO: 73 - DNA, 20 bp, Artificial Sequence
  sgRNA
ggggatgtccggccggtcga

SEQ ID NO: 74 - DNA, 20 bp, Artificial Sequence
  sgRNA
ttcagactggcagcggttgg

SEQ ID NO: 75 - DNA, 20 bp, Artificial Sequence
  sgRNA
ccagtctgaagatcctaaag

SEQ ID NO: 76 - DNA, 20 bp, Artificial Sequence
  sgRNA
ccggccggacatccccagag

SEQ ID NO: 77 - DNA, 20 bp, Artificial Sequence
  sgRNA
aggcaactctgaggctcacc

SEQ ID NO: 78 - DNA, 20 bp, Artificial Sequence
  sgRNA
cctctctggggatgtccggc

SEQ ID NO: 79 - DNA, 20 bp, Artificial Sequence
  sgRNA
ctcaagtccctcccctcgac

SEQ ID NO: 80 - DNA, 20 bp, Artificial Sequence
  sgRNA
tcctgcctgaaggtcgggcg

SEQ ID NO: 81 - DNA, 20 bp, Artificial Sequence
  sgRNA
agtccctcccctcgaccggc

SEQ ID NO: 82 - DNA, 20 bp, Artificial Sequence
  sgRNA
cggccggacatccccagaga

SEQ ID NO: 83 - DNA, 20 bp, Artificial Sequence
  sgRNA
gggatgtccggccggtcgag

SEQ ID NO: 84 - DNA, 20 bp, Artificial Sequence
  sgRNA
cccagaagaatgaggtggag

SEQ ID NO: 85 - DNA, 20 bp, Artificial Sequence
  sgRNA
gaccagcctgcccctctctg

SEQ ID NO: 86 - DNA, 20 bp, Artificial Sequence
  sgRNA
agtgggtggaggcagttgcc

SEQ ID NO: 87 - DNA, 20 bp, Artificial Sequence
  sgRNA
atgtctcctgcctgaaggtc

SEQ ID NO: 88 - DNA, 20 bp, Artificial Sequence
  sgRNA
tctacttgcttcaacctgtc

SEQ ID NO: 89 - DNA, 20 bp, Artificial Sequence
  sgRNA
cagaagaatgaggtggagag

SEQ ID NO: 90 - DNA, 20 bp, Artificial Sequence
  sgRNA
tgcccctctctggggatgtc

SEQ ID NO: 91 - DNA, 20 bp, Artificial Sequence
  sgRNA
ctacttgcttcaacctgtca

SEQ ID NO: 92 - DNA, 20 bp, Artificial Sequence
  sgRNA
cccctccccgcccgaccttc

SEQ ID NO: 93 - DNA, 20 bp, Artificial Sequence
  sgRNA
aatgtctcctgcctgaaggt

SEQ ID NO: 94 - DNA, 20 bp, Artificial Sequence
  sgRNA
ggaggcagttgccaggatgc

SEQ ID NO: 95 - DNA, 20 bp, Artificial Sequence
  sgRNA
aggatgcaggcagtggcccc

SEQ ID NO: 96 - DNA, 20 bp, Artificial Sequence
  sgRNA
taggatcttcagactggcag

SEQ ID NO: 97 - DNA, 20 bp, Artificial Sequence
  sgRNA
ctcctgcctgaaggtcgggc

SEQ ID NO: 98 - DNA, 20 bp, Artificial Sequence
  sgRNA
ccctctccacctcattcttc

SEQ ID NO: 99 - DNA, 20 bp, Artificial Sequence
  sgRNA
ccagaagaatgaggtggaga

SEQ ID NO: 100 - DNA, 20 bp, Artificial Sequence
  sgRNA
tgtccggccggtcgagggga

SEQ ID NO: 101 - DNA, 20 bp, Artificial Sequence
  sgRNA
cctctccacctcattcttct

SEQ ID NO: 102 - DNA, 20 bp, Artificial Sequence
  sgRNA
agttgccaggatgcaggcag

SEQ ID NO: 103 - DNA, 20 bp, Artificial Sequence
  sgRNA
tggggatgtccggccggtcg

SEQ ID NO: 104 - DNA, 20 bp, Artificial Sequence
  sgRNA
gggaccagcctgcccctctc

SEQ ID NO: 105 - DNA, 20 bp, Artificial Sequence
  sgRNA
aggtttgttgaataaatgaa

SEQ ID NO: 106 - DNA, 20 bp, Artificial Sequence
  sgRNA
ggacatccccagagaggggc

SEQ ID NO: 107 - DNA, 20 bp, Artificial Sequence
  sgRNA
gttgggggcaggcaactctg

SEQ ID NO: 108 - DNA, 20 bp, Artificial Sequence
  sgRNA
ggtttgttgaataaatgaat

SEQ ID NO: 109 - DNA, 20 bp, Artificial Sequence
  sgRNA
atgtccggccggtcgagggg

SEQ ID NO: 110 - DNA, 20 bp, Artificial Sequence
  sgRNA
ggcaactctgaggctcaccc

SEQ ID NO: 111 - DNA, 20 bp, Artificial Sequence
  sgRNA
cctgaaggtcgggcggggag

SEQ ID NO: 112 - DNA, 20 bp, Artificial Sequence
  sgRNA
gcctgaaggtcgggcgggga

SEQ ID NO: 113 - DNA, 20 bp, Artificial Sequence
  sgRNA
aggggagggacttgagcaat

SEQ ID NO: 114 - DNA, 20 bp, Artificial Sequence
  sgRNA
atccccagagaggggcaggc

SEQ ID NO: 115 - DNA, 20 bp, Artificial Sequence
  sgRNA
tgcctgaaggtcgggcgggg

SEQ ID NO: 116 - DNA, 20 bp, Artificial Sequence
  sgRNA
ggtcgggcggggaggggttg

SEQ ID NO: 117 - DNA, 20 bp, Artificial Sequence
  sgRNA
caactgcctccacccacttt

SEQ ID NO: 118 - DNA, 20 bp, Artificial Sequence
  sgRNA
gtcgggcggggaggggttgg

SEQ ID NO: 119 - DNA, 20 bp, Artificial Sequence
  sgRNA
caggatgcaggcagtggccc

SEQ ID NO: 120 - DNA, 20 bp, Artificial Sequence
  sgRNA
ggcggggaggggttgggggc

SEQ ID NO: 121 - DNA, 20 bp, Artificial Sequence
  sgRNA
aatgaggtggagaggggaat

SEQ ID NO: 122 - DNA, 20 bp, Artificial Sequence
  sgRNA
ggaccagcctgcccctctct

SEQ ID NO: 123 - DNA, 20 bp, Artificial Sequence
  sgRNA
aggtcgggcggggaggggtt

SEQ ID NO: 124 - DNA, 20 bp, Artificial Sequence
  sgRNA
aaggtcgggcggggaggggt

SEQ ID NO: 125 - DNA, 20 bp, Artificial Sequence
  sgRNA
gtttgttagtccatgcacgg

SEQ ID NO: 126 - DNA, 20 bp, Artificial Sequence
  sgRNA
tcagtgccaggagttggaca

SEQ ID NO: 127 - DNA, 20 bp, Artificial Sequence
  sgRNA
tggtgcccgagaagagtgag

SEQ ID NO: 128 - DNA, 20 bp, Artificial Sequence
  sgRNA
tagaagaagacggcagcaga

SEQ ID NO: 129 - DNA, 20 bp, Artificial Sequence
  sgRNA
tagtccatgcacggtggtga

SEQ ID NO: 130 - DNA, 20 bp, Artificial Sequence
  sgRNA
atggtgcccgagaagagtga

SEQ ID NO: 131 - DNA, 20 bp, Artificial Sequence
  sgRNA
acgagcaccaggcggcctag

SEQ ID NO: 132 - DNA, 20 bp, Artificial Sequence
  sgRNA
catgaaacaccacgagcacc

SEQ ID NO: 133 - DNA, 20 bp, Artificial Sequence
  sgRNA
gaaacaccacgagcaccagg

SEQ ID NO: 134 - DNA, 20 bp, Artificial Sequence
  sgRNA
caaacaccctgtccaactcc

SEQ ID NO: 135 - DNA, 20 bp, Artificial Sequence
  sgRNA
catgtttgttagtccatgca

SEQ ID NO: 136 - DNA, 20 bp, Artificial Sequence
  sgRNA
tagccttgctgtgtgatggg

SEQ ID NO: 137 - DNA, 20 bp, Artificial Sequence
  sgRNA
actcagtacttgtcagtgcc

SEQ ID NO: 138 - DNA, 20 bp, Artificial Sequence
  sgRNA
tcttctagttgcttttgtag

SEQ ID NO: 139 - DNA, 20 bp, Artificial Sequence
  sgRNA
tggcctcccatcacacagca

SEQ ID NO: 140 - DNA, 20 bp, Artificial Sequence
  sgRNA
ttagtccatgcacggtggtg

SEQ ID NO: 141 - DNA, 20 bp, Artificial Sequence
  sgRNA
aatggtgcccgagaagagtg

SEQ ID NO: 142 - DNA, 20 bp, Artificial Sequence
  sgRNA
ggctagccttgctgtgtgat

SEQ ID NO: 143 - DNA, 20 bp, Artificial Sequence
  sgRNA
tccatgcacggtggtgaggg

SEQ ID NO: 144 - DNA, 20 bp, Artificial Sequence
  sgRNA
tgatgggaggccagcttcat

SEQ ID NO: 145 - DNA, 20 bp, Artificial Sequence
  sgRNA
tggctagccttgctgtgtga

SEQ ID NO: 146 - DNA, 20 bp, Artificial Sequence
  sgRNA
cctaggccgcctggtgctcg

SEQ ID NO: 147 - DNA, 20 bp, Artificial Sequence
  sgRNA
ctagaagaagacggcagcag

SEQ ID NO: 148 - DNA, 20 bp, Artificial Sequence
  sgRNA
caccattcttctcctcccct

SEQ ID NO: 149 - DNA, 20 bp, Artificial Sequence
  sgRNA
aaacagccagcccatgaagc

SEQ ID NO: 150 - DNA, 20 bp, Artificial Sequence
  sgRNA
caaaagcaactagaagaaga

SEQ ID NO: 151 - DNA, 20 bp, Artificial Sequence
  sgRNA
cttttgtagaggctgtggct

SEQ ID NO: 152 - DNA, 20 bp, Artificial Sequence
  sgRNA
agcaccaggcggcctagggg

SEQ ID NO: 153 - DNA, 20 bp, Artificial Sequence
  sgRNA
cacgagcaccaggcggccta

SEQ ID NO: 154 - DNA, 20 bp, Artificial Sequence
  sgRNA
ccacgagcaccaggcggcct

SEQ ID NO: 155 - DNA, 20 bp, Artificial Sequence
  sgRNA
gtcagtgccaggagttggac

SEQ ID NO: 156 - DNA, 20 bp, Artificial Sequence
  sgRNA
tacttgtcagtgccaggagt

SEQ ID NO: 157 - DNA, 20 bp, Artificial Sequence
  sgRNA
ttttgtagaggctgtggctg

SEQ ID NO: 158 - DNA, 20 bp, Artificial Sequence
  sgRNA
cagatgcccctcactcttct

SEQ ID NO: 159 - DNA, 20 bp, Artificial Sequence
  sgRNA
cgagaagagtgaggggcatc

SEQ ID NO: 160 - DNA, 20 bp, Artificial Sequence
  sgRNA
gcctccctcaccaccgtgca

SEQ ID NO: 161 - DNA, 20 bp, Artificial Sequence
  sgRNA
ggcctaggggaggagaagaa

SEQ ID NO: 162 - DNA, 20 bp, Artificial Sequence
  sgRNA
gcttttgtagaggctgtggc

SEQ ID NO: 163 - DNA, 20 bp, Artificial Sequence
  sgRNA
gggaggccagcttcatgggc

SEQ ID NO: 164 - DNA, 20 bp, Artificial Sequence
  sgRNA
tgggctggctgtttctgtgc

SEQ ID NO: 165 - DNA, 20 bp, Artificial Sequence
  sgRNA
agttgcttttgtagaggctg

SEQ ID NO: 166 - DNA, 20 bp, Artificial Sequence
  sgRNA
ttctcctcccctaggccgcc

SEQ ID NO: 167 - DNA, 20 bp, Artificial Sequence
  sgRNA
agatgcccctcactcttctc

SEQ ID NO: 168 - DNA, 20 bp, Artificial Sequence
  sgRNA
gtgatgggaggccagcttca

SEQ ID NO: 169 - DNA, 20 bp, Artificial Sequence
  sgRNA
cagtttaaactcattgacgt

SEQ ID NO: 170 - DNA, 20 bp, Artificial Sequence
  sgRNA
acagattttgaccacacttg

SEQ ID NO: 171 - DNA, 20 bp, Artificial Sequence
  sgRNA
ttttttgagggaatttcaag

SEQ ID NO: 172 - DNA, 20 bp, Artificial Sequence
  sgRNA
tcaaaatctgtagagaaaag

SEQ ID NO: 173 - DNA, 20 bp, Artificial Sequence
  sgRNA
ttaaatttcttcctcaagtg

SEQ ID NO: 174 - DNA, 20 bp, Artificial Sequence
  sgRNA
gctcatcttaacgtcatgtc

SEQ ID NO: 175 - DNA, 20 bp, Artificial Sequence
  sgRNA
attctattttgttgctgcgg

SEQ ID NO: 176 - DNA, 20 bp, Artificial Sequence
  sgRNA
tttttgagggaatttcaaga

SEQ ID NO: 177 - DNA, 20 bp, Artificial Sequence
  sgRNA
tttattctattttgttgctg

SEQ ID NO: 178 - DNA, 20 bp, Artificial Sequence
  sgRNA
ttttgagggaatttcaagag

SEQ ID NO: 179 - DNA, 20 bp, Artificial Sequence
  sgRNA
agcaacaaaatagaataaag

SEQ ID NO: 180 - DNA, 20 bp, Artificial Sequence
  sgRNA
tgagtttaaactgcaaggaa

SEQ ID NO: 181 - DNA, 20 bp, Artificial Sequence
  sgRNA
ttctcttaaagaaagttagc

SEQ ID NO: 182 - DNA, 20 bp, Artificial Sequence
  sgRNA
agaggggagattttttattc

SEQ ID NO: 183 - DNA, 20 bp, Artificial Sequence
  sgRNA
tctcttaaagaaagttagct

SEQ ID NO: 184 - DNA, 20 bp, Artificial Sequence
  sgRNA
gtcaatgagtttaaactgca

SEQ ID NO: 185 - DNA, 20 bp, Artificial Sequence
  sgRNA
gagtttaaactgcaaggaaa

SEQ ID NO: 186 - DNA, 20 bp, Artificial Sequence
  sgRNA
ttattttctaggttttttga

SEQ ID NO: 187 - DNA, 20 bp, Artificial Sequence
  sgRNA
ttaaagaaagttagctgggt

SEQ ID NO: 188 - DNA, 20 bp, Artificial Sequence
  sgRNA
tttattttctaggttttttg

SEQ ID NO: 189 - DNA, 20 bp, Artificial Sequence
  sgRNA
ttctaattattttattttct

SEQ ID NO: 190 - DNA, 20 bp, Artificial Sequence
  sgRNA
agagatagaaagtacaacta

SEQ ID NO: 191 - DNA, 20 bp, Artificial Sequence
  sgRNA
cagagatagaaagtacaact

SEQ ID NO: 192 - DNA, 20 bp, Artificial Sequence
  sgRNA
tatttttcacctgcactcaa

SEQ ID NO: 193 - DNA, 20 bp, Artificial Sequence
  sgRNA
ccataaaagcctttgagtgc

SEQ ID NO: 194 - DNA, 20 bp, Artificial Sequence
  sgRNA
caactagggaatttagaaaa

SEQ ID NO: 195 - DNA, 20 bp, Artificial Sequence
  sgRNA
cctgcactcaaaggctttta

SEQ ID NO: 196 - DNA, 20 bp, Artificial Sequence
  sgRNA
gaagactttgctctgtgcat

SEQ ID NO: 197 - DNA, 20 bp, Artificial Sequence
  sgRNA
tttgagtgcaggtgaaaaat

SEQ ID NO: 198 - DNA, 20 bp, Artificial Sequence
  sgRNA
agtttttatctgtgaagtag

SEQ ID NO: 199 - DNA, 20 bp, Artificial Sequence
  sgRNA
aaattttaataacacagatt

SEQ ID NO: 200 - DNA, 20 bp, Artificial Sequence
  sgRNA
atataaataggccataccca

SEQ ID NO: 201 - DNA, 20 bp, Artificial Sequence
  sgRNA
aaattcctctgaatagagag

SEQ ID NO: 202 - DNA, 20 bp, Artificial Sequence
  sgRNA
taggccatacccatggagaa

SEQ ID NO: 203 - DNA, 20 bp, Artificial Sequence
  sgRNA
caagacttgggagaaagcaa

SEQ ID NO: 204 - DNA, 20 bp, Artificial Sequence
  sgRNA
aaaaagatttacaaactgtg

SEQ ID NO: 205 - DNA, 20 bp, Artificial Sequence
  sgRNA
gttagaatgtcctttctcca

SEQ ID NO: 206 - DNA, 20 bp, Artificial Sequence
  sgRNA
atggtcctctctctattcag

SEQ ID NO: 207 - DNA, 20 bp, Artificial Sequence
  sgRNA
tattatatatatcataagat

SEQ ID NO: 208 - DNA, 20 bp, Artificial Sequence
  sgRNA
tactaaaatgtaaatgacat

SEQ ID NO: 209 - DNA, 20 bp, Artificial Sequence
  sgRNA
atgacataggaaaactgaaa

SEQ ID NO: 210 - DNA, 20 bp, Artificial Sequence
  sgRNA
caaattgtaaaacaagactt

SEQ ID NO: 211 - DNA, 20 bp, Artificial Sequence
  sgRNA
ttagaatgtcctttctccat

SEQ ID NO: 212 - DNA, 20 bp, Artificial Sequence
  sgRNA
gaggaccatctcatataaat

SEQ ID NO: 213 - DNA, 20 bp, Artificial Sequence
  sgRNA
tatggcctatttatatgaga

SEQ ID NO: 214 - DNA, 20 bp, Artificial Sequence
  sgRNA
aatgacataggaaaactgaa

SEQ ID NO: 215 - DNA, 20 bp, Artificial Sequence
  sgRNA
atgtcctttctccatgggta

SEQ ID NO: 216 - DNA, 20 bp, Artificial Sequence
  sgRNA
tgaaagggagaagtgaaagt

SEQ ID NO: 217 - DNA, 20 bp, Artificial Sequence
  sgRNA
tttgaggttcttgaattctc

SEQ ID NO: 218 - DNA, 20 bp, Artificial Sequence
  sgRNA
ctgaaagggagaagtgaaag

SEQ ID NO: 219 - DNA, 20 bp, Artificial Sequence
  sgRNA
ctgtatcttttagtgttttg

SEQ ID NO: 220 - DNA, 20 bp, Artificial Sequence
  sgRNA
atcttatgatatatataata

SEQ ID NO: 221 - DNA, 20 bp, Artificial Sequence
  sgRNA
tatcttatgatatatataat

SEQ ID NO: 222 - DNA, 20 bp, Artificial Sequence
  sgRNA
gcaaattgtaaaacaagact

SEQ ID NO: 223 - DNA, 20 bp, Artificial Sequence
  sgRNA
cattttaccagggcgaagtg

SEQ ID NO: 224 - DNA, 20 bp, Artificial Sequence
  sgRNA
tgggtctgtctcatcgtcaa

SEQ ID NO: 225 - DNA, 20 bp, Artificial Sequence
  sgRNA
ttcaaagaatcccaccagaa

SEQ ID NO: 226 - DNA, 20 bp, Artificial Sequence
  sgRNA
tacctaattgaagtctcctg

SEQ ID NO: 227 - DNA, 20 bp, Artificial Sequence
  sgRNA
aacattttaccagggcgaag

SEQ ID NO: 228 - DNA, 20 bp, Artificial Sequence
  sgRNA
tgtgaaaatacgtaatcctc

SEQ ID NO: 229 - DNA, 20 bp, Artificial Sequence
  sgRNA
gaatcccaccagaatggcac

SEQ ID NO: 230 - DNA, 20 bp, Artificial Sequence
  sgRNA
acattttaccagggcgaagt

SEQ ID NO: 231 - DNA, 20 bp, Artificial Sequence
  sgRNA
tctcatcgtcaaaggaccca

SEQ ID NO: 232 - DNA, 20 bp, Artificial Sequence
  sgRNA
cccaccagaatggcacaggt

SEQ ID NO: 233 - DNA, 20 bp, Artificial Sequence
  sgRNA
gagatggtgacagataggca

SEQ ID NO: 234 - DNA, 20 bp, Artificial Sequence
  sgRNA
aaaggacccaaggagtctaa

SEQ ID NO: 235 - DNA, 20 bp, Artificial Sequence
  sgRNA
atcctcaggagacttcaatt

SEQ ID NO: 236 - DNA, 20 bp, Artificial Sequence
  sgRNA
gtataaataccagcagccag

SEQ ID NO: 237 - DNA, 20 bp, Artificial Sequence
  sgRNA
aagatgagatggtgacagat

SEQ ID NO: 238 - DNA, 20 bp, Artificial Sequence
  sgRNA
atagtttgtattaataacta

SEQ ID NO: 239 - DNA, 20 bp, Artificial Sequence
  sgRNA
atggcacaggtgggcataat

SEQ ID NO: 240 - DNA, 20 bp, Artificial Sequence
  sgRNA
taaataccagcagccagagg

SEQ ID NO: 241 - DNA, 20 bp, Artificial Sequence
  sgRNA
tgagatggtgacagataggc

SEQ ID NO: 242 - DNA, 20 bp, Artificial Sequence
  sgRNA
gagtttcctttagactcctt

SEQ ID NO: 243 - DNA, 20 bp, Artificial Sequence
  sgRNA
tcccaccagaatggcacagg

SEQ ID NO: 244 - DNA, 20 bp, Artificial Sequence
  sgRNA
aaaaatttccagtccttgaa

SEQ ID NO: 245 - DNA, 20 bp, Artificial Sequence
  sgRNA
acttcacaccattcaaggac

SEQ ID NO: 246 - DNA, 20 bp, Artificial Sequence
  sgRNA
tttaccagggcgaagtgggg

SEQ ID NO: 247 - DNA, 20 bp, Artificial Sequence
  sgRNA
gcccacctgtgccattctgg

SEQ ID NO: 248 - DNA, 20 bp, Artificial Sequence
  sgRNA
tattaataactaaggttttg

SEQ ID NO: 249 - DNA, 20 bp, Artificial Sequence
  sgRNA
aactaaggttttgtggcatt

SEQ ID NO: 250 - DNA, 20 bp, Artificial Sequence
  sgRNA
actaaggttttgtggcattt

SEQ ID NO: 251 - DNA, 20 bp, Artificial Sequence
  sgRNA
cccacctgtgccattctggt

SEQ ID NO: 252 - DNA, 20 bp, Artificial Sequence
  sgRNA
acaagttttttaagatgaga

SEQ ID NO: 253 - DNA, 20 bp, Artificial Sequence
  sgRNA
acaatgtgctgcacctcctc

SEQ ID NO: 254 - DNA, 20 bp, Artificial Sequence
  sgRNA
tatgcccacctgtgccattc

SEQ ID NO: 255 - DNA, 20 bp, Artificial Sequence
  sgRNA
cttttacttcacaccattca

SEQ ID NO: 256 - DNA, 20 bp, Artificial Sequence
  sgRNA
aatggcacaggtgggcataa

SEQ ID NO: 257 - DNA, 20 bp, Artificial Sequence
  sgRNA
gctgcacctcctctggctgc

SEQ ID NO: 258 - DNA, 20 bp, Artificial Sequence
  sgRNA
agagtttcctttagactcct

SEQ ID NO: 259 - DNA, 20 bp, Artificial Sequence
  sgRNA
attctggtgggattctttga

SEQ ID NO: 260 - DNA, 20 bp, Artificial Sequence
  sgRNA
gcttcagtttgtctgtggga

SEQ ID NO: 261 - DNA, 20 bp, Artificial Sequence
  sgRNA
attcactgagcatctattag

SEQ ID NO: 262 - DNA, 20 bp, Artificial Sequence
  sgRNA
atcaggaagcatccgcatcc

SEQ ID NO: 263 - DNA, 20 bp, Artificial Sequence
  sgRNA
gagagttctgaatcagggtg

SEQ ID NO: 264 - DNA, 20 bp, Artificial Sequence
  sgRNA
tccaggcctgttctgagcac

SEQ ID NO: 265 - DNA, 20 bp, Artificial Sequence
  sgRNA
ggacctttgagttgccctca

SEQ ID NO: 266 - DNA, 20 bp, Artificial Sequence
  sgRNA
ccaagtccgcgttgctgctg

SEQ ID NO: 267 - DNA, 20 bp, Artificial Sequence
  sgRNA
atctgcatgacccactcgat

SEQ ID NO: 268 - DNA, 20 bp, Artificial Sequence
  sgRNA
gtttgagggtcatctagctg

SEQ ID NO: 269 - DNA, 20 bp, Artificial Sequence
  sgRNA
gcaggcaggagtgggtgggt

SEQ ID NO: 270 - DNA, 20 bp, Artificial Sequence
  sgRNA
ctttgtagattattcgagtt

SEQ ID NO: 271 - DNA, 20 bp, Artificial Sequence
  sgRNA
gagttcggtttcagtcttga

SEQ ID NO: 272 - DNA, 20 bp, Artificial Sequence
  sgRNA
aaagagaattggaaagcaag

SEQ ID NO: 273 - DNA, 20 bp, Artificial Sequence
  sgRNA
tgtgtacatctctcttaaat

SEQ ID NO: 274 - DNA, 20 bp, Artificial Sequence
  sgRNA
caggctctcagagaacctgt

SEQ ID NO: 275 - DNA, 20 bp, Artificial Sequence
  sgRNA
gaaattcctctgaggcagaa

SEQ ID NO: 276 - DNA, 20 bp, Artificial Sequence
  sgRNA
cctgtgctatttataaggga

SEQ ID NO: 277 - DNA, 20 bp, Artificial Sequence
  sgRNA
gtgagaatgatcttccttca

SEQ ID NO: 278 - DNA, 20 bp, Artificial Sequence
  sgRNA
agagtttcctttcgactcct

SEQ ID NO: 279 - DNA, 20 bp, Artificial Sequence
  sgRNA
ttaagatggtgacagatagg

SEQ ID NO: 280 - DNA, 20 bp, Artificial Sequence
  sgRNA
atacctgatcgaaggctcct

SEQ ID NO: 281 - DNA, 20 bp, Artificial Sequence
  sgRNA
aagtcactcaattcataact

SEQ ID NO: 282 - DNA, 20 bp, Artificial Sequence
  sgRNA
caactccctgttagcccgga

SEQ ID NO: 283 - DNA, 20 bp, Artificial Sequence
  sgRNA
agtgcttagcagtgttccaa

SEQ ID NO: 284 - DNA, 20 bp, Artificial Sequence
  sgRNA
gcaccaggccaaacatacaa

SEQ ID NO: 285 - DNA, 20 bp, Artificial Sequence
  sgRNA
cactacaagggaagttcaga

SEQ ID NO: 286 - DNA, 20 bp, Artificial Sequence
  sgRNA
cgccacctagtggtaacaag

SEQ ID NO: 287 - DNA, 20 bp, Artificial Sequence
  sgRNA
gggccctgaaaggatagcga

SEQ ID NO: 288 - DNA, 20 bp, Artificial Sequence
  sgRNA
ttctacatacacttcgaagc

SEQ ID NO: 289 - DNA, 20 bp, Artificial Sequence
  sgRNA
tgtgactcaggtgggatgga

SEQ ID NO: 290 - DNA, 20 bp, Artificial Sequence
  sgRNA
gaggaggtacgtgaggaaag

SEQ ID NO: 291 - DNA, 20 bp, Artificial Sequence
  sgRNA
cagtgagagtgatcgaccgg

SEQ ID NO: 292 - DNA, 20 bp, Artificial Sequence
  sgRNA
gagacttgggcatgagttac

SEQ ID NO: 293 - DNA, 20 bp, Artificial Sequence
  sgRNA
aacccaatcggctgctgagc

SEQ ID NO: 294 - DNA, 20 bp, Artificial Sequence
  sgRNA
ccgcctgtgcccaattagcc

SEQ ID NO: 295 - DNA, 20 bp, Artificial Sequence
  sgRNA
ccctccctcccttccctccc

SEQ ID NO: 296 - DNA, 20 bp, Artificial Sequence
  sgRNA
acagggcctggacagggaag

SEQ ID NO: 297 - DNA, 20 bp, Artificial Sequence
  sgRNA
agaaagttccgggagtcgag

SEQ ID NO: 298 - DNA, 20 bp, Artificial Sequence
  sgRNA
cagagggctgtcagagggag

SEQ ID NO: 299 - DNA, 20 bp, Artificial Sequence
  sgRNA
aacttggtttctgttgtagg

SEQ ID NO: 300 - DNA, 20 bp, Artificial Sequence
  sgRNA
attccctagccgggcagggc

SEQ ID NO: 301 - DNA, 20 bp, Artificial Sequence
  sgRNA
aattgtagcgagatagacga

SEQ ID NO: 302 - DNA, 20 bp, Artificial Sequence
  sgRNA
gtggttggtgtacactcacg

SEQ ID NO: 303 - DNA, 20 bp, Artificial Sequence
  sgRNA
cgttctgtggctgagcctaa

SEQ ID NO: 304 - DNA, 20 bp, Artificial Sequence
  sgRNA
tgcaggcaacttgcagactg

SEQ ID NO: 305 - DNA, 20 bp, Artificial Sequence
  sgRNA
ttcacgcaagcaagttaagg

SEQ ID NO: 306 - DNA, 20 bp, Artificial Sequence
  sgRNA
cgtgccgttctaccagcatt

SEQ ID NO: 307 - DNA, 20 bp, Artificial Sequence
  sgRNA
acgacctccggatctgagtc

SEQ ID NO: 308 - DNA, 20 bp, Artificial Sequence
  sgRNA
ccgtgatatttcaaacagcc

SEQ ID NO: 309 - DNA, 20 bp, Artificial Sequence
  sgRNA
agcatcaacagctaggagac

SEQ ID NO: 310 - DNA, 20 bp, Artificial Sequence
  sgRNA
aaaccctactctcagatccc

SEQ ID NO: 311 - DNA, 20 bp, Artificial Sequence
  sgRNA
tagttcttctaggtcagctg

SEQ ID NO: 312 - DNA, 20 bp, Artificial Sequence
  sgRNA
taaccacaaattgatcgtcc

SEQ ID NO: 313 - DNA, 20 bp, Artificial Sequence
  sgRNA
actttggagatgactcagca

SEQ ID NO: 314 - DNA, 20 bp, Artificial Sequence
  sgRNA
tttattgtgacccatgaact

SEQ ID NO: 315 - DNA, 20 bp, Artificial Sequence
  sgRNA
gcaatgccctcggtttacag

SEQ ID NO: 316 - DNA, 20 bp, Artificial Sequence
  sgRNA
gcggagtctaggctgataaa

SEQ ID NO: 317 - DNA, 20 bp, Artificial Sequence
  sgRNA
ggtctgggaacgcgggagtg

SEQ ID NO: 318 - DNA, 20 bp, Artificial Sequence
  sgRNA
tatttattggtcacttcact

SEQ ID NO: 319 - DNA, 20 bp, Artificial Sequence
  sgRNA
ctccagccctctcatagttg

SEQ ID NO: 320 - DNA, 20 bp, Artificial Sequence
  sgRNA
aggatttaacatggactgaa

SEQ ID NO: 321 - DNA, 20 bp, Artificial Sequence
  sgRNA
ctgtgatcgaacagacgaga

SEQ ID NO: 322 - DNA, 20 bp, Artificial Sequence
  sgRNA
gcagtgtggcagccgccgat

SEQ ID NO: 323 - DNA, 20 bp, Artificial Sequence
  sgRNA
aacagctggtaactgccgat

SEQ ID NO: 324 - DNA, 20 bp, Artificial Sequence
  sgRNA
ctgcgtcacgcagcgtcggg

SEQ ID NO: 325 - DNA, 20 bp, Artificial Sequence
  sgRNA
ggtcgcactatgggccaatg

SEQ ID NO: 326 - DNA, 20 bp, Artificial Sequence
  sgRNA
gtaggtctaaaccagtcaaa

SEQ ID NO: 327 - DNA, 20 bp, Artificial Sequence
  sgRNA
gggtcgaccacgcgttgtgg

SEQ ID NO: 328 - DNA, 20 bp, Artificial Sequence
  sgRNA
tgatagggaatgcattctcc

SEQ ID NO: 329 - DNA, 20 bp, Artificial Sequence
  sgRNA
actttgagttcccgaagccc

SEQ ID NO: 330 - DNA, 20 bp, Artificial Sequence
  sgRNA
caagcctaagggatctagcc

SEQ ID NO: 331 - DNA, 20 bp, Artificial Sequence
  sgRNA
agctggccgtgcagagagga

SEQ ID NO: 332 - DNA, 20 bp, Artificial Sequence
  sgRNA
tcatctgggagatgagcctc

SEQ ID NO: 333 - DNA, 20 bp, Artificial Sequence
  sgRNA
ttcggttggcattcggctaa

SEQ ID NO: 334 - DNA, 20 bp, Artificial Sequence
  sgRNA
gggtctgagatgctttgaaa

SEQ ID NO: 335 - DNA, 20 bp, Artificial Sequence
  sgRNA
ggcgcctgtcaatttgcggg

SEQ ID NO: 336 - DNA, 20 bp, Artificial Sequence
  sgRNA
ttgctagtagcggccttgga

SEQ ID NO: 337 - DNA, 20 bp, Artificial Sequence
  sgRNA
ccttccgattgggcggcggt

SEQ ID NO: 338 - DNA, 20 bp, Artificial Sequence
  sgRNA
agctgtttgcggcgacgatc

SEQ ID NO: 339 - DNA, 20 bp, Artificial Sequence
  sgRNA
aatctagtgcgcatgctctt

SEQ ID NO: 340 - DNA, 20 bp, Artificial Sequence
  sgRNA
gtctaagatatagagctgtg

SEQ ID NO: 341 - DNA, 20 bp, Artificial Sequence
  sgRNA
gatagtcgccataacaagta

SEQ ID NO: 342 - DNA, 20 bp, Artificial Sequence
  sgRNA
ttgtgccaggagtctcgcgg

SEQ ID NO: 343 - DNA, 20 bp, Artificial Sequence
  sgRNA
ttgtggggtggggaggagag

SEQ ID NO: 344 - DNA, 20 bp, Artificial Sequence
  sgRNA
gaaagaggaaggggttgagg

SEQ ID NO: 345 - DNA, 20 bp, Artificial Sequence
  sgRNA
ccacagctctttggggggtg

SEQ ID NO: 346 - DNA, 20 bp, Artificial Sequence
  sgRNA
tgtccctaccctgaaagagc

SEQ ID NO: 347 - DNA, 20 bp, Artificial Sequence
  sgRNA
acatcatttgcatagtcaga

SEQ ID NO: 348 - DNA, 20 bp, Artificial Sequence
  sgRNA
ggggcatatgtgataccctt

SEQ ID NO: 349 - DNA, 20 bp, Artificial Sequence
  sgRNA
tttcggttgtctttctgcag

SEQ ID NO: 350 - DNA, 20 bp, Artificial Sequence
  sgRNA
gcggagagcgggtcgcccac

SEQ ID NO: 351 - DNA, 20 bp, Artificial Sequence
  sgRNA
ggcgcgggttcgagcacctc

SEQ ID NO: 352 - DNA, 20 bp, Artificial Sequence
  sgRNA
ggacttcgatctagcattct

SEQ ID NO: 353 - DNA, 20 bp, Artificial Sequence
  sgRNA
ctttaaattgtgttctactg

SEQ ID NO: 354 - DNA, 20 bp, Artificial Sequence
  sgRNA
gtgtgtgggcagaaggccac

SEQ ID NO: 355 - DNA, 20 bp, Artificial Sequence
  sgRNA
ttaaacgcccacttcggatg

SEQ ID NO: 356 - DNA, 20 bp, Artificial Sequence
  sgRNA
acgttgttaaccaaatcaaa

SEQ ID NO: 357 - DNA, 20 bp, Artificial Sequence
  sgRNA
atgggagggtcgcaacgacc

SEQ ID NO: 358 - DNA, 20 bp, Artificial Sequence
  sgRNA
ctagcataggactcactaaa

SEQ ID NO: 359 - DNA, 20 bp, Artificial Sequence
  sgRNA
actaagaggagggagaaggg

SEQ ID NO: 360 - DNA, 20 bp, Artificial Sequence
  sgRNA
ctccctgtggtggaggctcg

SEQ ID NO: 361 - DNA, 20 bp, Artificial Sequence
  sgRNA
aaatacagctttcctcaagc

SEQ ID NO: 362 - DNA, 20 bp, Artificial Sequence
  sgRNA
cggcatggcccgacagcccg

SEQ ID NO: 363 - DNA, 20 bp, Artificial Sequence
  sgRNA
acgtaccacgtgcccaaacg

SEQ ID NO: 364 - DNA, 20 bp, Artificial Sequence
  sgRNA
cagattcctcacagtcaata

SEQ ID NO: 365 - DNA, 20 bp, Artificial Sequence
  sgRNA
cagacactttatcagataag

SEQ ID NO: 366 - DNA, 20 bp, Artificial Sequence
  sgRNA
actagcccttgcgccaaggc

SEQ ID NO: 367 - DNA, 20 bp, Artificial Sequence
  sgRNA
cgggctctcggcggtggagg

SEQ ID NO: 368 - DNA, 20 bp, Artificial Sequence
  sgRNA
aggcagcacatgccggcgtc

SEQ ID NO: 369 - DNA, 20 bp, Artificial Sequence
  sgRNA
gctaacacccttgagattta

SEQ ID NO: 370 - DNA, 20 bp, Artificial Sequence
  sgRNA
tttcaggactcgcctttatt

SEQ ID NO: 371 - DNA, 20 bp, Artificial Sequence
  sgRNA
agagataacttccgggagat

SEQ ID NO: 372 - DNA, 20 bp, Artificial Sequence
  sgRNA
agctcttactatcttacttc

SEQ ID NO: 373 - DNA, 20 bp, Artificial Sequence
  sgRNA
cgagggctgactacctattc

SEQ ID NO: 374 - DNA, 20 bp, Artificial Sequence
  sgRNA
ggcgggatgttcccacgtgg

SEQ ID NO: 375 - DNA, 20 bp, Artificial Sequence
  sgRNA
ctgtcgcaaaggccacatcc

SEQ ID NO: 376 - DNA, 20 bp, Artificial Sequence
  sgRNA
tatcattgtgatgcatacaa

SEQ ID NO: 377 - DNA, 20 bp, Artificial Sequence
  sgRNA
aggaagtcaataccgtcagg

SEQ ID NO: 378 - DNA, 20 bp, Artificial Sequence
  sgRNA
ctaacagtctgtctactcca

SEQ ID NO: 379 - DNA, 20 bp, Artificial Sequence
  sgRNA
cccagggagcagccttggac

SEQ ID NO: 380 - DNA, 20 bp, Artificial Sequence
  sgRNA
agtgtcaatgtttggtcgga

SEQ ID NO: 381 - DNA, 20 bp, Artificial Sequence
  sgRNA
tgatgaaacagagtggcctg

SEQ ID NO: 382 - DNA, 20 bp, Artificial Sequence
  sgRNA
cttccttaactgagtggtgg

SEQ ID NO: 383 - DNA, 20 bp, Artificial Sequence
  sgRNA
aagctgagcagaagcaatgg

SEQ ID NO: 384 - DNA, 20 bp, Artificial Sequence
  sgRNA
caactctaagttgggagccc

SEQ ID NO: 385 - DNA, 20 bp, Artificial Sequence
  sgRNA
gaaacctgccacctcttacc

SEQ ID NO: 386 - DNA, 20 bp, Artificial Sequence
  sgRNA
tgcgcgtcatttgcagtctg

SEQ ID NO: 387 - DNA, 20 bp, Artificial Sequence
  sgRNA
taacttatcccatttcaaac

SEQ ID NO: 388 - DNA, 20 bp, Artificial Sequence
  sgRNA
tgggaaggcgcttcgagcga

SEQ ID NO: 389 - DNA, 20 bp, Artificial Sequence
  sgRNA
cattgtgggagccgcgcgag

SEQ ID NO: 390 - DNA, 20 bp, Artificial Sequence
  sgRNA
cgctcgctcgctctcctcac

SEQ ID NO: 391 - DNA, 20 bp, Artificial Sequence
  sgRNA
gaggaagccgagacctaaat

SEQ ID NO: 392 - DNA, 20 bp, Artificial Sequence
  sgRNA
gaacagagagggtcttctgg

SEQ ID NO: 393 - DNA, 20 bp, Artificial Sequence
  sgRNA
ggttgtcacctgccgtgggt

SEQ ID NO: 394 - DNA, 20 bp, Artificial Sequence
  sgRNA
tactggttgtttactttcaa

SEQ ID NO: 395 - DNA, 20 bp, Artificial Sequence
  sgRNA
gctagagtcatctgaaagga

SEQ ID NO: 396 - DNA, 20 bp, Artificial Sequence
  sgRNA
gactcctccttcaagaattg

SEQ ID NO: 397 - DNA, 20 bp, Artificial Sequence
  sgRNA
gaattaggcgggaccctgga

SEQ ID NO: 398 - DNA, 20 bp, Artificial Sequence
  sgRNA
taggatgctaagagctgtca

SEQ ID NO: 399 - DNA, 20 bp, Artificial Sequence
  sgRNA
aattgactgctgcgatggct

SEQ ID NO: 400 - DNA, 20 bp, Artificial Sequence
  sgRNA
ggtcccgcatctacttccgg

SEQ ID NO: 401 - DNA, 20 bp, Artificial Sequence
  sgRNA
agccttgcgttacttgttta

SEQ ID NO: 402 - DNA, 20 bp, Artificial Sequence
  sgRNA
gctgccgcctggctgctctg

SEQ ID NO: 403 - DNA, 20 bp, Artificial Sequence
  sgRNA
gcacgcgtgatggagctacc

SEQ ID NO: 404 - DNA, 20 bp, Artificial Sequence
  sgRNA
gagcgacgaggccaggtggg

SEQ ID NO: 405 - DNA, 20 bp, Artificial Sequence
  sgRNA
tggctgaatgcactccacct

SEQ ID NO: 406 - DNA, 20 bp, Artificial Sequence
  sgRNA
tttcccatcccgtcatgggc

SEQ ID NO: 407 - DNA, 20 bp, Artificial Sequence
  sgRNA
agtgggcgtgggtagcccgc

SEQ ID NO: 408 - DNA, 20 bp, Artificial Sequence
  sgRNA
gtagagtcctctgacccaga

SEQ ID NO: 409 - DNA, 20 bp, Artificial Sequence
  sgRNA
ttcagcactctgatttgtca

SEQ ID NO: 410 - DNA, 20 bp, Artificial Sequence
  sgRNA
cttaggatgtgcatgtgaca

SEQ ID NO: 411 - DNA, 20 bp, Artificial Sequence
  sgRNA
ggaaatcctgtcactcagcc

SEQ ID NO: 412 - DNA, 20 bp, Artificial Sequence
  sgRNA
caagcgccacagacaataac

SEQ ID NO: 413 - DNA, 20 bp, Artificial Sequence
  sgRNA
acaacatacccgtcacccaa

SEQ ID NO: 414 - DNA, 20 bp, Artificial Sequence
  sgRNA
cagttgctaaggaaacgacg

SEQ ID NO: 415 - DNA, 20 bp, Artificial Sequence
  sgRNA
acgtgaatacagtgctcagc

SEQ ID NO: 416 - DNA, 20 bp, Artificial Sequence
  sgRNA
taggaacgcttgcaacagtg

SEQ ID NO: 417 - DNA, 20 bp, Artificial Sequence
  sgRNA
agggcgtgtccttgtagtgg

SEQ ID NO: 418 - DNA, 20 bp, Artificial Sequence
  sgRNA
actcacccagaagcctctag

SEQ ID NO: 419 - DNA, 20 bp, Artificial Sequence
  sgRNA
gacgcgctaagcaagggcag

SEQ ID NO: 420 - DNA, 20 bp, Artificial Sequence
  sgRNA
acgttaacgggtgggttccc

SEQ ID NO: 421 - DNA, 20 bp, Artificial Sequence
  sgRNA
catgtggttggctagaagca

SEQ ID NO: 422 - DNA, 20 bp, Artificial Sequence
  sgRNA
agtagagtggattataagac

SEQ ID NO: 423 - DNA, 20 bp, Artificial Sequence
  sgRNA
gggattgctatcgctttaaa

SEQ ID NO: 424 - DNA, 20 bp, Artificial Sequence
  sgRNA
gctgcttagtctgtcttctc

SEQ ID NO: 425 - DNA, 20 bp, Artificial Sequence
  sgRNA
tggaagagatgtgagtctgc

SEQ ID NO: 426 - DNA, 20 bp, Artificial Sequence
  sgRNA
gtcatcctgcttatgcaaga

SEQ ID NO: 427 - DNA, 20 bp, Artificial Sequence
  sgRNA
cgccgggcttcgcctccaag

SEQ ID NO: 428 - DNA, 20 bp, Artificial Sequence
  sgRNA
agagcgccttcagagaaatg

SEQ ID NO: 429 - DNA, 20 bp, Artificial Sequence
  sgRNA
cttctagaacgacaagggaa

SEQ ID NO: 430 - DNA, 20 bp, Artificial Sequence
  sgRNA
agcagcaggatttagaggga

SEQ ID NO: 431 - DNA, 20 bp, Artificial Sequence
  sgRNA
gaggatcagcgcaaacgtgg

SEQ ID NO: 432 - DNA, 20 bp, Artificial Sequence
  sgRNA
acacaccgcggacgagctgg

SEQ ID NO: 433 - DNA, 20 bp, Artificial Sequence
  sgRNA
ttgtcatcccagtagcaaag

SEQ ID NO: 434 - DNA, 20 bp, Artificial Sequence
  sgRNA
tgactaggtctaaacgctct

SEQ ID NO: 435 - DNA, 20 bp, Artificial Sequence
  sgRNA
gggtggcagttcagatcatc

SEQ ID NO: 436 - DNA, 20 bp, Artificial Sequence
  sgRNA
ccgatggcgagcattggttg

SEQ ID NO: 437 - DNA, 20 bp, Artificial Sequence
  sgRNA
gatggtatcagcctgtcttc

SEQ ID NO: 438 - DNA, 20 bp, Artificial Sequence
  sgRNA
attggagtcgcgtctgcagg

SEQ ID NO: 439 - DNA, 20 bp, Artificial Sequence
  sgRNA
gctcttacatggtcctcacc

SEQ ID NO: 440 - DNA, 20 bp, Artificial Sequence
  sgRNA
ggctggctcctggcggagcg

SEQ ID NO: 441 - DNA, 20 bp, Artificial Sequence
  sgRNA
tggctagggcgcatctgcag

SEQ ID NO: 442 - DNA, 20 bp, Artificial Sequence
  sgRNA
cactgaagtagaaacacatg

SEQ ID NO: 443 - DNA, 20 bp, Artificial Sequence
  sgRNA
gtgtaggtgaatactgataa

SEQ ID NO: 444 - DNA, 20 bp, Artificial Sequence
  sgRNA
agtaaatctgagccacgcca

SEQ ID NO: 445 - DNA, 20 bp, Artificial Sequence
  sgRNA
tcaggcttgcagaatcatag

SEQ ID NO: 446 - DNA, 20 bp, Artificial Sequence
  sgRNA
gcgctgaaagagctgatttg

SEQ ID NO: 447 - DNA, 20 bp, Artificial Sequence
  sgRNA
tggagggcgggcgttgcaga

SEQ ID NO: 448 - DNA, 20 bp, Artificial Sequence
  sgRNA
acttgtgataccgcacacct

SEQ ID NO: 449 - DNA, 20 bp, Artificial Sequence
  sgRNA
aatcagataccatattgcta

SEQ ID NO: 450 - DNA, 20 bp, Artificial Sequence
  sgRNA
agtgccgccctctggcggct

SEQ ID NO: 451 - DNA, 20 bp, Artificial Sequence
  sgRNA
gtcgcgtgccggtgtcgccg

SEQ ID NO: 452 - DNA, 20 bp, Artificial Sequence
  sgRNA
tttgaaacgtctccaacgat

SEQ ID NO: 453 - DNA, 20 bp, Artificial Sequence
  sgRNA
taattagctcttatccctat

SEQ ID NO: 454 - DNA, 20 bp, Artificial Sequence
  sgRNA
tccttgcaatgacaaacctg

SEQ ID NO: 455 - DNA, 20 bp, Artificial Sequence
  sgRNA
agaagctgaaatctagaact

SEQ ID NO: 456 - DNA, 20 bp, Artificial Sequence
  sgRNA
accgggaagaggtgggagac

SEQ ID NO: 457 - DNA, 20 bp, Artificial Sequence
  sgRNA
cgcccaccgtggctgagtcc

SEQ ID NO: 458 - DNA, 20 bp, Artificial Sequence
  sgRNA
cacttctaaactacagaaat

SEQ ID NO: 459 - DNA, 20 bp, Artificial Sequence
  sgRNA
gcaggaggcagcgtcggccc

SEQ ID NO: 460 - DNA, 20 bp, Artificial Sequence
  sgRNA
cccttcgctagccgggaccc

SEQ ID NO: 461 - DNA, 20 bp, Artificial Sequence
  sgRNA
ttctgccttgtaaggccggg

SEQ ID NO: 462 - DNA, 20 bp, Artificial Sequence
  sgRNA
aatctttaggtctcagttcc

SEQ ID NO: 463 - DNA, 20 bp, Artificial Sequence
  sgRNA
cgcctgaacttcctcctgcg

SEQ ID NO: 464 - DNA, 20 bp, Artificial Sequence
  sgRNA
aaggaacacacctttaatcg

SEQ ID NO: 465 - DNA, 20 bp, Artificial Sequence
  sgRNA
tctctggcctttacagcagc

SEQ ID NO: 466 - DNA, 20 bp, Artificial Sequence
  sgRNA
gcccttctctcctacgcccg

SEQ ID NO: 467 - DNA, 20 bp, Artificial Sequence
  sgRNA
ctgctatgtggctcttctca

SEQ ID NO: 468 - DNA, 20 bp, Artificial Sequence
  sgRNA
gctctttaggttattggatc

SEQ ID NO: 469 - DNA, 20 bp, Artificial Sequence
  sgRNA
acacatgggctttcttgaaa

SEQ ID NO: 470 - DNA, 20 bp, Artificial Sequence
  sgRNA
caagcaagtcatgatgaaac

SEQ ID NO: 471 - DNA, 20 bp, Artificial Sequence
  sgRNA
tctggcttctctaccgtcag

SEQ ID NO: 472 - DNA, 20 bp, Artificial Sequence
  sgRNA
cgctctatctccttaagaac

SEQ ID NO: 473 - DNA, 20 bp, Artificial Sequence
  sgRNA
gttccttcccacccatcggc

SEQ ID NO: 474 - DNA, 20 bp, Artificial Sequence
  sgRNA
cggcggcggcaactccgcat

SEQ ID NO: 475 - DNA, 20 bp, Artificial Sequence
  sgRNA
acaagtatcctacaccaaag

SEQ ID NO: 476 - DNA, 20 bp, Artificial Sequence
  sgRNA
gggagactaggaaactggag

SEQ ID NO: 477 - DNA, 20 bp, Artificial Sequence
  sgRNA
actgacgcagcgcgggcgcg

SEQ ID NO: 478 - DNA, 20 bp, Artificial Sequence
  sgRNA
ggccttgacgaagctagccc

SEQ ID NO: 479 - DNA, 20 bp, Artificial Sequence
  sgRNA
cgagagacaatatggccgcg

SEQ ID NO: 480 - DNA, 20 bp, Artificial Sequence
  sgRNA
ctgtggctccagtcccagtt

SEQ ID NO: 481 - DNA, 20 bp, Artificial Sequence
  sgRNA
gatatgcaagattctacttt

SEQ ID NO: 482 - DNA, 20 bp, Artificial Sequence
  sgRNA
tttgagtatctacacggtga

SEQ ID NO: 483 - DNA, 20 bp, Artificial Sequence
  sgRNA
atgctgcagtaataatcgca

SEQ ID NO: 484 - DNA, 20 bp, Artificial Sequence
  sgRNA
attatctagggtggctgctg

SEQ ID NO: 485 - DNA, 20 bp, Artificial Sequence
  sgRNA
tttacccgcggtgcatgttg

SEQ ID NO: 486 - DNA, 20 bp, Artificial Sequence
  sgRNA
caatcattggttctaatcca

SEQ ID NO: 487 - DNA, 20 bp, Artificial Sequence
  sgRNA
acatcacccatctctagccc

SEQ ID NO: 488 - DNA, 20 bp, Artificial Sequence
  sgRNA
gccgcgggctcgctccaccc

SEQ ID NO: 489 - DNA, 20 bp, Artificial Sequence
  sgRNA
tgagcacagagtcccgctag

SEQ ID NO: 490 - DNA, 20 bp, Artificial Sequence
  sgRNA
aggattaacactggagaaca

SEQ ID NO: 491 - DNA, 20 bp, Artificial Sequence
  sgRNA
gagccagaggaaagaaagcc

SEQ ID NO: 492 - DNA, 20 bp, Artificial Sequence
  sgRNA
agtcaagagcaggtgccgcc

SEQ ID NO: 493 - DNA, 20 bp, Artificial Sequence
  sgRNA
tattgctggaagacagagag

SEQ ID NO: 494 - DNA, 20 bp, Artificial Sequence
  sgRNA
tttatagctctcactcaaag

SEQ ID NO: 495 - DNA, 20 bp, Artificial Sequence
  sgRNA
cccagtaggctgtggcccag

SEQ ID NO: 496 - DNA, 20 bp, Artificial Sequence
  sgRNA
accagctccggtttggccac

SEQ ID NO: 497 - DNA, 20 bp, Artificial Sequence
  sgRNA
tggactaacctgagcgccga

SEQ ID NO: 498 - DNA, 20 bp, Artificial Sequence
  sgRNA
cgctgtgcgctagattgcaa

SEQ ID NO: 499 - DNA, 20 bp, Artificial Sequence
  sgRNA
catgatgaggtcaaagaatt

SEQ ID NO: 500 - DNA, 20 bp, Artificial Sequence
  sgRNA
agagctcggaggtgtgggta

SEQ ID NO: 501 - DNA, 20 bp, Artificial Sequence
  sgRNA
gaggtagacaagtggtctgg

SEQ ID NO: 502 - DNA, 20 bp, Artificial Sequence
  sgRNA
tggtacggcccagcgctagc

SEQ ID NO: 503 - DNA, 20 bp, Artificial Sequence
  sgRNA
gagtctctctgacagggcgg

SEQ ID NO: 504 - DNA, 20 bp, Artificial Sequence
  sgRNA
tgtagagagtgataagggtt

SEQ ID NO: 505 - DNA, 20 bp, Artificial Sequence
  sgRNA
gtacttaagagtgttctagg

SEQ ID NO: 506 - DNA, 20 bp, Artificial Sequence
  sgRNA
taccagtaacagactcatgg

SEQ ID NO: 507 - DNA, 20 bp, Artificial Sequence
  sgRNA
ggtttggtatcttccatgca

SEQ ID NO: 508 - DNA, 20 bp, Artificial Sequence
  sgRNA
cgctgagcagggcgagtgac

SEQ ID NO: 509 - DNA, 20 bp, Artificial Sequence
  sgRNA
agccagaagtagagattgtt

SEQ ID NO: 510 - DNA, 20 bp, Artificial Sequence
  sgRNA
tgtaatcacgagtacttccg

SEQ ID NO: 511 - DNA, 20 bp, Artificial Sequence
  sgRNA
cttgtttattgtcgcgccgc

SEQ ID NO: 512 - DNA, 20 bp, Artificial Sequence
  sgRNA
gtctgcctggcgaccttgat

SEQ ID NO: 513 - DNA, 20 bp, Artificial Sequence
  sgRNA
gggtacaaaggtgcctagtc

SEQ ID NO: 514 - DNA, 20 bp, Artificial Sequence
  sgRNA
gcgccagagttgcaggcggg

SEQ ID NO: 515 - DNA, 20 bp, Artificial Sequence
  sgRNA
gaccagtagatggctcataa

SEQ ID NO: 516 - DNA, 20 bp, Artificial Sequence
  sgRNA
ggcagtgggaggtgctgagc

SEQ ID NO: 517 - DNA, 20 bp, Artificial Sequence
  sgRNA
tggcaagacttgacttatcc

SEQ ID NO: 518 - DNA, 20 bp, Artificial Sequence
  sgRNA
tcttcgtaagcgtgaagcgc

SEQ ID NO: 519 - DNA, 20 bp, Artificial Sequence
  sgRNA
tgtactgatctgggatctca

SEQ ID NO: 520 - DNA, 20 bp, Artificial Sequence
  sgRNA
aacatggagagagtgttaga

SEQ ID NO: 521 - DNA, 20 bp, Artificial Sequence
  sgRNA
tttgttctgagagggagaga

SEQ ID NO: 522 - DNA, 20 bp, Artificial Sequence
  sgRNA
cgagtgagcccacgagagcc

SEQ ID NO: 523 - DNA, 20 bp, Artificial Sequence
  sgRNA
acaacctcaagaagttaaat

SEQ ID NO: 524 - DNA, 20 bp, Artificial Sequence
  sgRNA
gttcagctaccgcaatccag

SEQ ID NO: 525 - DNA, 20 bp, Artificial Sequence
  sgRNA
ttaaataggacagttcggcc

SEQ ID NO: 526 - DNA, 20 bp, Artificial Sequence
  sgRNA
acgcgaacgctatggacacg

SEQ ID NO: 527 - DNA, 20 bp, Artificial Sequence
  sgRNA
attcaccacaagcacagcaa

SEQ ID NO: 528 - DNA, 20 bp, Artificial Sequence
  sgRNA
actttggttcctcacatggc

SEQ ID NO: 529 - DNA, 20 bp, Artificial Sequence
  sgRNA
ggacgaacagacacgtgctg

SEQ ID NO: 530 - DNA, 20 bp, Artificial Sequence
  sgRNA
tgtcatggtttgaaatcctg

SEQ ID NO: 531 - DNA, 20 bp, Artificial Sequence
  sgRNA
ggaaagctgatgcgcaggcg

SEQ ID NO: 532 - DNA, 20 bp, Artificial Sequence
  sgRNA
gaatttggttgtaaataacg

SEQ ID NO: 533 - DNA, 20 bp, Artificial Sequence
  sgRNA
cggaccggaagtagttacag

SEQ ID NO: 534 - DNA, 20 bp, Artificial Sequence
  sgRNA
gggcagacctcaacacttcc

SEQ ID NO: 535 - DNA, 20 bp, Artificial Sequence
  sgRNA
gctttaagaaggtgcggagg

SEQ ID NO: 536 - DNA, 20 bp, Artificial Sequence
  sgRNA
ttacttgagaccatctgagg

SEQ ID NO: 537 - DNA, 20 bp, Artificial Sequence
  sgRNA
cagtgaccacatgaaccttg

SEQ ID NO: 538 - DNA, 20 bp, Artificial Sequence
  sgRNA
tttgtgaaggctttctgcac

SEQ ID NO: 539 - DNA, 20 bp, Artificial Sequence
  sgRNA
ttctctggagagcatctccc

SEQ ID NO: 540 - DNA, 20 bp, Artificial Sequence
  sgRNA
tctggctgcgaaggtgcgtg

SEQ ID NO: 541 - DNA, 20 bp, Artificial Sequence
  sgRNA
gcagctctgttcttgaatga

SEQ ID NO: 542 - DNA, 20 bp, Artificial Sequence
  sgRNA
aacgccgcccgcccgttgca

SEQ ID NO: 543 - DNA, 20 bp, Artificial Sequence
  sgRNA
gctcacctgggagcttccta

SEQ ID NO: 544 - DNA, 20 bp, Artificial Sequence
  sgRNA
tcaccctggcaaccgcggct

SEQ ID NO: 545 - DNA, 20 bp, Artificial Sequence
  sgRNA
tggaacggaagttccggcgg

SEQ ID NO: 546 - DNA, 20 bp, Artificial Sequence
  sgRNA
gtccgactcttggttccctc

SEQ ID NO: 547 - DNA, 20 bp, Artificial Sequence
  sgRNA
agagccttgctgtagaagcc

SEQ ID NO: 548 - DNA, 20 bp, Artificial Sequence
  sgRNA
aagtccgttgacttcccagc

SEQ ID NO: 549 - DNA, 20 bp, Artificial Sequence
  sgRNA
ggtgtgtccgcgcaccacgg

SEQ ID NO: 550 - DNA, 20 bp, Artificial Sequence
  sgRNA
gacccagaaaggcgaagtga

SEQ ID NO: 551 - DNA, 20 bp, Artificial Sequence
  sgRNA
agctcgaaagagccaatcag

SEQ ID NO: 552 - DNA, 20 bp, Artificial Sequence
  sgRNA
gagagggatgtctgcagcgc

SEQ ID NO: 553 - DNA, 20 bp, Artificial Sequence
  sgRNA
tggtggcacatcccagccct

SEQ ID NO: 554 - DNA, 20 bp, Artificial Sequence
  sgRNA
ggaagaaattcaaaccgaga

SEQ ID NO: 555 - DNA, 20 bp, Artificial Sequence
  sgRNA
aactggaagtgtggtgggcg

SEQ ID NO: 556 - DNA, 20 bp, Artificial Sequence
  sgRNA
ccacgcctcttcgcgctaac

SEQ ID NO: 557 - DNA, 20 bp, Artificial Sequence
  sgRNA
tgtcgggacacaggaccctc

SEQ ID NO: 558 - DNA, 20 bp, Artificial Sequence
  sgRNA
ggctgtctgccaagagttcg

SEQ ID NO: 559 - DNA, 20 bp, Artificial Sequence
  sgRNA
ccctgtttcctgcccaagtc

SEQ ID NO: 560 - DNA, 20 bp, Artificial Sequence
  sgRNA
tttgataggcggagttacgg

SEQ ID NO: 561 - DNA, 20 bp, Artificial Sequence
  sgRNA
gttgtcatctaatcagctac

SEQ ID NO: 562 - DNA, 20 bp, Artificial Sequence
  sgRNA
gctcgagccaatccaacggg

SEQ ID NO: 563 - DNA, 20 bp, Artificial Sequence
  sgRNA
tatcacacaaagtgacttta

SEQ ID NO: 564 - DNA, 20 bp, Artificial Sequence
  sgRNA
gggtcgctgagccggtgcgc

SEQ ID NO: 565 - DNA, 20 bp, Artificial Sequence
  sgRNA
cccgcgatggctaaggaatg

SEQ ID NO: 566 - DNA, 20 bp, Artificial Sequence
  sgRNA
gggacaaagagcgtggccta

SEQ ID NO: 567 - DNA, 20 bp, Artificial Sequence
  sgRNA
gggcctatactgagagatgg

SEQ ID NO: 568 - DNA, 20 bp, Artificial Sequence
  sgRNA
ccgaggttcccaaacctaga

SEQ ID NO: 569 - DNA, 20 bp, Artificial Sequence
  sgRNA
ttgacaaggcgatgtttgca

SEQ ID NO: 570 - DNA, 20 bp, Artificial Sequence
  sgRNA
ggtgatgctggatgtgtttg

SEQ ID NO: 571 - DNA, 20 bp, Artificial Sequence
  sgRNA
cgggtgcgatgttgacagcc

SEQ ID NO: 572 - DNA, 20 bp, Artificial Sequence
  sgRNA
actcacttggttgcgcgacg

SEQ ID NO: 573 - DNA, 20 bp, Artificial Sequence
  sgRNA
tggctaaagtagagctcttg

SEQ ID NO: 574 - DNA, 20 bp, Artificial Sequence
  sgRNA
tctcggagcctcagacgctc

SEQ ID NO: 575 - DNA, 20 bp, Artificial Sequence
  sgRNA
gggcagtccggagtccgtcc

SEQ ID NO: 576 - DNA, 20 bp, Artificial Sequence
  sgRNA
aatactctgggaacaccgat

SEQ ID NO: 577 - DNA, 20 bp, Artificial Sequence
  sgRNA
ggctgtcattagcagttaca

SEQ ID NO: 578 - DNA, 20 bp, Artificial Sequence
  sgRNA
tggatccgtggcgcctcgcc

SEQ ID NO: 579 - DNA, 20 bp, Artificial Sequence
  sgRNA
tagcggcgcgcgcgcgggtt

SEQ ID NO: 580 - DNA, 20 bp, Artificial Sequence
  sgRNA
gggtcaaactgcgattccgt

SEQ ID NO: 581 - DNA, 20 bp, Artificial Sequence
  sgRNA
ccctcctacctgcctactct

SEQ ID NO: 582 - DNA, 20 bp, Artificial Sequence
  sgRNA
cgttacttcactgaggcaga

SEQ ID NO: 583 - DNA, 20 bp, Artificial Sequence
  sgRNA
tgctacatagtttaagagcc

SEQ ID NO: 584 - DNA, 20 bp, Artificial Sequence
  sgRNA
gggcccaagagatgagccac

SEQ ID NO: 585 - DNA, 20 bp, Artificial Sequence
  sgRNA
ctctcacgtcccggcggctg

SEQ ID NO: 586 - DNA, 20 bp, Artificial Sequence
  sgRNA
ctccacccaaagccacgggc

SEQ ID NO: 587 - DNA, 20 bp, Artificial Sequence
  sgRNA
gagacctgtcagcgcccgcg

SEQ ID NO: 588 - DNA, 20 bp, Artificial Sequence
  sgRNA
gcacccacttcccatattga

SEQ ID NO: 589 - DNA, 20 bp, Artificial Sequence
  sgRNA
taatctcattaacgcgcgcg

SEQ ID NO: 590 - DNA, 20 bp, Artificial Sequence
  sgRNA
ggctgaggagctccgcgcac

SEQ ID NO: 591 - DNA, 20 bp, Artificial Sequence
  sgRNA
cgcatttagtaatacgcgcg

SEQ ID NO: 592 - DNA, 20 bp, Artificial Sequence
  sgRNA
ctgttgctgagactggctgc

SEQ ID NO: 593 - DNA, 20 bp, Artificial Sequence
  sgRNA
cagagagccggctccggagg

SEQ ID NO: 594 - DNA, 20 bp, Artificial Sequence
  sgRNA
ttaatgattgtcggactcgg

SEQ ID NO: 595 - DNA, 20 bp, Artificial Sequence
  sgRNA
gcagtaagagctcactgaag

SEQ ID NO: 596 - DNA, 20 bp, Artificial Sequence
  sgRNA
tctcctgcatcccggccggg

SEQ ID NO: 597 - DNA, 20 bp, Artificial Sequence
  sgRNA
gcaaatccagcaagacaatg

SEQ ID NO: 598 - DNA, 20 bp, Artificial Sequence
  sgRNA
aaaggatcagctgaaatcct

SEQ ID NO: 599 - DNA, 20 bp, Artificial Sequence
  sgRNA
ttctttggaccggaagcagg

SEQ ID NO: 600 - DNA, 20 bp, Artificial Sequence
  sgRNA
ggaggagctgaagaagggcg

SEQ ID NO: 601 - DNA, 20 bp, Artificial Sequence
  sgRNA
gcttaaggcaacatccttct

SEQ ID NO: 602 - DNA, 20 bp, Artificial Sequence
  sgRNA
agctgtttgcggcgacgatc

SEQ ID NO: 603 - DNA, 20 bp, Artificial Sequence
  sgRNA
tggcggagcccacctggccc

SEQ ID NO: 604 - DNA, 20 bp, Artificial Sequence
  sgRNA
gtgtgtgtgtgacttactga

SEQ ID NO: 605 - DNA, 20 bp, Artificial Sequence
  sgRNA
ataggcaccagtgactgtcc

SEQ ID NO: 606 - DNA, 20 bp, Artificial Sequence
  sgRNA
gggcggctcaggcctttccc

SEQ ID NO: 607 - DNA, 20 bp, Artificial Sequence
  sgRNA
gacagcctatagtcacttgg

SEQ ID NO: 608 - DNA, 20 bp, Artificial Sequence
  sgRNA
gattacccttcttaccctcg

SEQ ID NO: 609 - DNA, 20 bp, Artificial Sequence
  sgRNA
gctgcttccaggaagggctt

SEQ ID NO: 610 - DNA, 20 bp, Artificial Sequence
  sgRNA
cgcgaaggctgccggcagcc

SEQ ID NO: 611 - DNA, 20 bp, Artificial Sequence
  sgRNA
aaagaacctcacataagctc

SEQ ID NO: 612 - DNA, 20 bp, Artificial Sequence
  sgRNA
gatatagggctctggcggcg

SEQ ID NO: 613 - DNA, 20 bp, Artificial Sequence
  sgRNA
ttagctagggagtcagctgt

SEQ ID NO: 614 - DNA, 20 bp, Artificial Sequence
  sgRNA
ttgatctgacaagtgattcg

SEQ ID NO: 615 - DNA, 20 bp, Artificial Sequence
  sgRNA
cccagtgaggagctgcctgc

SEQ ID NO: 616 - DNA, 20 bp, Artificial Sequence
  sgRNA
gcagagcctttggtacgcat

SEQ ID NO: 617 - DNA, 20 bp, Artificial Sequence
  sgRNA
gaaagaatgcccgcctggcg

SEQ ID NO: 618 - DNA, 20 bp, Artificial Sequence
  sgRNA
ccctccgctcagcagaagcc

SEQ ID NO: 619 - DNA, 20 bp, Artificial Sequence
  sgRNA
catgcgcatttgcaagcgct

SEQ ID NO: 620 - DNA, 20 bp, Artificial Sequence
  sgRNA
gtgtgtatttcaccaaccct

SEQ ID NO: 621 - DNA, 20 bp, Artificial Sequence
  sgRNA
gtaatttcacatgctgccca

SEQ ID NO: 622 - DNA, 20 bp, Artificial Sequence
  sgRNA
cagcttcacgcgcgcatccc

SEQ ID NO: 623 - DNA, 20 bp, Artificial Sequence
  sgRNA
tagagctcatttgtctgcaa

SEQ ID NO: 624 - DNA, 20 bp, Artificial Sequence
  sgRNA
atgtctttagaaatactgca

SEQ ID NO: 625 - DNA, 20 bp, Artificial Sequence
  sgRNA
gtgcagtgcagcgaggatgg

SEQ ID NO: 626 - DNA, 20 bp, Artificial Sequence
  sgRNA
ggaacagctgcaaattggac

SEQ ID NO: 627 - DNA, 20 bp, Artificial Sequence
  sgRNA
ggtctgccaggtgagatact

SEQ ID NO: 628 - DNA, 20 bp, Artificial Sequence
  sgRNA
gtcagaatcgcgagggccag

SEQ ID NO: 629 - DNA, 20 bp, Artificial Sequence
  sgRNA
caaagggattgagccggctg

SEQ ID NO: 630 - DNA, 20 bp, Artificial Sequence
  sgRNA
aagtcaaggctgcctcatcc

SEQ ID NO: 631 - DNA, 20 bp, Artificial Sequence
  sgRNA
cacgggtgatgtatgctcct

SEQ ID NO: 632 - DNA, 20 bp, Artificial Sequence
  sgRNA
gcggccaggccacaaccgag

SEQ ID NO: 633 - DNA, 20 bp, Artificial Sequence
  sgRNA
agtccagatgtcgctctccc

SEQ ID NO: 634 - DNA, 20 bp, Artificial Sequence
  sgRNA
cagcagcgaatgggagctca

SEQ ID NO: 635 - DNA, 20 bp, Artificial Sequence
  sgRNA
cccaggacttctcccggatc

SEQ ID NO: 636 - DNA, 20 bp, Artificial Sequence
  sgRNA
gctggcggaacccagaagca

SEQ ID NO: 637 - DNA, 20 bp, Artificial Sequence
  sgRNA
gtggtctaagatcctctgaa

SEQ ID NO: 638 - DNA, 20 bp, Artificial Sequence
  sgRNA
catgcgcaccgcggtccgcc

SEQ ID NO: 639 - DNA, 20 bp, Artificial Sequence
  sgRNA
gcgggagctacggcggcgct

SEQ ID NO: 640 - DNA, 20 bp, Artificial Sequence
  sgRNA
gtcagaggttctagccggag

SEQ ID NO: 641 - DNA, 20 bp, Artificial Sequence
  sgRNA
tcgcttcagtcacctccctg

SEQ ID NO: 642 - DNA, 20 bp, Artificial Sequence
  sgRNA
ctggattagagccagtcgcc

SEQ ID NO: 643 - DNA, 20 bp, Artificial Sequence
  sgRNA
catgactacctgggaggaga

SEQ ID NO: 644 - DNA, 20 bp, Artificial Sequence
  sgRNA
gagggtagggctgagcttgc

SEQ ID NO: 645 - DNA, 20 bp, Artificial Sequence
  sgRNA
cccgcccaggaaagctgtca

SEQ ID NO: 646 - DNA, 20 bp, Artificial Sequence
  sgRNA
tgcatcctgtgatgtgagat

SEQ ID NO: 647 - DNA, 20 bp, Artificial Sequence
  sgRNA
tccctgccaagaagtggaaa

SEQ ID NO: 648 - DNA, 20 bp, Artificial Sequence
  sgRNA
atggagtgcatggccggcgg

SEQ ID NO: 649 - DNA, 20 bp, Artificial Sequence
  sgRNA
gcatgagggcgagtgtgcga

SEQ ID NO: 650 - DNA, 20 bp, Artificial Sequence
  sgRNA
gggcgcggtgcactaggcgc

SEQ ID NO: 651 - DNA, 20 bp, Artificial Sequence
  sgRNA
ggcttaaggagaattgccaa

SEQ ID NO: 652 - DNA, 20 bp, Artificial Sequence
  sgRNA
aaatgctccgctacaaacac

SEQ ID NO: 653 - DNA, 20 bp, Artificial Sequence
  sgRNA
ttgctgctagctggaaccca

SEQ ID NO: 654 - DNA, 20 bp, Artificial Sequence
  sgRNA
tttgctttccgtcggagcct

SEQ ID NO: 655 - DNA, 20 bp, Artificial Sequence
  sgRNA
atcagagttatatggaaatc

SEQ ID NO: 656 - DNA, 20 bp, Artificial Sequence
  sgRNA
gggctggaactgagaggtct

SEQ ID NO: 657 - DNA, 20 bp, Artificial Sequence
  sgRNA
gcaagagtacgcagattaag

SEQ ID NO: 658 - DNA, 20 bp, Artificial Sequence
  sgRNA
tcaccacactgtgtctgaga

SEQ ID NO: 659 - DNA, 20 bp, Artificial Sequence
  sgRNA
ggcttcaataagcgggtggg

SEQ ID NO: 660 - DNA, 20 bp, Artificial Sequence
  sgRNA
accgtggcggagccaggctg

SEQ ID NO: 661 - DNA, 20 bp, Artificial Sequence
  sgRNA
gcactaactttcggctggca

SEQ ID NO: 662 - DNA, 20 bp, Artificial Sequence
  sgRNA
tggcgtccctctctgggcac

SEQ ID NO: 663 - DNA, 20 bp, Artificial Sequence
  sgRNA
aataaatgacacgcctacgc

SEQ ID NO: 664 - DNA, 20 bp, Artificial Sequence
  sgRNA
gggagtgcagtctgggatac

SEQ ID NO: 665 - DNA, 20 bp, Artificial Sequence
  sgRNA
ctcactggaataaacattac

SEQ ID NO: 666 - DNA, 20 bp, Artificial Sequence
  sgRNA
gggctggaagaaatgcatag

SEQ ID NO: 667 - DNA, 20 bp, Artificial Sequence
  sgRNA
agagcagcatcgggaagtag

SEQ ID NO: 668 - DNA, 20 bp, Artificial Sequence
  sgRNA
tcgactggaaacttacacca

SEQ ID NO: 669 - DNA, 20 bp, Artificial Sequence
  sgRNA
aagtaggcagagtagtaaca

SEQ ID NO: 670 - DNA, 20 bp, Artificial Sequence
  sgRNA
gtcttagggaaacagcaatg

SEQ ID NO: 671 - DNA, 20 bp, Artificial Sequence
  sgRNA
tgcttccggaggcgggtcag

SEQ ID NO: 672 - DNA, 20 bp, Artificial Sequence
  sgRNA
tcgtcctgctcgtgttgctt

SEQ ID NO: 673 - DNA, 20 bp, Artificial Sequence
  sgRNA
agcttgaaacccgcgcgagg

SEQ ID NO: 674 - DNA, 20 bp, Artificial Sequence
  sgRNA
gttaattgagacggagctct

SEQ ID NO: 675 - DNA, 20 bp, Artificial Sequence
  sgRNA
cctgcaggcactgggtctga

SEQ ID NO: 676 - DNA, 20 bp, Artificial Sequence
  sgRNA
gcttgtcacgtgcaattctg

SEQ ID NO: 677 - DNA, 20 bp, Artificial Sequence
  sgRNA
gcgtcttccggcgcccgtgg

SEQ ID NO: 678 - DNA, 20 bp, Artificial Sequence
  sgRNA
gggagggtggccgccggaaa

SEQ ID NO: 679 - DNA, 20 bp, Artificial Sequence
  sgRNA
tgcttagctgcgcagctttg

SEQ ID NO: 680 - DNA, 20 bp, Artificial Sequence
  sgRNA
tttgggacagtcccactaaa

SEQ ID NO: 681 - DNA, 20 bp, Artificial Sequence
  sgRNA
cgctggccaatagaaagtct

SEQ ID NO: 682 - DNA, 20 bp, Artificial Sequence
  sgRNA
tggagagcccggcgctaccc

SEQ ID NO: 683 - DNA, 20 bp, Artificial Sequence
  sgRNA
cgggaggctgggctgctggg

SEQ ID NO: 684 - DNA, 20 bp, Artificial Sequence
  sgRNA
agggtgcaggttcaaacatc

SEQ ID NO: 685 - DNA, 20 bp, Artificial Sequence
  sgRNA
tatctccaagatccctatgc

SEQ ID NO: 686 - DNA, 20 bp, Artificial Sequence
  sgRNA
cgtaggcagctgccaaaccc

SEQ ID NO: 687 - DNA, 20 bp, Artificial Sequence
  sgRNA
cgcgagggctcggtgccgag

SEQ ID NO: 688 - DNA, 20 bp, Artificial Sequence
  sgRNA
acacacacacacactcacac

SEQ ID NO: 689 - DNA, 20 bp, Artificial Sequence
  sgRNA
gaagacaggcggtggaccaa

SEQ ID NO: 690 - DNA, 20 bp, Artificial Sequence
  sgRNA
gagacgcctaatacatggac

SEQ ID NO: 691 - DNA, 20 bp, Artificial Sequence
  sgRNA
cctgttgggagcagctctca

SEQ ID NO: 692 - DNA, 20 bp, Artificial Sequence
  sgRNA
gtggaatcggtgggaggaac

SEQ ID NO: 693 - DNA, 20 bp, Artificial Sequence
  sgRNA
caggcactacaggaatgacc

SEQ ID NO: 694 - DNA, 20 bp, Artificial Sequence
  sgRNA
cgccgccagggcgttgggcg

SEQ ID NO: 695 - DNA, 20 bp, Artificial Sequence
  sgRNA
acacgtcacctctacgtgat

SEQ ID NO: 696 - DNA, 20 bp, Artificial Sequence
  sgRNA
ctgtattgtccagttgctag

SEQ ID NO: 697 - DNA, 20 bp, Artificial Sequence
  sgRNA
ataaagcattcagccctgcg

SEQ ID NO: 698 - DNA, 20 bp, Artificial Sequence
  sgRNA
atcgcgtgtgcggcctaaac

SEQ ID NO: 699 - DNA, 20 bp, Artificial Sequence
  sgRNA
aagttatgagtgcaaatcat

SEQ ID NO: 700 - DNA, 20 bp, Artificial Sequence
  sgRNA
ccacagcgccactcaacggc

SEQ ID NO: 701 - DNA, 20 bp, Artificial Sequence
  sgRNA
agcgcggcggtgcaggccaa

SEQ ID NO: 702 - DNA, 20 bp, Artificial Sequence
  sgRNA
ctgtggagggcgaaaggacg

SEQ ID NO: 703 - DNA, 20 bp, Artificial Sequence
  sgRNA
agaccagtggttcaatctcc

SEQ ID NO: 704 - DNA, 20 bp, Artificial Sequence
  sgRNA
gtcagagcacagtggagaac

SEQ ID NO: 705 - DNA, 20 bp, Artificial Sequence
  sgRNA
aggagagtctgtgcagatcc

SEQ ID NO: 706 - DNA, 20 bp, Artificial Sequence
  sgRNA
ctgactattggtctccgctg

SEQ ID NO: 707 - DNA, 20 bp, Artificial Sequence
  sgRNA
gattgagagtgcccgactcc

SEQ ID NO: 708 - DNA, 20 bp, Artificial Sequence
  sgRNA
tggaactctacaaatctcca

SEQ ID NO: 709 - DNA, 20 bp, Artificial Sequence
  sgRNA
cgcgtggcgtggttcggcca

SEQ ID NO: 710 - DNA, 20 bp, Artificial Sequence
  sgRNA
aacgtcttcaaccatagcaa

SEQ ID NO: 711 - DNA, 20 bp, Artificial Sequence
  sgRNA
gcttggaggcagaactccca

SEQ ID NO: 712 - DNA, 20 bp, Artificial Sequence
  sgRNA
gcaggtccgagcggctggcg

SEQ ID NO: 713 - DNA, 20 bp, Artificial Sequence
  sgRNA
aaatagggcagccgcggcag

SEQ ID NO: 714 - DNA, 20 bp, Artificial Sequence
  sgRNA
ggagtgcaggcgcctcgcga

SEQ ID NO: 715 - DNA, 20 bp, Artificial Sequence
  sgRNA
ccatgcaggattggccagat

SEQ ID NO: 716 - DNA, 20 bp, Artificial Sequence
  sgRNA
aacgggcacacgttggtaac

SEQ ID NO: 717 - DNA, 20 bp, Artificial Sequence
  sgRNA
atttattgacttcggatgca

SEQ ID NO: 718 - DNA, 20 bp, Artificial Sequence
  sgRNA
tttccactaccgcagatcct

SEQ ID NO: 719 - DNA, 20 bp, Artificial Sequence
  sgRNA
gaaagacaagaatgagccaa

SEQ ID NO: 720 - DNA, 20 bp, Artificial Sequence
  sgRNA
ctcaccaagttgtctgtcag

SEQ ID NO: 721 - DNA, 20 bp, Artificial Sequence
  sgRNA
tgagcaaatatgcccagtca

SEQ ID NO: 722 - DNA, 20 bp, Artificial Sequence
  sgRNA
gctaagagccagccatgcta

SEQ ID NO: 723 - DNA, 20 bp, Artificial Sequence
  sgRNA
aggtttcaggaacagtggta

SEQ ID NO: 724 - DNA, 20 bp, Artificial Sequence
  sgRNA
caataaccactcatctccct

SEQ ID NO: 725 - DNA, 20 bp, Artificial Sequence
  sgRNA
ttccatacaagcgcatttct

SEQ ID NO: 726 - DNA, 20 bp, Artificial Sequence
  sgRNA
ttggttaaattggcctctcc

SEQ ID NO: 727 - DNA, 20 bp, Artificial Sequence
  sgRNA
tgacttgactcatctgtgat

SEQ ID NO: 728 - DNA, 20 bp, Artificial Sequence
  sgRNA
ggctggcttctccatcatgg

SEQ ID NO: 729 - DNA, 20 bp, Artificial Sequence
  sgRNA
gcaacgcgcctgcttacgct

SEQ ID NO: 730 - DNA, 20 bp, Artificial Sequence
  sgRNA
gggacgccaggctcggtgac

SEQ ID NO: 731 - DNA, 20 bp, Artificial Sequence
  sgRNA
ttaatgcagcttgtttgata

SEQ ID NO: 732 - DNA, 20 bp, Artificial Sequence
  sgRNA
caactaggcagttggactcc

SEQ ID NO: 733 - DNA, 20 bp, Artificial Sequence
  sgRNA
ttccgcaggtgtcctgcagg

SEQ ID NO: 734 - DNA, 20 bp, Artificial Sequence
  sgRNA
atgtaacctaggtaggaaga

SEQ ID NO: 735 - DNA, 20 bp, Artificial Sequence
  sgRNA
agggaatctttgacagcgcc

SEQ ID NO: 736 - DNA, 20 bp, Artificial Sequence
  sgRNA
tatttcaaacaacagccagc

SEQ ID NO: 737 - DNA, 20 bp, Artificial Sequence
  sgRNA
aagcaatcaatcgcccaacc

SEQ ID NO: 738 - DNA, 20 bp, Artificial Sequence
  sgRNA
gaagtctctccaaggcatcc

SEQ ID NO: 739 - DNA, 20 bp, Artificial Sequence
  sgRNA
gacgagcctccgcgaagcag

SEQ ID NO: 740 - DNA, 20 bp, Artificial Sequence
  sgRNA
ctctagaagctagataagcg

SEQ ID NO: 741 - DNA, 20 bp, Artificial Sequence
  sgRNA
gagggaagaagaggcgcgag

SEQ ID NO: 742 - DNA, 20 bp, Artificial Sequence
  sgRNA
gggcagagccagcggaggaa

SEQ ID NO: 743 - DNA, 20 bp, Artificial Sequence
  sgRNA
tttactctttcctacctgaa

SEQ ID NO: 744 - DNA, 20 bp, Artificial Sequence
  sgRNA
tagggagctcaaagtccgac

SEQ ID NO: 745 - DNA, 20 bp, Artificial Sequence
  sgRNA
ctcagctctttctcatcaga

SEQ ID NO: 746 - DNA, 20 bp, Artificial Sequence
  sgRNA
taaagggcatgcatgcctcc

SEQ ID NO: 747 - DNA, 20 bp, Artificial Sequence
  sgRNA
caaggttctagacaacaccc

SEQ ID NO: 748 - DNA, 20 bp, Artificial Sequence
  sgRNA
acaacagcggatgccagccc

SEQ ID NO: 749 - DNA, 20 bp, Artificial Sequence
  sgRNA
gccatttaacatcaagttcc

SEQ ID NO: 750 - DNA, 20 bp, Artificial Sequence
  sgRNA
aaggcagggcgcgcgcctcg

SEQ ID NO: 751 - DNA, 20 bp, Artificial Sequence
  sgRNA
cgggagggacgacaaggatg

SEQ ID NO: 752 - DNA, 20 bp, Artificial Sequence
  sgRNA
aaaggcccaagcttccaaga

SEQ ID NO: 753 - DNA, 20 bp, Artificial Sequence
  sgRNA
gcgctgggaatcggaaccgc

SEQ ID NO: 754 - DNA, 20 bp, Artificial Sequence
  sgRNA
tcccaatgggaccagagcag

SEQ ID NO: 755 - DNA, 20 bp, Artificial Sequence
  sgRNA
ttgggctgtcagcagatctg

SEQ ID NO: 756 - DNA, 20 bp, Artificial Sequence
  sgRNA
ggcgtgtttgcagcaaccac

SEQ ID NO: 757 - DNA, 20 bp, Artificial Sequence
  sgRNA
ttggaatcaccctctggacc

SEQ ID NO: 758 - DNA, 20 bp, Artificial Sequence
  sgRNA
gccggtggtaatggatgtgg

SEQ ID NO: 759 - DNA, 20 bp, Artificial Sequence
  sgRNA
gttcctatagctttcaaacg

SEQ ID NO: 760 - DNA, 20 bp, Artificial Sequence
  sgRNA
gatttctcagtgagtaaatt

SEQ ID NO: 761 - DNA, 20 bp, Artificial Sequence
  sgRNA
cttcggtgcctagcgggtgc

SEQ ID NO: 762 - DNA, 20 bp, Artificial Sequence
  sgRNA
tgcgcgctgattgacagctg

SEQ ID NO: 763 - DNA, 20 bp, Artificial Sequence
  sgRNA
ggtagcttgagggcaaagtt

SEQ ID NO: 764 - DNA, 20 bp, Artificial Sequence
  sgRNA
acatagtagctatgttgaca

SEQ ID NO: 765 - DNA, 20 bp, Artificial Sequence
  sgRNA
ccgaccggaagtgcagctgc

SEQ ID NO: 766 - DNA, 20 bp, Artificial Sequence
  sgRNA
cggaagtggccggagggcgc

SEQ ID NO: 767 - DNA, 20 bp, Artificial Sequence
  sgRNA
gcgttctacccagctgaagg

SEQ ID NO: 768 - DNA, 20 bp, Artificial Sequence
  sgRNA
aacttatgagaaggcccacc

SEQ ID NO: 769 - DNA, 20 bp, Artificial Sequence
  sgRNA
cgtttcacaattaaggtccc

SEQ ID NO: 770 - DNA, 20 bp, Artificial Sequence
  sgRNA
taaacaaggaaggacagctc

SEQ ID NO: 771 - DNA, 20 bp, Artificial Sequence
  sgRNA
agcagtaaattacttctgct

SEQ ID NO: 772 - DNA, 20 bp, Artificial Sequence
  sgRNA
tcggtcgcgatgcgccagcc

SEQ ID NO: 773 - DNA, 20 bp, Artificial Sequence
  sgRNA
aagcaagagcgcagagacat

SEQ ID NO: 774 - DNA, 20 bp, Artificial Sequence
  sgRNA
ataggacagcttacagctta

SEQ ID NO: 775 - DNA, 20 bp, Artificial Sequence
  sgRNA
ccagagttcatacaccttca

SEQ ID NO: 776 - DNA, 20 bp, Artificial Sequence
  sgRNA
gctcggcgtgttactacgtc

SEQ ID NO: 777 - DNA, 20 bp, Artificial Sequence
  sgRNA
ccacaggagatcaatggaaa

SEQ ID NO: 778 - DNA, 20 bp, Artificial Sequence
  sgRNA
gactgtggtgaacgcagagc

SEQ ID NO: 779 - DNA, 20 bp, Artificial Sequence
  sgRNA
aggcgcctagcggcctgaag

SEQ ID NO: 780 - DNA, 20 bp, Artificial Sequence
  sgRNA
atcttgagcaatcaagcgtt

SEQ ID NO: 781 - DNA, 20 bp, Artificial Sequence
  sgRNA
tgactcaggctaaggattcc

SEQ ID NO: 782 - DNA, 20 bp, Artificial Sequence
  sgRNA
gcgcattcgcctgctcctct

SEQ ID NO: 783 - DNA, 20 bp, Artificial Sequence
  sgRNA
acgtcacgggaggcgcgcgc

SEQ ID NO: 784 - DNA, 20 bp, Artificial Sequence
  sgRNA
tctatggtcgccgtttccca

SEQ ID NO: 785 - DNA, 20 bp, Artificial Sequence
  sgRNA
ggaagctctcacatccaagc

SEQ ID NO: 786 - DNA, 20 bp, Artificial Sequence
  sgRNA
agctgacagaccaatcgccc

SEQ ID NO: 787 - DNA, 20 bp, Artificial Sequence
  sgRNA
gggctcagatggtccaggtt

SEQ ID NO: 788 - DNA, 20 bp, Artificial Sequence
  sgRNA
acttgtgctaagaactttcc

SEQ ID NO: 789 - DNA, 20 bp, Artificial Sequence
  sgRNA
agctagtgtgatatactgat

SEQ ID NO: 790 - DNA, 20 bp, Artificial Sequence
  sgRNA
gattcgatgacacgatttcc

SEQ ID NO: 791 - DNA, 20 bp, Artificial Sequence
  sgRNA
actattcatccttaaatgct

SEQ ID NO: 792 - DNA, 20 bp, Artificial Sequence
  sgRNA
ggagcggcgcgcaaaccttc

SEQ ID NO: 793 - DNA, 20 bp, Artificial Sequence
  sgRNA
gaaccctccattaaagacaa

SEQ ID NO: 794 - DNA, 20 bp, Artificial Sequence
  sgRNA
gccagtggcagccgagtaag

SEQ ID NO: 795 - DNA, 20 bp, Artificial Sequence
  sgRNA
gcagaggtctctggccaaac

SEQ ID NO: 796 - DNA, 20 bp, Artificial Sequence
  sgRNA
tgggcacagagcgagggcga

SEQ ID NO: 797 - DNA, 20 bp, Artificial Sequence
  sgRNA
cccagttattcacaaccgcc

SEQ ID NO: 798 - DNA, 20 bp, Artificial Sequence
  sgRNA
gttaatgtcactgtgttcag

SEQ ID NO: 799 - DNA, 20 bp, Artificial Sequence
  sgRNA
cggctggacagagctgacac

SEQ ID NO: 800 - DNA, 20 bp, Artificial Sequence
  sgRNA
acaatactgcaagtggactc

SEQ ID NO: 801 - DNA, 20 bp, Artificial Sequence
  sgRNA
ccgggatggcgccagcctat

SEQ ID NO: 802 - DNA, 20 bp, Artificial Sequence
  sgRNA
gggattggttctcaagtacc

SEQ ID NO: 803 - DNA, 20 bp, Artificial Sequence
  sgRNA
tgtgtgaccctcagacaaca

SEQ ID NO: 804 - DNA, 20 bp, Artificial Sequence
  sgRNA
gagacgttgcgtgacgaccg

SEQ ID NO: 805 - DNA, 20 bp, Artificial Sequence
  sgRNA
aaattcataggcaccagcct

SEQ ID NO: 806 - DNA, 20 bp, Artificial Sequence
  sgRNA
gggtctccggccggacagcg

SEQ ID NO: 807 - DNA, 20 bp, Artificial Sequence
  sgRNA
ctaaaccatccgggcgggct

SEQ ID NO: 808 - DNA, 20 bp, Artificial Sequence
  sgRNA
ttacgtcagtcaccgctagc

SEQ ID NO: 809 - DNA, 20 bp, Artificial Sequence
  sgRNA
agaggcatccacaattcgga

SEQ ID NO: 810 - DNA, 20 bp, Artificial Sequence
  sgRNA
catctctctacgtcacggcc

SEQ ID NO: 811 - DNA, 20 bp, Artificial Sequence
  sgRNA
cgccgcagaggaccactgcc

SEQ ID NO: 812 - DNA, 20 bp, Artificial Sequence
  sgRNA
cccggtttcgggtcgttgca

SEQ ID NO: 813 - DNA, 20 bp, Artificial Sequence
  sgRNA
cttgatagggaccaagagct

SEQ ID NO: 814 - DNA, 20 bp, Artificial Sequence
  sgRNA
gcgccagacatttcctaaag

SEQ ID NO: 815 - DNA, 20 bp, Artificial Sequence
  sgRNA
actgaaggccatatgtggga

SEQ ID NO: 816 - DNA, 20 bp, Artificial Sequence
  sgRNA
aagggaggcgttgcaacatc

SEQ ID NO: 817 - DNA, 20 bp, Artificial Sequence
  sgRNA
tgatgacacgccagcgcgcg

SEQ ID NO: 818 - DNA, 20 bp, Artificial Sequence
  sgRNA
ttgacgggccaataagagag

SEQ ID NO: 819 - DNA, 20 bp, Artificial Sequence
  sgRNA
gacgcgtgaatggaggtgga

SEQ ID NO: 820 - DNA, 20 bp, Artificial Sequence
  sgRNA
cgcacgtacactctttagta

SEQ ID NO: 821 - DNA, 20 bp, Artificial Sequence
  sgRNA
ccaaggcaaggctgtcctca

SEQ ID NO: 822 - DNA, 20 bp, Artificial Sequence
  sgRNA
aggtgcgggcaagcccgagg

SEQ ID NO: 823 - DNA, 20 bp, Artificial Sequence
  sgRNA
tttaatagccggctcctcga

SEQ ID NO: 824 - DNA, 20 bp, Artificial Sequence
  sgRNA
agcgagccgaggtttgtcga

SEQ ID NO: 825 - DNA, 20 bp, Artificial Sequence
  sgRNA
cggtgatgatatctgagaca

SEQ ID NO: 826 - DNA, 20 bp, Artificial Sequence
  sgRNA
tcaagggttctgtgttcttc

SEQ ID NO: 827 - DNA, 20 bp, Artificial Sequence
  sgRNA
gggacaaacctagagcgaca

SEQ ID NO: 828 - DNA, 20 bp, Artificial Sequence
  sgRNA
tcccggactgttcacgcact

SEQ ID NO: 829 - DNA, 20 bp, Artificial Sequence
  sgRNA
gcgggacgcgcccacttggc

SEQ ID NO: 830 - DNA, 20 bp, Artificial Sequence
  sgRNA
acctgggcggcggaggcgtg

SEQ ID NO: 831 - DNA, 20 bp, Artificial Sequence
  sgRNA
gaggaatgcacaaccgatcc

SEQ ID NO: 832 - DNA, 20 bp, Artificial Sequence
  sgRNA
gtatcttagcagacaaggaa

SEQ ID NO: 833 - DNA, 20 bp, Artificial Sequence
  sgRNA
gctcacatgcgggctcagaa

SEQ ID NO: 834 - DNA, 20 bp, Artificial Sequence
  sgRNA
ctcctccgatgtgacgcctg

SEQ ID NO: 835 - DNA, 20 bp, Artificial Sequence
  sgRNA
tggtaggatccttgaatctc

SEQ ID NO: 836 - DNA, 20 bp, Artificial Sequence
  sgRNA
gtaagcaaagatttcatatg

SEQ ID NO: 837 - DNA, 20 bp, Artificial Sequence
  sgRNA
aggctcgtctgtggcggcga

SEQ ID NO: 838 - DNA, 20 bp, Artificial Sequence
  sgRNA
ttacgaggcaaccaagagga

SEQ ID NO: 839 - DNA, 20 bp, Artificial Sequence
  sgRNA
gggtggagcctatggtacac

SEQ ID NO: 840 - DNA, 20 bp, Artificial Sequence
  sgRNA
aaggaaacccaggctgtgtc

SEQ ID NO: 841 - DNA, 20 bp, Artificial Sequence
  sgRNA
aaacggagtgacggcgcgac

SEQ ID NO: 842 - DNA, 20 bp, Artificial Sequence
  sgRNA
tggactggaatccaggagac

SEQ ID NO: 843 - DNA, 20 bp, Artificial Sequence
  sgRNA
cttgctattatagcactgtg

SEQ ID NO: 844 - DNA, 20 bp, Artificial Sequence
  sgRNA
aggctggtgcccgtgaattt

SEQ ID NO: 845 - DNA, 20 bp, Artificial Sequence
  sgRNA
actgcttgtctccactaatt

SEQ ID NO: 846 - DNA, 20 bp, Artificial Sequence
  sgRNA
actgcaattattagattgag

SEQ ID NO: 847 - DNA, 20 bp, Artificial Sequence
  sgRNA
aggcaactggctaactagcc

SEQ ID NO: 848 - DNA, 20 bp, Artificial Sequence
  sgRNA
cgccaaagtctctagggatg

SEQ ID NO: 849 - DNA, 20 bp, Artificial Sequence
  sgRNA
cctcatcatctgcgtggtcc

SEQ ID NO: 850 - DNA, 20 bp, Artificial Sequence
  sgRNA
cgcacgctttggctcgggag

SEQ ID NO: 851 - DNA, 20 bp, Artificial Sequence
  sgRNA
gattatctgctccacgcacg

SEQ ID NO: 852 - DNA, 20 bp, Artificial Sequence
  sgRNA
gtgggccggaactacggcag

SEQ ID NO: 853 - DNA, 20 bp, Artificial Sequence
  sgRNA
ggttgtgtcctctacacaca

SEQ ID NO: 854 - DNA, 20 bp, Artificial Sequence
  sgRNA
tggcggcgagttctgtcacg

SEQ ID NO: 855 - DNA, 20 bp, Artificial Sequence
  sgRNA
ggctcctcaattgccctaaa

SEQ ID NO: 856 - DNA, 20 bp, Artificial Sequence
  sgRNA
gcgcaaactcgctcacttcc

SEQ ID NO: 857 - DNA, 20 bp, Artificial Sequence
  sgRNA
caaggagggcgataccaaga

SEQ ID NO: 858 - DNA, 20 bp, Artificial Sequence
  sgRNA
tcaaagcaaacagtgatagg

SEQ ID NO: 859 - DNA, 20 bp, Artificial Sequence
  sgRNA
ctgtgcacgtttgttgagct

SEQ ID NO: 860 - DNA, 20 bp, Artificial Sequence
  sgRNA
cggcgccatcccttagcttg

SEQ ID NO: 861 - DNA, 20 bp, Artificial Sequence
  sgRNA
gagggtcttctgtagggtga

SEQ ID NO: 862 - DNA, 20 bp, Artificial Sequence
  sgRNA
cagacctttagaggctctct

SEQ ID NO: 863 - DNA, 20 bp, Artificial Sequence
  sgRNA
ttgttagggtcacttaaaca

SEQ ID NO: 864 - DNA, 20 bp, Artificial Sequence
  sgRNA
cgctctatatatacagcgcc

SEQ ID NO: 865 - DNA, 20 bp, Artificial Sequence
  sgRNA
gtcacgtgacgtccgcggcc

SEQ ID NO: 866 - DNA, 20 bp, Artificial Sequence
  sgRNA
tgtcaggaagaggaagagcg

SEQ ID NO: 867 - DNA, 20 bp, Artificial Sequence
  sgRNA
caaccttagacttaggcatg

SEQ ID NO: 868 - DNA, 20 bp, Artificial Sequence
  sgRNA
ccaagcggaaacttacacac

SEQ ID NO: 869 - DNA, 20 bp, Artificial Sequence
  sgRNA
gtcggagtggcggaggctct

SEQ ID NO: 870 - DNA, 20 bp, Artificial Sequence
  sgRNA
gaatgaaccaagtgtccgcc

SEQ ID NO: 871 - DNA, 20 bp, Artificial Sequence
  sgRNA
tgctgctgtgcattgaagcc

SEQ ID NO: 872 - DNA, 20 bp, Artificial Sequence
  sgRNA
cagcatcaccactctgggcg

SEQ ID NO: 873 - DNA, 20 bp, Artificial Sequence
  sgRNA
aacgactggcgcgcgcaccc

SEQ ID NO: 874 - DNA, 20 bp, Artificial Sequence
  sgRNA
tttggatatcatgacaaagt

SEQ ID NO: 875 - DNA, 20 bp, Artificial Sequence
  sgRNA
ttcatgcaagaaactatctg

SEQ ID NO: 876 - DNA, 20 bp, Artificial Sequence
  sgRNA
cccttggcagcgggtctaaa

SEQ ID NO: 877 - DNA, 20 bp, Artificial Sequence
  sgRNA
cgcaggtaaatccatgcgcc

SEQ ID NO: 878 - DNA, 20 bp, Artificial Sequence
  sgRNA
acattcagagctgacccggg

SEQ ID NO: 879 - DNA, 20 bp, Artificial Sequence
  sgRNA
ttgcaattggtcgcaaccag

SEQ ID NO: 880 - DNA, 20 bp, Artificial Sequence
  sgRNA
ctagcgaaaggctgccgccc

SEQ ID NO: 881 - DNA, 20 bp, Artificial Sequence
  sgRNA
ggctctggaagagctggttt

SEQ ID NO: 882 - DNA, 20 bp, Artificial Sequence
  sgRNA
ttagtgcaacctgtggcacg

SEQ ID NO: 883 - DNA, 20 bp, Artificial Sequence
  sgRNA
actacaattcccataaagca

SEQ ID NO: 884 - DNA, 20 bp, Artificial Sequence
  sgRNA
ttgcgcgggcccaatgagcg

SEQ ID NO: 885 - DNA, 20 bp, Artificial Sequence
  sgRNA
ggaggagggagtctgttagg

SEQ ID NO: 886 - DNA, 20 bp, Artificial Sequence
  sgRNA
tgagtagtatacatgtgagc

SEQ ID NO: 887 - DNA, 20 bp, Artificial Sequence
  sgRNA
tgtgcggtgagcaatagctg

SEQ ID NO: 888 - DNA, 20 bp, Artificial Sequence
  sgRNA
ttcttacgtaagccgggagc

SEQ ID NO: 889 - DNA, 20 bp, Artificial Sequence
  sgRNA
tgactataggaggtgatgcg

SEQ ID NO: 890 - DNA, 20 bp, Artificial Sequence
  sgRNA
cggctccgactgcgtgtgag

SEQ ID NO: 891 - DNA, 20 bp, Artificial Sequence
  sgRNA
gataaggtctgctggaatcg

SEQ ID NO: 892 - DNA, 20 bp, Artificial Sequence
  sgRNA
aggctcagtctgcttaggct

SEQ ID NO: 893 - DNA, 20 bp, Artificial Sequence
  sgRNA
gaagcttccggcggacgcca

SEQ ID NO: 894 - DNA, 20 bp, Artificial Sequence
  sgRNA
tcaacaggaactagacagca

SEQ ID NO: 895 - DNA, 20 bp, Artificial Sequence
  sgRNA
ggaaggaggaaggcagccgt

SEQ ID NO: 896 - DNA, 20 bp, Artificial Sequence
  sgRNA
gcagccagcccggccttatt

SEQ ID NO: 897 - DNA, 20 bp, Artificial Sequence
  sgRNA
gggaccagcatcagtgagtg

SEQ ID NO: 898 - DNA, 20 bp, Artificial Sequence
  sgRNA
tctggccctgtggctaagtc

SEQ ID NO: 899 - DNA, 20 bp, Artificial Sequence
  sgRNA
tactttgcgcccactcctag

SEQ ID NO: 900 - DNA, 20 bp, Artificial Sequence
  sgRNA
aggagctggtctccggcagg

SEQ ID NO: 901 - DNA, 20 bp, Artificial Sequence
  sgRNA
aaagctgactctgacagcaa

SEQ ID NO: 902 - DNA, 20 bp, Artificial Sequence
  sgRNA
ttacatcatccttgggcgtg

SEQ ID NO: 903 - DNA, 20 bp, Artificial Sequence
  sgRNA
ggatgggagcgtccctgcaa

SEQ ID NO: 904 - DNA, 20 bp, Artificial Sequence
  sgRNA
gagcccaagtccctgtgtgg

SEQ ID NO: 905 - DNA, 20 bp, Artificial Sequence
  sgRNA
ggctcgcgaccatagagaag

SEQ ID NO: 906 - DNA, 20 bp, Artificial Sequence
  sgRNA
ttgcttgcaggagcgagtga

SEQ ID NO: 907 - DNA, 20 bp, Artificial Sequence
  sgRNA
gctagacccagatgcagcct

SEQ ID NO: 908 - DNA, 20 bp, Artificial Sequence
  sgRNA
tgtagaattggaactactag

SEQ ID NO: 909 - DNA, 20 bp, Artificial Sequence
  sgRNA
ggtctttctggcaggcatcg

SEQ ID NO: 910 - DNA, 20 bp, Artificial Sequence
  sgRNA
tcctgtgaaatcagaccaat

SEQ ID NO: 911 - DNA, 20 bp, Artificial Sequence
  sgRNA
tttcctgagtctctgatttg

SEQ ID NO: 912 - DNA, 20 bp, Artificial Sequence
  sgRNA
aagctgtcgagaaagctatc

SEQ ID NO: 913 - DNA, 20 bp, Artificial Sequence
  sgRNA
tcacatgctctttaaacgtc

SEQ ID NO: 914 - DNA, 20 bp, Artificial Sequence
  sgRNA
aaatgctcaatgtttaactg

SEQ ID NO: 915 - DNA, 20 bp, Artificial Sequence
  sgRNA
gggagggcccaggcgagcgg

SEQ ID NO: 916 - DNA, 20 bp, Artificial Sequence
  sgRNA
ggcccgcctcctccgagacc

SEQ ID NO: 917 - DNA, 20 bp, Artificial Sequence
  sgRNA
atctagtcaaagaatgaggg

SEQ ID NO: 918 - DNA, 20 bp, Artificial Sequence
  sgRNA
gctagctgtggaaagttggg

SEQ ID NO: 919 - DNA, 20 bp, Artificial Sequence
  sgRNA
ggcccgcgtgatccacgcac

SEQ ID NO: 920 - DNA, 20 bp, Artificial Sequence
  sgRNA
aaattccgtagactcgccta

SEQ ID NO: 921 - DNA, 20 bp, Artificial Sequence
  sgRNA
gtagactcaacaagttccag

SEQ ID NO: 922 - DNA, 20 bp, Artificial Sequence
  sgRNA
gggtccttcctagaaataaa

SEQ ID NO: 923 - DNA, 20 bp, Artificial Sequence
  sgRNA
tcccacttcccgctgtggat

SEQ ID NO: 924 - DNA, 20 bp, Artificial Sequence
  sgRNA
tcgcccgccgccgaggagaa

SEQ ID NO: 925 - DNA, 20 bp, Artificial Sequence
  sgRNA
ccaacatctcgtgaggtggg

SEQ ID NO: 926 - DNA, 20 bp, Artificial Sequence
  sgRNA
ctcttgatttggatttgatg

SEQ ID NO: 927 - DNA, 20 bp, Artificial Sequence
  sgRNA
agagtcaagaaggttggcag

SEQ ID NO: 928 - DNA, 20 bp, Artificial Sequence
  sgRNA
agaggtgaccagatctcaag

SEQ ID NO: 929 - DNA, 20 bp, Artificial Sequence
  sgRNA
ggacataaatagtgggttcc

SEQ ID NO: 930 - DNA, 20 bp, Artificial Sequence
  sgRNA
ggtgggtagaagattgacag

SEQ ID NO: 931 - DNA, 20 bp, Artificial Sequence
  sgRNA
tgggcggagcatccgcctcg

SEQ ID NO: 932 - DNA, 20 bp, Artificial Sequence
  sgRNA
gtggttgattagcaaagtct

SEQ ID NO: 933 - DNA, 20 bp, Artificial Sequence
  sgRNA
cttgtttacccgggagttcc

SEQ ID NO: 934 - DNA, 20 bp, Artificial Sequence
  sgRNA
gaaaggtttcagaagcggac

SEQ ID NO: 935 - DNA, 20 bp, Artificial Sequence
  sgRNA
tttgtcttactttgctaagt

SEQ ID NO: 936 - DNA, 20 bp, Artificial Sequence
  sgRNA
tttatgagaattgagggcct

SEQ ID NO: 937 - DNA, 20 bp, Artificial Sequence
  sgRNA
gcgcttaccgcctcttatgc

SEQ ID NO: 938 - DNA, 20 bp, Artificial Sequence
  sgRNA
gaggttgctaagaattctgc

SEQ ID NO: 939 - DNA, 20 bp, Artificial Sequence
  sgRNA
ctgccgctcgcccaggcttt

SEQ ID NO: 940 - DNA, 20 bp, Artificial Sequence
  sgRNA
gagggtaggaagtgccgccg

SEQ ID NO: 941 - DNA, 20 bp, Artificial Sequence
  sgRNA
gcttgtgagtcaccggtacc

SEQ ID NO: 942 - DNA, 20 bp, Artificial Sequence
  sgRNA
cgaggagcaggctgactccg

SEQ ID NO: 943 - DNA, 20 bp, Artificial Sequence
  sgRNA
gtccctcagacttgtttgct

SEQ ID NO: 944 - DNA, 20 bp, Artificial Sequence
  sgRNA
gtagtccggtccataccata

SEQ ID NO: 945 - DNA, 20 bp, Artificial Sequence
  sgRNA
acctcgcgcgcggactgccc

SEQ ID NO: 946 - DNA, 20 bp, Artificial Sequence
  sgRNA
gggtttggtgcacgtgggag

SEQ ID NO: 947 - DNA, 20 bp, Artificial Sequence
  sgRNA
gagattcatgcaatgctaat

SEQ ID NO: 948 - DNA, 20 bp, Artificial Sequence
  sgRNA
tcccagattggctgagaccc

SEQ ID NO: 949 - DNA, 20 bp, Artificial Sequence
  sgRNA
aaggaaggcacgcgcaagac

SEQ ID NO: 950 - DNA, 20 bp, Artificial Sequence
  sgRNA
gtcatggcctttgacatcag

SEQ ID NO: 951 - DNA, 20 bp, Artificial Sequence
  sgRNA
tcatctctgaactatatccc

SEQ ID NO: 952 - DNA, 20 bp, Artificial Sequence
  sgRNA
gacggctccgttgcgacatc

SEQ ID NO: 953 - DNA, 20 bp, Artificial Sequence
  sgRNA
cgcgctgggcctgggttcgc

SEQ ID NO: 954 - DNA, 20 bp, Artificial Sequence
  sgRNA
agatgcaacgtcatcacgcc

SEQ ID NO: 955 - DNA, 20 bp, Artificial Sequence
  sgRNA
ccctttcgattacgctttgc

SEQ ID NO: 956 - DNA, 20 bp, Artificial Sequence
  sgRNA
taggccttggtgcagatgcc

SEQ ID NO: 957 - DNA, 20 bp, Artificial Sequence
  sgRNA
gctcgacccttgcaccgaaa

SEQ ID NO: 958 - DNA, 20 bp, Artificial Sequence
  sgRNA
agagatgcgcggcctcgcgc

SEQ ID NO: 959 - DNA, 20 bp, Artificial Sequence
  sgRNA
cgcgcgtgcagcctcggagc

SEQ ID NO: 960 - DNA, 20 bp, Artificial Sequence
  sgRNA
cttgcagctcagccagtctc

SEQ ID NO: 961 - DNA, 20 bp, Artificial Sequence
  sgRNA
agtttcctgaatagtgagcg

SEQ ID NO: 962 - DNA, 20 bp, Artificial Sequence
  sgRNA
ggaaacgtagctgtgggtga

SEQ ID NO: 963 - DNA, 20 bp, Artificial Sequence
  sgRNA
ccgagcccagaggacgcgtc

SEQ ID NO: 964 - DNA, 20 bp, Artificial Sequence
  sgRNA
cggatgtctgtgcgcatgct

SEQ ID NO: 965 - DNA, 20 bp, Artificial Sequence
  sgRNA
cccgccgccaacgaactggg

SEQ ID NO: 966 - DNA, 20 bp, Artificial Sequence
  sgRNA
tacctgcaaatgactgagtt

SEQ ID NO: 967 - DNA, 20 bp, Artificial Sequence
  sgRNA
acccagacagctccctcgca

SEQ ID NO: 968 - DNA, 20 bp, Artificial Sequence
  sgRNA
gctccttcagagcctgtagg

SEQ ID NO: 969 - DNA, 20 bp, Artificial Sequence
  sgRNA
attgactaaggcagattaaa

SEQ ID NO: 970 - DNA, 20 bp, Artificial Sequence
  sgRNA
caactgagtgaatgcccagt

SEQ ID NO: 971 - DNA, 20 bp, Artificial Sequence
  sgRNA
tgccagcaagaaagaagccc

SEQ ID NO: 972 - DNA, 20 bp, Artificial Sequence
  sgRNA
agttgcgcaggcgcaaccgc

SEQ ID NO: 973 - DNA, 20 bp, Artificial Sequence
  sgRNA
ctcagcgggacaaagcaaac

SEQ ID NO: 974 - DNA, 20 bp, Artificial Sequence
  sgRNA
ggcagcatctggactgcagc

SEQ ID NO: 975 - DNA, 20 bp, Artificial Sequence
  sgRNA
gaggagactagagttgaatt

SEQ ID NO: 976 - DNA, 20 bp, Artificial Sequence
  sgRNA
cggtgcgagttcttgcgagt

SEQ ID NO: 977 - DNA, 20 bp, Artificial Sequence
  sgRNA
gagcgattgtaaatgtgtga

SEQ ID NO: 978 - DNA, 20 bp, Artificial Sequence
  sgRNA
ccagcaggttcggcgatgcc

SEQ ID NO: 979 - DNA, 20 bp, Artificial Sequence
  sgRNA
tgacttccaggtatatacta

SEQ ID NO: 980 - DNA, 20 bp, Artificial Sequence
  sgRNA
atgcagtggtaagtgcagac

SEQ ID NO: 981 - DNA, 20 bp, Artificial Sequence
  sgRNA
attagcctactttgcaatcc

SEQ ID NO: 982 - DNA, 20 bp, Artificial Sequence
  sgRNA
gtgctttgattggttgcctg

SEQ ID NO: 983 - DNA, 20 bp, Artificial Sequence
  sgRNA
gtcagcagaggaagtggtaa

SEQ ID NO: 984 - DNA, 20 bp, Artificial Sequence
  sgRNA
tttgagcagctcctcctgac

SEQ ID NO: 985 - DNA, 20 bp, Artificial Sequence
  sgRNA
tcccagtactcctccaggca

SEQ ID NO: 986 - DNA, 20 bp, Artificial Sequence
  sgRNA
caaatgttgggtgagaatta

SEQ ID NO: 987 - DNA, 20 bp, Artificial Sequence
  sgRNA
gtgtagtcttccgcaagcgc

SEQ ID NO: 988 - DNA, 20 bp, Artificial Sequence
  sgRNA
actcttgcttagaaatctaa

SEQ ID NO: 989 - DNA, 20 bp, Artificial Sequence
  sgRNA
ctctccacaaggcggcacct

SEQ ID NO: 990 - DNA, 20 bp, Artificial Sequence
  sgRNA
gccgacctcactcattgctt

SEQ ID NO: 991 - DNA, 20 bp, Artificial Sequence
  sgRNA
ctgcggctcactagcttggc

SEQ ID NO: 992 - DNA, 20 bp, Artificial Sequence
  sgRNA
tgagggaggtggtaccaagg

SEQ ID NO: 993 - DNA, 20 bp, Artificial Sequence
  sgRNA
ttctcagtatgattctttgt

SEQ ID NO: 994 - DNA, 20 bp, Artificial Sequence
  sgRNA
aaagcttactgtgccaggcc

SEQ ID NO: 995 - DNA, 20 bp, Artificial Sequence
  sgRNA
agtcccgcccatcaactgcg

SEQ ID NO: 996 - DNA, 20 bp, Artificial Sequence
  sgRNA
cagggcctttgtgcgacgag

SEQ ID NO: 997 - DNA, 20 bp, Artificial Sequence
  sgRNA
gggagtttagagggcatcct

SEQ ID NO: 998 - DNA, 20 bp, Artificial Sequence
  sgRNA
ggacaaagtacaaataatgt

SEQ ID NO: 999 - DNA, 20 bp, Artificial Sequence
  sgRNA
ctgtgacctcatagagtact

SEQ ID NO: 1000 - DNA, 20 bp, Artificial Sequence
  sgRNA
cctttctaccctactcatta

SEQ ID NO: 1001 - DNA, 20 bp, Artificial Sequence
  sgRNA
gggaaacactgtctaggttc

SEQ ID NO: 1002 - DNA, 20 bp, Artificial Sequence
  sgRNA
ccctcccactactgactgaa

SEQ ID NO: 1003 - DNA, 20 bp, Artificial Sequence
  sgRNA
ccaggcgagaagctgcagac

SEQ ID NO: 1004 - DNA, 20 bp, Artificial Sequence
  sgRNA
gtactaattaaggacaacag

SEQ ID NO: 1005 - DNA, 20 bp, Artificial Sequence
  sgRNA
caatgaaccagagacctgaa

SEQ ID NO: 1006 - DNA, 20 bp, Artificial Sequence
  sgRNA
gtggctctctgaggcctagg

SEQ ID NO: 1007 - DNA, 20 bp, Artificial Sequence
  sgRNA
actcaccagctaccaagccc

SEQ ID NO: 1008 - DNA, 20 bp, Artificial Sequence
  sgRNA
ggctaataatagactgatta

SEQ ID NO: 1009 - DNA, 20 bp, Artificial Sequence
  sgRNA
acgcgataggaggcagcagc

SEQ ID NO: 1010 - DNA, 20 bp, Artificial Sequence
  sgRNA
gagccgtgggcccgaggaac

SEQ ID NO: 1011 - DNA, 20 bp, Artificial Sequence
  sgRNA
cgcagtgggcagcaggcctg

SEQ ID NO: 1012 - DNA, 20 bp, Artificial Sequence
  sgRNA
gagtcagcccgcctgccgct

SEQ ID NO: 1013 - DNA, 20 bp, Artificial Sequence
  sgRNA
cagcacagctgtcacacagc

SEQ ID NO: 1014 - DNA, 20 bp, Artificial Sequence
  sgRNA
gagcagctgcagtgcagtgt

SEQ ID NO: 1015 - DNA, 20 bp, Artificial Sequence
  sgRNA
aactttctctggatttgtac

SEQ ID NO: 1016 - DNA, 20 bp, Artificial Sequence
  sgRNA
tctaggttgccaagcgacgc

SEQ ID NO: 1017 - DNA, 20 bp, Artificial Sequence
  sgRNA
aagataaacagtgagcgagc

SEQ ID NO: 1018 - DNA, 20 bp, Artificial Sequence
  sgRNA
cacatctgcgtcacttacag

SEQ ID NO: 1019 - DNA, 20 bp, Artificial Sequence
  sgRNA
cgcgagcgcagtccgttgcc

SEQ ID NO: 1020 - DNA, 20 bp, Artificial Sequence
  sgRNA
ctaacaatgccagtgtaagg

SEQ ID NO: 1021 - DNA, 20 bp, Artificial Sequence
  sgRNA
gggcagaaagttgccattta

SEQ ID NO: 1022 - DNA, 20 bp, Artificial Sequence
  sgRNA
gaatcataatgaagcgcctc

SEQ ID NO: 1023 - DNA, 20 bp, Artificial Sequence
  sgRNA
gagccgtaacctgctcttgc

SEQ ID NO: 1024 - DNA, 20 bp, Artificial Sequence
  sgRNA
gaagagtgtctgtttaaggg

SEQ ID NO: 1025 - DNA, 20 bp, Artificial Sequence
  sgRNA
gcgctgccagtctcgggagg

SEQ ID NO: 1026 - DNA, 20 bp, Artificial Sequence
  sgRNA
catgcgtagtgtccattcca

SEQ ID NO: 1027 - DNA, 20 bp, Artificial Sequence
  sgRNA
acaggagccagtcagactgg

SEQ ID NO: 1028 - DNA, 20 bp, Artificial Sequence
  sgRNA
acatcgctcacgtccgccag

SEQ ID NO: 1029 - DNA, 20 bp, Artificial Sequence
  sgRNA
cttcagagcgcatcctccag

SEQ ID NO: 1030 - DNA, 20 bp, Artificial Sequence
  sgRNA
atctctcggagagcagcgat

SEQ ID NO: 1031 - DNA, 20 bp, Artificial Sequence
  sgRNA
cgcgctgattggccgctacc

SEQ ID NO: 1032 - DNA, 20 bp, Artificial Sequence
  sgRNA
taaagaaatgcagagtcaca

SEQ ID NO: 1033 - DNA, 20 bp, Artificial Sequence
  sgRNA
atctgctattaggaggctcc

SEQ ID NO: 1034 - DNA, 20 bp, Artificial Sequence
  sgRNA
tgtctgctaaatgcttcacc

SEQ ID NO: 1035 - DNA, 20 bp, Artificial Sequence
  sgRNA
agacggagatctccgagttc

SEQ ID NO: 1036 - DNA, 20 bp, Artificial Sequence
  sgRNA
ctgaggcacattgtacaatc

SEQ ID NO: 1037 - DNA, 20 bp, Artificial Sequence
  sgRNA
tctagggtcagagatctttc

SEQ ID NO: 1038 - DNA, 20 bp, Artificial Sequence
  sgRNA
ggtcctgcgggttagaggcg

SEQ ID NO: 1039 - DNA, 20 bp, Artificial Sequence
  sgRNA
gaagcaacatttattcagta

SEQ ID NO: 1040 - DNA, 20 bp, Artificial Sequence
  sgRNA
ggacaggaagtgccttgcgc

SEQ ID NO: 1041 - DNA, 20 bp, Artificial Sequence
  sgRNA
tgttggtaatgtcccaaact

SEQ ID NO: 1042 - DNA, 20 bp, Artificial Sequence
  sgRNA
agagctttctgagcaggtgc

SEQ ID NO: 1043 - DNA, 20 bp, Artificial Sequence
  sgRNA
ctggatagcattcttggttt

SEQ ID NO: 1044 - DNA, 20 bp, Artificial Sequence
  sgRNA
tgaggcagcccgcgtgcaag

SEQ ID NO: 1045 - DNA, 20 bp, Artificial Sequence
  sgRNA
tcagtatgtgtcaccaaagg

SEQ ID NO: 1046 - DNA, 20 bp, Artificial Sequence
  sgRNA
gcataatcaagaccaaagtc

SEQ ID NO: 1047 - DNA, 20 bp, Artificial Sequence
  sgRNA
gacatggacaagttgtcttg

SEQ ID NO: 1048 - DNA, 20 bp, Artificial Sequence
  sgRNA
tctctctcaactcgttatca

SEQ ID NO: 1049 - DNA, 20 bp, Artificial Sequence
  sgRNA
aacgcctcgcttaaagtaac

SEQ ID NO: 1050 - DNA, 20 bp, Artificial Sequence
  sgRNA
agctgtttatcaactgcacc

SEQ ID NO: 1051 - DNA, 20 bp, Artificial Sequence
  sgRNA
tcctgctaaatttgccgcca

SEQ ID NO: 1052 - DNA, 20 bp, Artificial Sequence
  sgRNA
ctctttatttcaagaactcc

SEQ ID NO: 1053 - DNA, 20 bp, Artificial Sequence
  sgRNA
aaagcccgcgtagtaagcgc

SEQ ID NO: 1054 - DNA, 20 bp, Artificial Sequence
  sgRNA
aatggaaggagccaatgaag

SEQ ID NO: 1055 - DNA, 20 bp, Artificial Sequence
  sgRNA
gccaatttgaaggatgaaga

SEQ ID NO: 1056 - DNA, 20 bp, Artificial Sequence
  sgRNA
gggtgacaggagcccgacgt

SEQ ID NO: 1057 - DNA, 20 bp, Artificial Sequence
  sgRNA
agcaactctcggcttaaact

SEQ ID NO: 1058 - DNA, 20 bp, Artificial Sequence
  sgRNA
gctagggtgactcactgtct

SEQ ID NO: 1059 - DNA, 20 bp, Artificial Sequence
  sgRNA
gcatcaggtataaacttccc

SEQ ID NO: 1060 - DNA, 20 bp, Artificial Sequence
  sgRNA
caagagcctccctatcctcc

SEQ ID NO: 1061 - DNA, 20 bp, Artificial Sequence
  sgRNA
attaccatgtattagcatac

SEQ ID NO: 1062 - DNA, 20 bp, Artificial Sequence
  sgRNA
caggaggagagagcgacgtg

SEQ ID NO: 1063 - DNA, 20 bp, Artificial Sequence
  sgRNA
cccagagcaggagttaatcg

SEQ ID NO: 1064 - DNA, 20 bp, Artificial Sequence
  sgRNA
tgagagcctgcccaccgctc

SEQ ID NO: 1065 - DNA, 20 bp, Artificial Sequence
  sgRNA
cactaaccctgagccaagag

SEQ ID NO: 1066 - DNA, 20 bp, Artificial Sequence
  sgRNA
agggcttgtagagcttacta

SEQ ID NO: 1067 - DNA, 20 bp, Artificial Sequence
  sgRNA
cccgccctgcaaagcagacg

SEQ ID NO: 1068 - DNA, 20 bp, Artificial Sequence
  sgRNA
gcacaaaggagaaatcatac

SEQ ID NO: 1069 - DNA, 20 bp, Artificial Sequence
  sgRNA
ttctagaaacttggattcca

SEQ ID NO: 1070 - DNA, 20 bp, Artificial Sequence
  sgRNA
atcggcatattgaggatgag

SEQ ID NO: 1071 - DNA, 20 bp, Artificial Sequence
  sgRNA
gatgttgcaggttagtggaa

SEQ ID NO: 1072 - DNA, 20 bp, Artificial Sequence
  sgRNA
gaagccgcggtgccaaatta

SEQ ID NO: 1073 - DNA, 20 bp, Artificial Sequence
  sgRNA
tttctggtgctaacttgcct

SEQ ID NO: 1074 - DNA, 20 bp, Artificial Sequence
  sgRNA
cctaccctgcaggcagaatg

SEQ ID NO: 1075 - DNA, 20 bp, Artificial Sequence
  sgRNA
tacgtgagcagaagtagttc

SEQ ID NO: 1076 - DNA, 20 bp, Artificial Sequence
  sgRNA
ccaacttctttaaggagtta

SEQ ID NO: 1077 - DNA, 20 bp, Artificial Sequence
  sgRNA
attagctcgcgcggcgaccc

SEQ ID NO: 1078 - DNA, 20 bp, Artificial Sequence
  sgRNA
ggcggtgagtaacacatcat

SEQ ID NO: 1079 - DNA, 20 bp, Artificial Sequence
  sgRNA
atggtgctgcgccggttgcc

SEQ ID NO: 1080 - DNA, 20 bp, Artificial Sequence
  sgRNA
cgggagttgcaagtaagcgc

SEQ ID NO: 1081 - DNA, 20 bp, Artificial Sequence
  sgRNA
acaacccagacttacagacc

SEQ ID NO: 1082 - DNA, 20 bp, Artificial Sequence
  sgRNA
aggcagcacgaggtggcctg

SEQ ID NO: 1083 - DNA, 20 bp, Artificial Sequence
  sgRNA
catgcgtacttcaagagccc

SEQ ID NO: 1084 - DNA, 20 bp, Artificial Sequence
  sgRNA
cttaaagctcttcccaagct

SEQ ID NO: 1085 - DNA, 20 bp, Artificial Sequence
  sgRNA
taggtgaatgccaccattcc

SEQ ID NO: 1086 - DNA, 20 bp, Artificial Sequence
  sgRNA
gggaaccgggtacggagagg

SEQ ID NO: 1087 - DNA, 20 bp, Artificial Sequence
  sgRNA
ctcaccaatggccgtccggg

SEQ ID NO: 1088 - DNA, 20 bp, Artificial Sequence
  sgRNA
aagagcaggcattaggagtc

SEQ ID NO: 1089 - DNA, 20 bp, Artificial Sequence
  sgRNA
agacatgctgaataacaaag

SEQ ID NO: 1090 - DNA, 20 bp, Artificial Sequence
  sgRNA
ggacgagagggagagagagg

SEQ ID NO: 1091 - DNA, 20 bp, Artificial Sequence
  sgRNA
atggctgtgaacggccactg

SEQ ID NO: 1092 - DNA, 20 bp, Artificial Sequence
  sgRNA
ctgagacaaccttactgcgc

SEQ ID NO: 1093 - DNA, 20 bp, Artificial Sequence
  sgRNA
gaggcgcttctagcgacacg

SEQ ID NO: 1094 - DNA, 20 bp, Artificial Sequence
  sgRNA
ctgtctggaagtgggaatgt

SEQ ID NO: 1095 - DNA, 20 bp, Artificial Sequence
  sgRNA
cagagattcaaagctaacct

SEQ ID NO: 1096 - DNA, 20 bp, Artificial Sequence
  sgRNA
gccgccgctaaggaaagagg

SEQ ID NO: 1097 - DNA, 20 bp, Artificial Sequence
  sgRNA
cgagccttccggaggacgcg

SEQ ID NO: 1098 - DNA, 20 bp, Artificial Sequence
  sgRNA
attgtctgtcttgaagggag

SEQ ID NO: 1099 - DNA, 20 bp, Artificial Sequence
  sgRNA
gaactgatggacaccgagtg

SEQ ID NO: 1100 - DNA, 20 bp, Artificial Sequence
  sgRNA
gttctcgtggcgcactgagc

SEQ ID NO: 1101 - DNA, 20 bp, Artificial Sequence
  sgRNA
actgcaaactgacgccgacg

SEQ ID NO: 1102 - DNA, 20 bp, Artificial Sequence
  sgRNA
acatcggctggcgacggtgg

SEQ ID NO: 1103 - DNA, 20 bp, Artificial Sequence
  sgRNA
atcatcgggcaacagtgctt

SEQ ID NO: 1104 - DNA, 20 bp, Artificial Sequence
  sgRNA
gagacttgtttgtctgggcc

SEQ ID NO: 1105 - DNA, 20 bp, Artificial Sequence
  sgRNA
aagaaatccacggctagttt

SEQ ID NO: 1106 - DNA, 20 bp, Artificial Sequence
  sgRNA
gtcgctacaaacttcgccga

SEQ ID NO: 1107 - DNA, 20 bp, Artificial Sequence
  sgRNA
cgactctcgagcgtctccat

SEQ ID NO: 1108 - DNA, 20 bp, Artificial Sequence
  sgRNA
taatcactagggtatgtctt

SEQ ID NO: 1109 - DNA, 20 bp, Artificial Sequence
  sgRNA
ggcggtaagtaaagatggtg

SEQ ID NO: 1110 - DNA, 20 bp, Artificial Sequence
  sgRNA
atggacacaacggcagggcg

SEQ ID NO: 1111 - DNA, 20 bp, Artificial Sequence
  sgRNA
cggaacttaatagacaccaa

SEQ ID NO: 1112 - DNA, 20 bp, Artificial Sequence
  sgRNA
tcatttctatgctagggctt

SEQ ID NO: 1113 - DNA, 20 bp, Artificial Sequence
  sgRNA
agattgaatctcagagttta

SEQ ID NO: 1114 - DNA, 20 bp, Artificial Sequence
  sgRNA
tcggagagcaagcattctgc

SEQ ID NO: 1115 - DNA, 20 bp, Artificial Sequence
  sgRNA
gccttgcacgccgcccattc

SEQ ID NO: 1116 - DNA, 20 bp, Artificial Sequence
  sgRNA
aaacaaagctttatcacgtg

SEQ ID NO: 1117 - DNA, 20 bp, Artificial Sequence
  sgRNA
ggctgcgggaggagggtgcc

SEQ ID NO: 1118 - DNA, 20 bp, Artificial Sequence
  sgRNA
ggagctgcggctaagcgcgc

SEQ ID NO: 1119 - DNA, 20 bp, Artificial Sequence
  sgRNA
ggctgctgagcccacgtcag

SEQ ID NO: 1120 - DNA, 20 bp, Artificial Sequence
  sgRNA
tatcccagagtgctcgagtc

SEQ ID NO: 1121 - DNA, 20 bp, Artificial Sequence
  sgRNA
ataaattaatgctcctgcgc

SEQ ID NO: 1122 - DNA, 20 bp, Artificial Sequence
  sgRNA
aattgctaacaatcagatag

SEQ ID NO: 1123 - DNA, 20 bp, Artificial Sequence
  sgRNA
cggaggctgagcgatcgctg

SEQ ID NO: 1124 - DNA, 20 bp, Artificial Sequence
  sgRNA
aagtggcttgttcatgcaca

SEQ ID NO: 1125 - DNA, 20 bp, Artificial Sequence
  sgRNA
atgccgtgtcctctgaacgg

SEQ ID NO: 1126 - DNA, 20 bp, Artificial Sequence
  sgRNA
acccggtgcggatagggctc

SEQ ID NO: 1127 - DNA, 20 bp, Artificial Sequence
  sgRNA
tcgctgcttcttacgtaagc

SEQ ID NO: 1128 - DNA, 20 bp, Artificial Sequence
  sgRNA
cccgagatcccgcagctcgg

SEQ ID NO: 1129 - DNA, 20 bp, Artificial Sequence
  sgRNA
tgcataacgctcgagcattc

SEQ ID NO: 1130 - DNA, 20 bp, Artificial Sequence
  sgRNA
tgagaactgtcattatctag

SEQ ID NO: 1131 - DNA, 20 bp, Artificial Sequence
  sgRNA
cgtgatgatgcaaaccggtg

SEQ ID NO: 1132 - DNA, 20 bp, Artificial Sequence
  sgRNA
tcaggctggagctaggtcgc

SEQ ID NO: 1133 - DNA, 20 bp, Artificial Sequence
  sgRNA
actcatctgatcgtgatgcg

SEQ ID NO: 1134 - DNA, 20 bp, Artificial Sequence
  sgRNA
agctgcgcgcagtgccctcg

SEQ ID NO: 1135 - DNA, 20 bp, Artificial Sequence
  sgRNA
agttgattgcaaagaggcgg

SEQ ID NO: 1136 - DNA, 20 bp, Artificial Sequence
  sgRNA
caatactaaagaaagcatcc

SEQ ID NO: 1137 - DNA, 20 bp, Artificial Sequence
  sgRNA
ggaacagagcgtagtgccaa

SEQ ID NO: 1138 - DNA, 20 bp, Artificial Sequence
  sgRNA
ttgacagcgagagcgcctcc

SEQ ID NO: 1139 - DNA, 20 bp, Artificial Sequence
  sgRNA
gtcatagaggactcagtcct

SEQ ID NO: 1140 - DNA, 20 bp, Artificial Sequence
  sgRNA
cctggagggcgtcctggcgg

SEQ ID NO: 1141 - DNA, 20 bp, Artificial Sequence
  sgRNA
agctcgaatccgtcgctatg

SEQ ID NO: 1142 - DNA, 20 bp, Artificial Sequence
  sgRNA
tcaccgtcctctagggactc

SEQ ID NO: 1143 - DNA, 20 bp, Artificial Sequence
  sgRNA
atagggcttgattctcatcc

SEQ ID NO: 1144 - DNA, 20 bp, Artificial Sequence
  sgRNA
ttctctttgtggcctcgctc

SEQ ID NO: 1145 - DNA, 20 bp, Artificial Sequence
  sgRNA
cttccgcaaacgcgcctggg

SEQ ID NO: 1146 - DNA, 20 bp, Artificial Sequence
  sgRNA
atcaaaccagcccgctctat

SEQ ID NO: 1147 - DNA, 20 bp, Artificial Sequence
  sgRNA
tgcggagcgctgtttggcgc

SEQ ID NO: 1148 - DNA, 20 bp, Artificial Sequence
  sgRNA
ttgctaagaactctctctcc

SEQ ID NO: 1149 - DNA, 20 bp, Artificial Sequence
  sgRNA
ggcggctccgcataaccacg

SEQ ID NO: 1150 - DNA, 20 bp, Artificial Sequence
  sgRNA
gggcaaggctaagtaaggta

SEQ ID NO: 1151 - DNA, 20 bp, Artificial Sequence
  sgRNA
gtttgggtgtcaccggctgc

SEQ ID NO: 1152 - DNA, 20 bp, Artificial Sequence
  sgRNA
acggagggtggcgcattgaa

SEQ ID NO: 1153 - DNA, 20 bp, Artificial Sequence
  sgRNA
tccaaagcaagatccagata

SEQ ID NO: 1154 - DNA, 20 bp, Artificial Sequence
  sgRNA
ctctctccctcctaacatgc

SEQ ID NO: 1155 - DNA, 20 bp, Artificial Sequence
  sgRNA
gggcccagccctttcccgac

SEQ ID NO: 1156 - DNA, 20 bp, Artificial Sequence
  sgRNA
cagaggccaacctgtcctct

SEQ ID NO: 1157 - DNA, 20 bp, Artificial Sequence
  sgRNA
gtttgtgtttctggcctcta

SEQ ID NO: 1158 - DNA, 20 bp, Artificial Sequence
  sgRNA
gcccgaggctgacttctcat

SEQ ID NO: 1159 - DNA, 20 bp, Artificial Sequence
  sgRNA
cagcgggtgagccagcttgc

SEQ ID NO: 1160 - DNA, 20 bp, Artificial Sequence
  sgRNA
aacatcatcgggatctaatc

SEQ ID NO: 1161 - DNA, 20 bp, Artificial Sequence
  sgRNA
gggacgttggttccctgcac

SEQ ID NO: 1162 - DNA, 20 bp, Artificial Sequence
  sgRNA
cgggaccctcggcacccatt

SEQ ID NO: 1163 - DNA, 20 bp, Artificial Sequence
  sgRNA
tagggctatttctgccaggc

SEQ ID NO: 1164 - DNA, 20 bp, Artificial Sequence
  sgRNA
atgaaagacgcactcactcc

SEQ ID NO: 1165 - DNA, 20 bp, Artificial Sequence
  sgRNA
ttggcacagctacatcagcg

SEQ ID NO: 1166 - DNA, 20 bp, Artificial Sequence
  sgRNA
aaaggagctctggaccacta

SEQ ID NO: 1167 - DNA, 20 bp, Artificial Sequence
  sgRNA
tgcctaaccacctctacctt

SEQ ID NO: 1168 - DNA, 20 bp, Artificial Sequence
  sgRNA
tgccaaactccagaaatacc

SEQ ID NO: 1169 - DNA, 20 bp, Artificial Sequence
  sgRNA
atagagtttggttacttgaa

SEQ ID NO: 1170 - DNA, 20 bp, Artificial Sequence
  sgRNA
agactaccaccgtagacaag

SEQ ID NO: 1171 - DNA, 20 bp, Artificial Sequence
  sgRNA
gcgccgctgcccttgtagcc

SEQ ID NO: 1172 - DNA, 20 bp, Artificial Sequence
  sgRNA
tcactttgagaagagagata

SEQ ID NO: 1173 - DNA, 20 bp, Artificial Sequence
  sgRNA
tgcgcatgttccacccgctc

SEQ ID NO: 1174 - DNA, 20 bp, Artificial Sequence
  sgRNA
gaacccgcggagcctccggt

SEQ ID NO: 1175 - DNA, 20 bp, Artificial Sequence
  sgRNA
gtagccacgcccaagtcgcg

SEQ ID NO: 1176 - DNA, 20 bp, Artificial Sequence
  sgRNA
gaacttgatagactgaacta

SEQ ID NO: 1177 - DNA, 20 bp, Artificial Sequence
  sgRNA
gaagcctgagagcgaggctg

SEQ ID NO: 1178 - DNA, 20 bp, Artificial Sequence
  sgRNA
gcaatcggctcgtgtctctc

SEQ ID NO: 1179 - DNA, 20 bp, Artificial Sequence
  sgRNA
gctttggcacggatggcacg

SEQ ID NO: 1180 - DNA, 20 bp, Artificial Sequence
  sgRNA
cgagtttcactctcactatc

SEQ ID NO: 1181 - DNA, 20 bp, Artificial Sequence
  sgRNA
gctgtcttacctgattcctc

SEQ ID NO: 1182 - DNA, 20 bp, Artificial Sequence
  sgRNA
ggtcacatggcatagatgtc

SEQ ID NO: 1183 - DNA, 20 bp, Artificial Sequence
  sgRNA
taagcggaagagacaagaac

SEQ ID NO: 1184 - DNA, 20 bp, Artificial Sequence
  sgRNA
gtgctgctgcgctatagcgg

SEQ ID NO: 1185 - DNA, 20 bp, Artificial Sequence
  sgRNA
tacactaaacccatacctcc

SEQ ID NO: 1186 - DNA, 20 bp, Artificial Sequence
  sgRNA
ggagccaaacatggcgtcta

SEQ ID NO: 1187 - DNA, 20 bp, Artificial Sequence
  sgRNA
tgcgcagagccagcacaaat

SEQ ID NO: 1188 - DNA, 20 bp, Artificial Sequence
  sgRNA
agaggtggcagttgcaggcc

SEQ ID NO: 1189 - DNA, 20 bp, Artificial Sequence
  sgRNA
cctttcgggcttcggtggag

SEQ ID NO: 1190 - DNA, 20 bp, Artificial Sequence
  sgRNA
aagatgagccgcgctcgctg

SEQ ID NO: 1191 - DNA, 20 bp, Artificial Sequence
  sgRNA
ggtaacccacagccagtgac

SEQ ID NO: 1192 - DNA, 20 bp, Artificial Sequence
  sgRNA
agtatgcaaaggatagtgat

SEQ ID NO: 1193 - DNA, 20 bp, Artificial Sequence
  sgRNA
tttcggttctactcctgcag

SEQ ID NO: 1194 - DNA, 20 bp, Artificial Sequence
  sgRNA
agctaaggcctcacctccct

SEQ ID NO: 1195 - DNA, 20 bp, Artificial Sequence
  sgRNA
acctcccttggatctcgccc

SEQ ID NO: 1196 - DNA, 20 bp, Artificial Sequence
  sgRNA
agaaacttatgacttcctaa

SEQ ID NO: 1197 - DNA, 20 bp, Artificial Sequence
  sgRNA
tcgccgtcagatttctttgg

SEQ ID NO: 1198 - DNA, 20 bp, Artificial Sequence
  sgRNA
ggtcagtggaaggaaggctg

SEQ ID NO: 1199 - DNA, 20 bp, Artificial Sequence
  sgRNA
ctacaccaattgaaggttac

SEQ ID NO: 1200 - DNA, 20 bp, Artificial Sequence
  sgRNA
aaagagacgccactgttaga

SEQ ID NO: 1201 - DNA, 20 bp, Artificial Sequence
  sgRNA
cgtgcttaaacggcacagca

SEQ ID NO: 1202 - DNA, 20 bp, Artificial Sequence
  sgRNA
attaagataaagcatcagag

SEQ ID NO: 1203 - DNA, 20 bp, Artificial Sequence
  sgRNA
tacgcatgtgcctcccagct

SEQ ID NO: 1204 - DNA, 20 bp, Artificial Sequence
  sgRNA
gagaggagatggatgtccct

SEQ ID NO: 1205 - DNA, 20 bp, Artificial Sequence
  sgRNA
tatttatatccatcccactc

SEQ ID NO: 1206 - DNA, 20 bp, Artificial Sequence
  sgRNA
agcacaatctgggcgggtcc

SEQ ID NO: 1207 - DNA, 20 bp, Artificial Sequence
  sgRNA
ggtaccggaacaaatcttgc

SEQ ID NO: 1208 - DNA, 20 bp, Artificial Sequence
  sgRNA
ggtgtccatgcaggtgggcg

SEQ ID NO: 1209 - DNA, 20 bp, Artificial Sequence
  sgRNA
caaaggtgcaagtttccctc

SEQ ID NO: 1210 - DNA, 20 bp, Artificial Sequence
  sgRNA
gtgagcactggcgccgcggg

SEQ ID NO: 1211 - DNA, 20 bp, Artificial Sequence
  sgRNA
ggaaggaacgggagaactag

SEQ ID NO: 1212 - DNA, 20 bp, Artificial Sequence
  sgRNA
attgctcaggttatgacacc

SEQ ID NO: 1213 - DNA, 20 bp, Artificial Sequence
  sgRNA
caataaacatgttggccctg

SEQ ID NO: 1214 - DNA, 20 bp, Artificial Sequence
  sgRNA
ggcctgttcggagggagtgg

SEQ ID NO: 1215 - DNA, 20 bp, Artificial Sequence
  sgRNA
gggtccggaaccggtttggg

SEQ ID NO: 1216 - DNA, 20 bp, Artificial Sequence
  sgRNA
agcgtttctttacgtagcgc

SEQ ID NO: 1217 - DNA, 20 bp, Artificial Sequence
  sgRNA
gcagagcagcttctcctatg

SEQ ID NO: 1218 - DNA, 20 bp, Artificial Sequence
  sgRNA
gctggaccattctcaagagg

SEQ ID NO: 1219 - DNA, 20 bp, Artificial Sequence
  sgRNA
ttacgtcagtgtgctgtttc

SEQ ID NO: 1220 - DNA, 20 bp, Artificial Sequence
  sgRNA
ccatcaaacattgaagagag

SEQ ID NO: 1221 - DNA, 20 bp, Artificial Sequence
  sgRNA
gacagagctagtccatcacc

SEQ ID NO: 1222 - DNA, 20 bp, Artificial Sequence
  sgRNA
acctgagccatgccaaggaa

SEQ ID NO: 1223 - DNA, 20 bp, Artificial Sequence
  sgRNA
ggcggagtttagggaagcag

SEQ ID NO: 1224 - DNA, 20 bp, Artificial Sequence
  sgRNA
tgctcagagcttccgactgc

SEQ ID NO: 1225 - DNA, 20 bp, Artificial Sequence
  sgRNA
ctcttgactatacataacag

SEQ ID NO: 1226 - DNA, 20 bp, Artificial Sequence
  sgRNA
gcgaggactgcgcgctaccc

SEQ ID NO: 1227 - DNA, 20 bp, Artificial Sequence
  sgRNA
cagattctgagctgcaagac

SEQ ID NO: 1228 - DNA, 20 bp, Artificial Sequence
  sgRNA
tttagggtggagatagaact

SEQ ID NO: 1229 - DNA, 20 bp, Artificial Sequence
  sgRNA
ggcctctctttccatagacc

SEQ ID NO: 1230 - DNA, 20 bp, Artificial Sequence
  sgRNA
aagacccgacattcctcttc

SEQ ID NO: 1231 - DNA, 20 bp, Artificial Sequence
  sgRNA
gactcttccagagctgctga

SEQ ID NO: 1232 - DNA, 20 bp, Artificial Sequence
  sgRNA
atcacgtgatccatagtggg

SEQ ID NO: 1233 - DNA, 20 bp, Artificial Sequence
  sgRNA
ttgatcctggaaggcaatcc

SEQ ID NO: 1234 - DNA, 20 bp, Artificial Sequence
  sgRNA
cgtcagaggaaatagaggcg

SEQ ID NO: 1235 - DNA, 20 bp, Artificial Sequence
  sgRNA
caatcgccgcgccggccaga

SEQ ID NO: 1236 - DNA, 20 bp, Artificial Sequence
  sgRNA
caaatgagggacacagagga

SEQ ID NO: 1237 - DNA, 20 bp, Artificial Sequence
  sgRNA
ggatactctccgctgatcca

SEQ ID NO: 1238 - DNA, 20 bp, Artificial Sequence
  sgRNA
gggacgtttggaagatgctt

SEQ ID NO: 1239 - DNA, 20 bp, Artificial Sequence
  sgRNA
tgactcgtcttgttctattt

SEQ ID NO: 1240 - DNA, 20 bp, Artificial Sequence
  sgRNA
cccgtttggccaatgacaat

SEQ ID NO: 1241 - DNA, 20 bp, Artificial Sequence
  sgRNA
ctggagagggagtaacccgt

SEQ ID NO: 1242 - DNA, 20 bp, Artificial Sequence
  sgRNA
gggaggcgcgcgtgtgctcc

SEQ ID NO: 1243 - DNA, 20 bp, Artificial Sequence
  sgRNA
gtgcccaacggtgccagggt

SEQ ID NO: 1244 - DNA, 20 bp, Artificial Sequence
  sgRNA
tgcgcccagaggcgctacgg

SEQ ID NO: 1245 - DNA, 20 bp, Artificial Sequence
  sgRNA
ggatgaccgcgaccgcgcgc

SEQ ID NO: 1246 - DNA, 20 bp, Artificial Sequence
  sgRNA
tctatcacccataagcttac

SEQ ID NO: 1247 - DNA, 20 bp, Artificial Sequence
  sgRNA
ggtcagctcacaatgatgaa

SEQ ID NO: 1248 - DNA, 20 bp, Artificial Sequence
  sgRNA
ttgtagtttgcatgtgtccg

SEQ ID NO: 1249 - DNA, 20 bp, Artificial Sequence
  sgRNA
acctccagggctagccaatg

SEQ ID NO: 1250 - DNA, 20 bp, Artificial Sequence
  sgRNA
gaggcagtctccagggaagt

SEQ ID NO: 1251 - DNA, 20 bp, Artificial Sequence
  sgRNA
aagccaagaactaggaggag

SEQ ID NO: 1252 - DNA, 20 bp, Artificial Sequence
  sgRNA
ttgcatcacaaagcgttgcc

SEQ ID NO: 1253 - DNA, 20 bp, Artificial Sequence
  sgRNA
tttatgcaatgttaagtgag

SEQ ID NO: 1254 - DNA, 20 bp, Artificial Sequence
  sgRNA
cacggcgtcttgggtggtcc

SEQ ID NO: 1255 - DNA, 20 bp, Artificial Sequence
  sgRNA
gaggcagtggagggttatcc

SEQ ID NO: 1256 - DNA, 20 bp, Artificial Sequence
  sgRNA
ctcgtcccggttactagcac

SEQ ID NO: 1257 - DNA, 20 bp, Artificial Sequence
  sgRNA
gagatcaggaaattctgcgt

SEQ ID NO: 1258 - DNA, 20 bp, Artificial Sequence
  sgRNA
ggcttagtggctagggttgg

SEQ ID NO: 1259 - DNA, 20 bp, Artificial Sequence
  sgRNA
gggtcagaggtccgggtggc

SEQ ID NO: 1260 - DNA, 20 bp, Artificial Sequence
  sgRNA
gggtctgtttactcctataa

SEQ ID NO: 1261 - DNA, 20 bp, Artificial Sequence
  sgRNA
agaaagtacttggaggaaga

SEQ ID NO: 1262 - DNA, 20 bp, Artificial Sequence
  sgRNA
gtgtgatctgttggtgagcc

SEQ ID NO: 1263 - DNA, 20 bp, Artificial Sequence
  sgRNA
gcagctagaagcaaagcctc

SEQ ID NO: 1264 - DNA, 20 bp, Artificial Sequence
  sgRNA
cgcaaatagaaggacacgga

SEQ ID NO: 1265 - DNA, 20 bp, Artificial Sequence
  sgRNA
aagaaccaagtattcagcca

SEQ ID NO: 1266 - DNA, 20 bp, Artificial Sequence
  sgRNA
cccagagtcccagagccatt

SEQ ID NO: 1267 - DNA, 20 bp, Artificial Sequence
  sgRNA
tgagagagagagagagagag

SEQ ID NO: 1268 - DNA, 20 bp, Artificial Sequence
  sgRNA
agaaccatctgtggctcctg

SEQ ID NO: 1269 - DNA, 20 bp, Artificial Sequence
  sgRNA
atttcttctttggttctttg

SEQ ID NO: 1270 - DNA, 20 bp, Artificial Sequence
  sgRNA
agtcctgggctggccttatc

SEQ ID NO: 1271 - DNA, 20 bp, Artificial Sequence
  sgRNA
cgcgcaggaagcactgctcc

SEQ ID NO: 1272 - DNA, 20 bp, Artificial Sequence
  sgRNA
tttatggagcgcccttgtcg

SEQ ID NO: 1273 - DNA, 20 bp, Artificial Sequence
  sgRNA
aatcacgctcatcgacctat

SEQ ID NO: 1274 - DNA, 20 bp, Artificial Sequence
  sgRNA
tgggcgggttcaaggctgcg

SEQ ID NO: 1275 - DNA, 20 bp, Artificial Sequence
  sgRNA
ccgcgagctgccgcgaactc

SEQ ID NO: 1276 - DNA, 20 bp, Artificial Sequence
  sgRNA
cggacctgtggaccggatca

SEQ ID NO: 1277 - DNA, 20 bp, Artificial Sequence
  sgRNA
ctgatacagtctggtagata

SEQ ID NO: 1278 - DNA, 20 bp, Artificial Sequence
  sgRNA
ggaggcagacatagtcaccg

SEQ ID NO: 1279 - DNA, 20 bp, Artificial Sequence
  sgRNA
tctcttcctgccagcactgc

SEQ ID NO: 1280 - DNA, 20 bp, Artificial Sequence
  sgRNA
cccacacctgccgggatgtc

SEQ ID NO: 1281 - DNA, 20 bp, Artificial Sequence
  sgRNA
taggtaacaacataatcatc

SEQ ID NO: 1282 - DNA, 20 bp, Artificial Sequence
  sgRNA
cgcacagggttaagcggcag

SEQ ID NO: 1283 - DNA, 20 bp, Artificial Sequence
  sgRNA
ctcaattggtcccgcctgtc

SEQ ID NO: 1284 - DNA, 20 bp, Artificial Sequence
  sgRNA
gccaggccttatctagagga

SEQ ID NO: 1285 - DNA, 20 bp, Artificial Sequence
  sgRNA
tttgtgtttcttccagatac

SEQ ID NO: 1286 - DNA, 20 bp, Artificial Sequence
  sgRNA
ggcgggaactggtcggagaa

SEQ ID NO: 1287 - DNA, 20 bp, Artificial Sequence
  sgRNA
gaggagggccgcgacgagcc

SEQ ID NO: 1288 - DNA, 20 bp, Artificial Sequence
  sgRNA
ggcttgtgtcaccgtcgccc

SEQ ID NO: 1289 - DNA, 20 bp, Artificial Sequence
  sgRNA
cttgcaaggaccacgaggag

SEQ ID NO: 1290 - DNA, 20 bp, Artificial Sequence
  sgRNA
tctgagaggctcgtctcctc

SEQ ID NO: 1291 - DNA, 20 bp, Artificial Sequence
  sgRNA
taaagtcccggcgctgcccg

SEQ ID NO: 1292 - DNA, 20 bp, Artificial Sequence
  sgRNA
acagaacacaaccaacccaa

SEQ ID NO: 1293 - DNA, 20 bp, Artificial Sequence
  sgRNA
gtcgtgtcgtgtcgcggcgc

SEQ ID NO: 1294 - DNA, 20 bp, Artificial Sequence
  sgRNA
ccagcggactttggatctgg

SEQ ID NO: 1295 - DNA, 20 bp, Artificial Sequence
  sgRNA
gaagggtcttctgccaccga

SEQ ID NO: 1296 - DNA, 20 bp, Artificial Sequence
  sgRNA
ctggccgctctcccagtgcc

SEQ ID NO: 1297 - DNA, 20 bp, Artificial Sequence
  sgRNA
aaatgcggctgccgcttgtt

SEQ ID NO: 1298 - DNA, 20 bp, Artificial Sequence
  sgRNA
actaggcagacaggtgacta

SEQ ID NO: 1299 - DNA, 20 bp, Artificial Sequence
  sgRNA
gccgagcgggcttggcggtg

SEQ ID NO: 1300 - DNA, 20 bp, Artificial Sequence
  sgRNA
ctaagctttacagctctgtg

SEQ ID NO: 1301 - DNA, 20 bp, Artificial Sequence
  sgRNA
tcagctggcaaccatgagaa

SEQ ID NO: 1302 - DNA, 20 bp, Artificial Sequence
  sgRNA
aactcgtgacaacccgtcgg

SEQ ID NO: 1303 - DNA, 20 bp, Artificial Sequence
  sgRNA
cgaggagttacagctggagc

SEQ ID NO: 1304 - DNA, 20 bp, Artificial Sequence
  sgRNA
ttcttctaggcagacaaacg

SEQ ID NO: 1305 - DNA, 20 bp, Artificial Sequence
  sgRNA
catttccacttggcctgtga

SEQ ID NO: 1306 - DNA, 20 bp, Artificial Sequence
  sgRNA
aataggatatcacctcactc

SEQ ID NO: 1307 - DNA, 20 bp, Artificial Sequence
  sgRNA
actttccttccctacctaaa

SEQ ID NO: 1308 - DNA, 20 bp, Artificial Sequence
  sgRNA
ggagaagcaccagatgcaag

SEQ ID NO: 1309 - DNA, 20 bp, Artificial Sequence
  sgRNA
tgggcgggcgtgcgcgttga

SEQ ID NO: 1310 - DNA, 20 bp, Artificial Sequence
  sgRNA
tatgtacacattgcctcctc

SEQ ID NO: 1311 - DNA, 20 bp, Artificial Sequence
  sgRNA
agcagggaggtaagctaatt

SEQ ID NO: 1312 - DNA, 20 bp, Artificial Sequence
  sgRNA
gtgaagtctgacctcacagg

SEQ ID NO: 1313 - DNA, 20 bp, Artificial Sequence
  sgRNA
tggaaggaggatgttctcaa

SEQ ID NO: 1314 - DNA, 20 bp, Artificial Sequence
  sgRNA
tggtctggaagacttctgag

SEQ ID NO: 1315 - DNA, 20 bp, Artificial Sequence
  sgRNA
agacttcctaaagcgaagga

SEQ ID NO: 1316 - DNA, 20 bp, Artificial Sequence
  sgRNA
gggtggacccgtgacctgag

SEQ ID NO: 1317 - DNA, 20 bp, Artificial Sequence
  sgRNA
gaaaggaaactgtgtttaaa

SEQ ID NO: 1318 - DNA, 20 bp, Artificial Sequence
  sgRNA
tccgcgtgggccggatggcg

SEQ ID NO: 1319 - DNA, 20 bp, Artificial Sequence
  sgRNA
agtcctgcgaagagtttgtc

SEQ ID NO: 1320 - DNA, 20 bp, Artificial Sequence
  sgRNA
gggtttaaactcacctcctc

SEQ ID NO: 1321 - DNA, 20 bp, Artificial Sequence
  sgRNA
ctagctagcgagcatcctct

SEQ ID NO: 1322 - DNA, 20 bp, Artificial Sequence
  sgRNA
tgcagctataaatatcagag

SEQ ID NO: 1323 - DNA, 20 bp, Artificial Sequence
  sgRNA
gaacagatactatcggcaaa

SEQ ID NO: 1324 - DNA, 20 bp, Artificial Sequence
  sgRNA
gccattatcagaaccaagcg

SEQ ID NO: 1325 - DNA, 20 bp, Artificial Sequence
  sgRNA
agcttcctttctcacatctc

SEQ ID NO: 1326 - DNA, 20 bp, Artificial Sequence
  sgRNA
agctgagaggcaggtcagtc

SEQ ID NO: 1327 - DNA, 20 bp, Artificial Sequence
  sgRNA
cagcaatcctgactcagcag

SEQ ID NO: 1328 - DNA, 20 bp, Artificial Sequence
  sgRNA
attgccaaccatagttcatc

SEQ ID NO: 1329 - DNA, 20 bp, Artificial Sequence
  sgRNA
caaaccaggtggcacatcgc

SEQ ID NO: 1330 - DNA, 20 bp, Artificial Sequence
  sgRNA
cggaggttgcgtggtgcagg

SEQ ID NO: 1331 - DNA, 20 bp, Artificial Sequence
  sgRNA
tgtttccgattgggcagaat

SEQ ID NO: 1332 - DNA, 20 bp, Artificial Sequence
  sgRNA
gggacacagcgcggcacgat

SEQ ID NO: 1333 - DNA, 20 bp, Artificial Sequence
  sgRNA
gtgtgcacgttcgagctttc

SEQ ID NO: 1334 - DNA, 20 bp, Artificial Sequence
  sgRNA
cgcggctgactgacgcggtg

SEQ ID NO: 1335 - DNA, 20 bp, Artificial Sequence
  sgRNA
tctgactctggagtgcttta

SEQ ID NO: 1336 - DNA, 20 bp, Artificial Sequence
  sgRNA
gactgaggtggaggcctggg

SEQ ID NO: 1337 - DNA, 20 bp, Artificial Sequence
  sgRNA
cacgtgtcatgttccatatt

SEQ ID NO: 1338 - DNA, 20 bp, Artificial Sequence
  sgRNA
ggtcactgtcctacacaaat

SEQ ID NO: 1339 - DNA, 20 bp, Artificial Sequence
  sgRNA
gaagcgtgcgagtacttatg

SEQ ID NO: 1340 - DNA, 20 bp, Artificial Sequence
  sgRNA
aggcatgtctccaccaaata

SEQ ID NO: 1341 - DNA, 20 bp, Artificial Sequence
  sgRNA
gcagttgggaaacttgatat

SEQ ID NO: 1342 - DNA, 20 bp, Artificial Sequence
  sgRNA
atgcagatgaggcgggcgcg

SEQ ID NO: 1343 - DNA, 20 bp, Artificial Sequence
  sgRNA
tggcaaccgtggcgcagctt

SEQ ID NO: 1344 - DNA, 20 bp, Artificial Sequence
  sgRNA
agcaaatctcattggtaaag

SEQ ID NO: 1345 - DNA, 20 bp, Artificial Sequence
  sgRNA
cgtgaccgccgatccctctg

SEQ ID NO: 1346 - DNA, 20 bp, Artificial Sequence
  sgRNA
gggagggcgcagatcacccg

SEQ ID NO: 1347 - DNA, 20 bp, Artificial Sequence
  sgRNA
tcagtcacagaagactgaga

SEQ ID NO: 1348 - DNA, 20 bp, Artificial Sequence
  sgRNA
gctgggcatgttaacccaca

SEQ ID NO: 1349 - DNA, 20 bp, Artificial Sequence
  sgRNA
ggcttctctgggattacgtt

SEQ ID NO: 1350 - DNA, 20 bp, Artificial Sequence
  sgRNA
atggtgggattgggcttctg

SEQ ID NO: 1351 - DNA, 20 bp, Artificial Sequence
  sgRNA
ggccctaggcttgccctggg

SEQ ID NO: 1352 - DNA, 20 bp, Artificial Sequence
  sgRNA
ggtgatcgcgaccggtgccg

SEQ ID NO: 1353 - DNA, 20 bp, Artificial Sequence
  sgRNA
cggttagaattcattcctcc

SEQ ID NO: 1354 - DNA, 20 bp, Artificial Sequence
  sgRNA
ctctacaaaggcttgtgtta

SEQ ID NO: 1355 - DNA, 20 bp, Artificial Sequence
  sgRNA
ccatggaatcgaaagggtct

SEQ ID NO: 1356 - DNA, 20 bp, Artificial Sequence
  sgRNA
gggagagctacgcacaagcg

SEQ ID NO: 1357 - DNA, 20 bp, Artificial Sequence
  sgRNA
atgctgggctggtatagact

SEQ ID NO: 1358 - DNA, 20 bp, Artificial Sequence
  sgRNA
ttccaccaacactgcattcg

SEQ ID NO: 1359 - DNA, 20 bp, Artificial Sequence
  sgRNA
ctcgagacggcggcgcgcct

SEQ ID NO: 1360 - DNA, 20 bp, Artificial Sequence
  sgRNA
gggtggacggtcagcggagg

SEQ ID NO: 1361 - DNA, 20 bp, Artificial Sequence
  sgRNA
cgggtccgattgtgattgga

SEQ ID NO: 1362 - DNA, 20 bp, Artificial Sequence
  sgRNA
ggatcagcccagatagggcg

SEQ ID NO: 1363 - DNA, 20 bp, Artificial Sequence
  sgRNA
tgcaggacagcatacacccg

SEQ ID NO: 1364 - DNA, 20 bp, Artificial Sequence
  sgRNA
ggtcgctcgggccaacttcc

SEQ ID NO: 1365 - DNA, 20 bp, Artificial Sequence
  sgRNA
gagatcgggtctagctctgt

SEQ ID NO: 1366 - DNA, 20 bp, Artificial Sequence
  sgRNA
gccggacactacggagcaag

SEQ ID NO: 1367 - DNA, 20 bp, Artificial Sequence
  sgRNA
tttcagaacgcgcctggccc

SEQ ID NO: 1368 - DNA, 20 bp, Artificial Sequence
  sgRNA
aaggcgggatgcaaagcact

SEQ ID NO: 1369 - DNA, 20 bp, Artificial Sequence
  sgRNA
tatggcagatcgcagaagaa

SEQ ID NO: 1370 - DNA, 20 bp, Artificial Sequence
  sgRNA
gctgaatctttgtactatac

SEQ ID NO: 1371 - DNA, 20 bp, Artificial Sequence
  sgRNA
tggcttcttcgtacggccat

SEQ ID NO: 1372 - DNA, 20 bp, Artificial Sequence
  sgRNA
aggctgataggacctatctg

SEQ ID NO: 1373 - DNA, 20 bp, Artificial Sequence
  sgRNA
ctgtgtgccggccgccaccg

SEQ ID NO: 1374 - DNA, 20 bp, Artificial Sequence
  sgRNA
atggatgattgggctaaact

SEQ ID NO: 1375 - DNA, 20 bp, Artificial Sequence
  sgRNA
ggagcaggagcacctgctgg

SEQ ID NO: 1376 - DNA, 20 bp, Artificial Sequence
  sgRNA
ggaggcgtgcgcttcgcaaa

SEQ ID NO: 1377 - DNA, 20 bp, Artificial Sequence
  sgRNA
tgacgtcagtgccacctcct

SEQ ID NO: 1378 - DNA, 20 bp, Artificial Sequence
  sgRNA
ggaatgtgcttaattcattc

SEQ ID NO: 1379 - DNA, 20 bp, Artificial Sequence
  sgRNA
caagggaatcgctggctctc

SEQ ID NO: 1380 - DNA, 20 bp, Artificial Sequence
  sgRNA
cctccgctccttggctcacg

SEQ ID NO: 1381 - DNA, 20 bp, Artificial Sequence
  sgRNA
gtcaccaaaccggtggccgg

SEQ ID NO: 1382 - DNA, 20 bp, Artificial Sequence
  sgRNA
ggatgtacgtgcaaagatat

SEQ ID NO: 1383 - DNA, 20 bp, Artificial Sequence
  sgRNA
gccgctgtcgtgaggcatgc

SEQ ID NO: 1384 - DNA, 20 bp, Artificial Sequence
  sgRNA
cggattccgtgacgccagcc

SEQ ID NO: 1385 - DNA, 20 bp, Artificial Sequence
  sgRNA
tgttaagtgccgtggcagta

SEQ ID NO: 1386 - DNA, 20 bp, Artificial Sequence
  sgRNA
ccagtgcggcgcgcccaatc

SEQ ID NO: 1387 - DNA, 20 bp, Artificial Sequence
  sgRNA
gaagctgtcagagcatttga

SEQ ID NO: 1388 - DNA, 20 bp, Artificial Sequence
  sgRNA
actctcgcgacgcttgcgtc

SEQ ID NO: 1389 - DNA, 20 bp, Artificial Sequence
  sgRNA
agtgtccattggtcaattgt

SEQ ID NO: 1390 - DNA, 20 bp, Artificial Sequence
  sgRNA
ggaggaagtgctggtgcccg

SEQ ID NO: 1391 - DNA, 20 bp, Artificial Sequence
  sgRNA
cgttgggtcggtttgtcctc

SEQ ID NO: 1392 - DNA, 20 bp, Artificial Sequence
  sgRNA
agagaagcttctgagtaaac

SEQ ID NO: 1393 - DNA, 20 bp, Artificial Sequence
  sgRNA
tgacaggtatgggtcagacc

SEQ ID NO: 1394 - DNA, 20 bp, Artificial Sequence
  sgRNA
gtacatctgccgcacctacc

SEQ ID NO: 1395 - DNA, 20 bp, Artificial Sequence
  sgRNA
gcccggagcggaccctatgc

SEQ ID NO: 1396 - DNA, 20 bp, Artificial Sequence
  sgRNA
ctccatcaagatggtataaa

SEQ ID NO: 1397 - DNA, 20 bp, Artificial Sequence
  sgRNA
atcatgccattgtgctttca

SEQ ID NO: 1398 - DNA, 20 bp, Artificial Sequence
  sgRNA
tccatcaggagtagatgatc

SEQ ID NO: 1399 - DNA, 20 bp, Artificial Sequence
  sgRNA
ggctgaccttgagtcaaagc

SEQ ID NO: 1400 - DNA, 20 bp, Artificial Sequence
  sgRNA
aagggcaggcaacacttaaa

SEQ ID NO: 1401 - DNA, 20 bp, Artificial Sequence
  sgRNA
cccggcggagcagccgactc

SEQ ID NO: 1402 - DNA, 20 bp, Artificial Sequence
  sgRNA
ctgaaagagagataaagctg

SEQ ID NO: 1403 - DNA, 20 bp, Artificial Sequence
  sgRNA
gaagcgattcaacacacgcc

SEQ ID NO: 1404 - DNA, 20 bp, Artificial Sequence
  sgRNA
cccgccactcagtgtgtggc

SEQ ID NO: 1405 - DNA, 20 bp, Artificial Sequence
  sgRNA
aggtcttagaactggcaggt

SEQ ID NO: 1406 - DNA, 20 bp, Artificial Sequence
  sgRNA
acggcttccgggttggcggg

SEQ ID NO: 1407 - DNA, 20 bp, Artificial Sequence
  sgRNA
cccgcgctcgctcgacccac

SEQ ID NO: 1408 - DNA, 20 bp, Artificial Sequence
  sgRNA
ttcttcgaattcgttcttcg

SEQ ID NO: 1409 - DNA, 20 bp, Artificial Sequence
  sgRNA
gagatgtcattctcaactct

SEQ ID NO: 1410 - DNA, 20 bp, Artificial Sequence
  sgRNA
tgtgctccaatcagatacta

SEQ ID NO: 1411 - DNA, 20 bp, Artificial Sequence
  sgRNA
gtacatcacagtagccgatg

SEQ ID NO: 1412 - DNA, 20 bp, Artificial Sequence
  sgRNA
tggatcagactccttctaat

SEQ ID NO: 1413 - DNA, 20 bp, Artificial Sequence
  sgRNA
ctagttcttaggcagatgga

SEQ ID NO: 1414 - DNA, 20 bp, Artificial Sequence
  sgRNA
tgggaggaacattcctgccc

SEQ ID NO: 1415 - DNA, 20 bp, Artificial Sequence
  sgRNA
ccgaaacgccggcttctctt

SEQ ID NO: 1416 - DNA, 20 bp, Artificial Sequence
  sgRNA
gtggtgggaacaaagggagg

SEQ ID NO: 1417 - DNA, 20 bp, Artificial Sequence
  sgRNA
tcacagccacaccgttccac

SEQ ID NO: 1418 - DNA, 20 bp, Artificial Sequence
  sgRNA
tacagatgtgatagagaccg

SEQ ID NO: 1419 - DNA, 20 bp, Artificial Sequence
  sgRNA
gggtttccgaatccgggtct

SEQ ID NO: 1420 - DNA, 20 bp, Artificial Sequence
  sgRNA
tcagggctgggtctgtgttg

SEQ ID NO: 1421 - DNA, 20 bp, Artificial Sequence
  sgRNA
ccctccatcatcaacgcggg

SEQ ID NO: 1422 - DNA, 20 bp, Artificial Sequence
  sgRNA
ccggcctgacgcgcgcaccg

SEQ ID NO: 1423 - DNA, 20 bp, Artificial Sequence
  sgRNA
aagccacagctacctcacaa

SEQ ID NO: 1424 - DNA, 20 bp, Artificial Sequence
  sgRNA
gcgagggtcctgcggtgtcc

SEQ ID NO: 1425 - DNA, 20 bp, Artificial Sequence
  sgRNA
aggcgtgacttcgacttctc

SEQ ID NO: 1426 - DNA, 20 bp, Artificial Sequence
  sgRNA
gcgtgatgggagggctttgc

SEQ ID NO: 1427 - DNA, 20 bp, Artificial Sequence
  sgRNA
tccttcccggtcacgtgcgc

SEQ ID NO: 1428 - DNA, 20 bp, Artificial Sequence
  sgRNA
acacagtggctcgtgtgtgc

SEQ ID NO: 1429 - DNA, 20 bp, Artificial Sequence
  sgRNA
gcggccgttgccctggcgag

SEQ ID NO: 1430 - DNA, 20 bp, Artificial Sequence
  sgRNA
acccagagggcctgagggcg

SEQ ID NO: 1431 - DNA, 20 bp, Artificial Sequence
  sgRNA
agcggcagcgggtagcatcc

SEQ ID NO: 1432 - DNA, 20 bp, Artificial Sequence
  sgRNA
gaatgaaatgtaaatgggcc

SEQ ID NO: 1433 - DNA, 20 bp, Artificial Sequence
  sgRNA
ggagcatccgcgcgcgagcc

SEQ ID NO: 1434 - DNA, 20 bp, Artificial Sequence
  sgRNA
cccatgcctgcaccaatggg

SEQ ID NO: 1435 - DNA, 20 bp, Artificial Sequence
  sgRNA
tcttgaacagctgcgggcgc

SEQ ID NO: 1436 - DNA, 20 bp, Artificial Sequence
  sgRNA
acggttcaccggagcggccg

SEQ ID NO: 1437 - DNA, 20 bp, Artificial Sequence
  sgRNA
gagctaaggaggaaaggtgc

SEQ ID NO: 1438 - DNA, 20 bp, Artificial Sequence
  sgRNA
ggaagtgggtacatctcaag

SEQ ID NO: 1439 - DNA, 20 bp, Artificial Sequence
  sgRNA
ttggtgctggctgcgggttt

SEQ ID NO: 1440 - DNA, 20 bp, Artificial Sequence
  sgRNA
ggaaatgggcgggccacagc

SEQ ID NO: 1441 - DNA, 20 bp, Artificial Sequence
  sgRNA
aaacaacagaattcttggtg

SEQ ID NO: 1442 - DNA, 20 bp, Artificial Sequence
  sgRNA
ctgacgcgcgggctgacgtg

SEQ ID NO: 1443 - DNA, 20 bp, Artificial Sequence
  sgRNA
cactctcctaatctttgtct

SEQ ID NO: 1444 - DNA, 20 bp, Artificial Sequence
  sgRNA
ctgagaccaccacagagcta

SEQ ID NO: 1445 - DNA, 20 bp, Artificial Sequence
  sgRNA
catttactcattccgtcacc

SEQ ID NO: 1446 - DNA, 20 bp, Artificial Sequence
  sgRNA
caatctcaggttaacgtgta

SEQ ID NO: 1447 - DNA, 20 bp, Artificial Sequence
  sgRNA
ggtggcggtggctgccgcaa

SEQ ID NO: 1448 - DNA, 20 bp, Artificial Sequence
  sgRNA
ttctgaaagacgtgaaataa

SEQ ID NO: 1449 - DNA, 20 bp, Artificial Sequence
  sgRNA
acaagcaggtgtttgattcc

SEQ ID NO: 1450 - DNA, 20 bp, Artificial Sequence
  sgRNA
cgctgccgttcattggctcc

SEQ ID NO: 1451 - DNA, 20 bp, Artificial Sequence
  sgRNA
atcttgtatccatagtgcca

SEQ ID NO: 1452 - DNA, 20 bp, Artificial Sequence
  sgRNA
cccgcaggctcacctggctg

SEQ ID NO: 1453 - DNA, 20 bp, Artificial Sequence
  sgRNA
tttgcatgacagaaacacat

SEQ ID NO: 1454 - DNA, 20 bp, Artificial Sequence
  sgRNA
aatggtcattaataatgcag

SEQ ID NO: 1455 - DNA, 20 bp, Artificial Sequence
  sgRNA
tgagggtttgcaccaatccg

SEQ ID NO: 1456 - DNA, 20 bp, Artificial Sequence
  sgRNA
ggaattgtagtccgggccag

SEQ ID NO: 1457 - DNA, 20 bp, Artificial Sequence
  sgRNA
ttcttaccgggctagctggg

SEQ ID NO: 1458 - DNA, 20 bp, Artificial Sequence
  sgRNA
caatgctccgctcgagggcg

SEQ ID NO: 1459 - DNA, 20 bp, Artificial Sequence
  sgRNA
tactcttagtgccgcagccg

SEQ ID NO: 1460 - DNA, 20 bp, Artificial Sequence
  sgRNA
gcgtggcgagggagagggcg

SEQ ID NO: 1461 - DNA, 20 bp, Artificial Sequence
  sgRNA
tttctgctgctgcgcgaccc

SEQ ID NO: 1462 - DNA, 20 bp, Artificial Sequence
  sgRNA
gggccggaacgcaccgccat

SEQ ID NO: 1463 - DNA, 20 bp, Artificial Sequence
  sgRNA
gatgattcaggaagctgcct

SEQ ID NO: 1464 - DNA, 20 bp, Artificial Sequence
  sgRNA
ggccctctggtggtagcacc

SEQ ID NO: 1465 - DNA, 20 bp, Artificial Sequence
  sgRNA
gtggccgaggcggagcgccc

SEQ ID NO: 1466 - DNA, 20 bp, Artificial Sequence
  sgRNA
tggtctatcctgggtgtggg

SEQ ID NO: 1467 - DNA, 20 bp, Artificial Sequence
  sgRNA
tctgttggcgtccttcctgt

SEQ ID NO: 1468 - DNA, 20 bp, Artificial Sequence
  sgRNA
cgtagcttctgctatgtggc

SEQ ID NO: 1469 - DNA, 20 bp, Artificial Sequence
  sgRNA
ggcagggctctcttcaacct

SEQ ID NO: 1470 - DNA, 20 bp, Artificial Sequence
  sgRNA
gtgtgcttgaaatggctttg

SEQ ID NO: 1471 - DNA, 20 bp, Artificial Sequence
  sgRNA
gaggttcacgtgatcattgc

SEQ ID NO: 1472 - DNA, 20 bp, Artificial Sequence
  sgRNA
gcgcagacctgaccaccaat

SEQ ID NO: 1473 - DNA, 20 bp, Artificial Sequence
  sgRNA
gctccatttataggaggagc

SEQ ID NO: 1474 - DNA, 20 bp, Artificial Sequence
  sgRNA
cagggcgtgtcctgaaaccc

SEQ ID NO: 1475 - DNA, 20 bp, Artificial Sequence
  sgRNA
cgtgatagcccagctgcctg

SEQ ID NO: 1476 - DNA, 20 bp, Artificial Sequence
  sgRNA
caagacctccagctcaaggg

SEQ ID NO: 1477 - DNA, 20 bp, Artificial Sequence
  sgRNA
tcaatgggcaccgatgggcg

SEQ ID NO: 1478 - DNA, 20 bp, Artificial Sequence
  sgRNA
agctgtctggagaatctaac

SEQ ID NO: 1479 - DNA, 20 bp, Artificial Sequence
  sgRNA
aaattctcctagtgagaatg

SEQ ID NO: 1480 - DNA, 20 bp, Artificial Sequence
  sgRNA
gatcccgtagctagagaacg

SEQ ID NO: 1481 - DNA, 20 bp, Artificial Sequence
  sgRNA
tgattggcggagcgcgatgc

SEQ ID NO: 1482 - DNA, 20 bp, Artificial Sequence
  sgRNA
gtcgccgagccgggttgcta

SEQ ID NO: 1483 - DNA, 20 bp, Artificial Sequence
  sgRNA
aaatcccgcgatttgtaccg

SEQ ID NO: 1484 - DNA, 20 bp, Artificial Sequence
  sgRNA
aatgactgtttaatttgggt

SEQ ID NO: 1485 - DNA, 20 bp, Artificial Sequence
  sgRNA
cagaagtgctctgcagcgcc

SEQ ID NO: 1486 - DNA, 20 bp, Artificial Sequence
  sgRNA
acactatcccagagtctccc

SEQ ID NO: 1487 - DNA, 20 bp, Artificial Sequence
  sgRNA
cctgtacgtttacatgtgcc

SEQ ID NO: 1488 - DNA, 20 bp, Artificial Sequence
  sgRNA
cactagttacaactcctgca

SEQ ID NO: 1489 - DNA, 20 bp, Artificial Sequence
  sgRNA
tccatcgtgacctttaaagg

SEQ ID NO: 1490 - DNA, 20 bp, Artificial Sequence
  sgRNA
gagcaatacagcaggagtcg

SEQ ID NO: 1491 - DNA, 20 bp, Artificial Sequence
  sgRNA
tttgggctcatgaaaggttt

SEQ ID NO: 1492 - DNA, 20 bp, Artificial Sequence
  sgRNA
gagtgatggcaaggaagccc

SEQ ID NO: 1493 - DNA, 20 bp, Artificial Sequence
  sgRNA
cctgaatgtatgaatcccac

SEQ ID NO: 1494 - DNA, 20 bp, Artificial Sequence
  sgRNA
gctcgtatatccaacctcag

SEQ ID NO: 1495 - DNA, 20 bp, Artificial Sequence
  sgRNA
tcaggacagacagttaggca

SEQ ID NO: 1496 - DNA, 20 bp, Artificial Sequence
  sgRNA
gaccctaattcagtagatct

SEQ ID NO: 1497 - DNA, 20 bp, Artificial Sequence
  sgRNA
tgaacaagcacatccgcccg

SEQ ID NO: 1498 - DNA, 20 bp, Artificial Sequence
  sgRNA
agaggcttgtctacatgcct

SEQ ID NO: 1499 - DNA, 20 bp, Artificial Sequence
  sgRNA
ggtgctcttgagtgctggct

SEQ ID NO: 1500 - DNA, 20 bp, Artificial Sequence
  sgRNA
gccacagttagaggaggttg

SEQ ID NO: 1501 - DNA, 20 bp, Artificial Sequence
  sgRNA
aaattcctgcagctcagaaa

SEQ ID NO: 1502 - DNA, 20 bp, Artificial Sequence
  sgRNA
gctgctctacacctgccgcg

SEQ ID NO: 1503 - DNA, 20 bp, Artificial Sequence
  sgRNA
ggcgtgtctcaacagagaat

SEQ ID NO: 1504 - DNA, 20 bp, Artificial Sequence
  sgRNA
tacaagaatctttctcatgg

SEQ ID NO: 1505 - DNA, 20 bp, Artificial Sequence
  sgRNA
tcggtgcgtgccaggccggg

SEQ ID NO: 1506 - DNA, 20 bp, Artificial Sequence
  sgRNA
gccacccgggatgcgagcac

SEQ ID NO: 1507 - DNA, 20 bp, Artificial Sequence
  sgRNA
ccaggtgaccggcagggctc

SEQ ID NO: 1508 - DNA, 20 bp, Artificial Sequence
  sgRNA
ttaatctgtgagagttaatc

SEQ ID NO: 1509 - DNA, 20 bp, Artificial Sequence
  sgRNA
gcgccgccgtctcactccag

SEQ ID NO: 1510 - DNA, 20 bp, Artificial Sequence
  sgRNA
ggaatcacctagaacaggcc

SEQ ID NO: 1511 - DNA, 20 bp, Artificial Sequence
  sgRNA
aaacgttgggcacatcattt

SEQ ID NO: 1512 - DNA, 20 bp, Artificial Sequence
  sgRNA
gggcgttgcttctacgggct

SEQ ID NO: 1513 - DNA, 20 bp, Artificial Sequence
  sgRNA
tggcatctcaggttgcagcc

SEQ ID NO: 1514 - DNA, 20 bp, Artificial Sequence
  sgRNA
atctgtcactgaagctgaaa

SEQ ID NO: 1515 - DNA, 20 bp, Artificial Sequence
  sgRNA
ggtgaagcacttggtgcagg

SEQ ID NO: 1516 - DNA, 20 bp, Artificial Sequence
  sgRNA
ggctcgagaagggagggctt

SEQ ID NO: 1517 - DNA, 20 bp, Artificial Sequence
  sgRNA
ttattccatggaatctcatt

SEQ ID NO: 1518 - DNA, 20 bp, Artificial Sequence
  sgRNA
gggctggctgaaagacactc

SEQ ID NO: 1519 - DNA, 20 bp, Artificial Sequence
  sgRNA
gggctaactgccaatcgcaa

SEQ ID NO: 1520 - DNA, 20 bp, Artificial Sequence
  sgRNA
tcccagctactgttagtctg

SEQ ID NO: 1521 - DNA, 20 bp, Artificial Sequence
  sgRNA
tagtgataacacttagaagc

SEQ ID NO: 1522 - DNA, 20 bp, Artificial Sequence
  sgRNA
gccggatccaaattccaggg

SEQ ID NO: 1523 - DNA, 20 bp, Artificial Sequence
  sgRNA
acagtagcttgtcactggcg

SEQ ID NO: 1524 - DNA, 20 bp, Artificial Sequence
  sgRNA
tcagagggcgttcttgaggc

SEQ ID NO: 1525 - DNA, 20 bp, Artificial Sequence
  sgRNA
gactagagcccaccgggtca

SEQ ID NO: 1526 - DNA, 20 bp, Artificial Sequence
  sgRNA
gtgtaaaggagtgtaaattg

SEQ ID NO: 1527 - DNA, 20 bp, Artificial Sequence
  sgRNA
ggctttcatcggagcacgct

SEQ ID NO: 1528 - DNA, 20 bp, Artificial Sequence
  sgRNA
aataaactgaaagccctctg

SEQ ID NO: 1529 - DNA, 20 bp, Artificial Sequence
  sgRNA
gccctgggcgagcagcttgg

SEQ ID NO: 1530 - DNA, 20 bp, Artificial Sequence
  sgRNA
ccgcatctgcctataactga

SEQ ID NO: 1531 - DNA, 20 bp, Artificial Sequence
  sgRNA
aacacataatctcttcagct

SEQ ID NO: 1532 - DNA, 20 bp, Artificial Sequence
  sgRNA
gtcagaaccgcgttccctca

SEQ ID NO: 1533 - DNA, 20 bp, Artificial Sequence
  sgRNA
gctgggaggcctctgcggcg

SEQ ID NO: 1534 - DNA, 20 bp, Artificial Sequence
  sgRNA
tataggcaccaacgagtagc

SEQ ID NO: 1535 - DNA, 20 bp, Artificial Sequence
  sgRNA
tgctatggtcaccagatacc

SEQ ID NO: 1536 - DNA, 20 bp, Artificial Sequence
  sgRNA
gcatgatggtgttaaattac

SEQ ID NO: 1537 - DNA, 20 bp, Artificial Sequence
  sgRNA
gggacgccacctccggaggt

SEQ ID NO: 1538 - DNA, 20 bp, Artificial Sequence
  sgRNA
aaacgtagcatgtttaactt

SEQ ID NO: 1539 - DNA, 20 bp, Artificial Sequence
  sgRNA
cagcaagtagctgacaggaa

SEQ ID NO: 1540 - DNA, 20 bp, Artificial Sequence
  sgRNA
cgtgtggaatatttcacaac

SEQ ID NO: 1541 - DNA, 20 bp, Artificial Sequence
  sgRNA
ggtcccttagttagagcaag

SEQ ID NO: 1542 - DNA, 20 bp, Artificial Sequence
  sgRNA
aaagaggaactttatagagc

SEQ ID NO: 1543 - DNA, 20 bp, Artificial Sequence
  sgRNA
gcgcgctccgagacgcagag

SEQ ID NO: 1544 - DNA, 20 bp, Artificial Sequence
  sgRNA
cctccctttccctctggctc

SEQ ID NO: 1545 - DNA, 20 bp, Artificial Sequence
  sgRNA
tacttacctttgcaactgcc

SEQ ID NO: 1546 - DNA, 20 bp, Artificial Sequence
  sgRNA
acaggcagtggttgaaattc

SEQ ID NO: 1547 - DNA, 20 bp, Artificial Sequence
  sgRNA
ttcgggaagcaggtatggca

SEQ ID NO: 1548 - DNA, 20 bp, Artificial Sequence
  sgRNA
ccagagcccttcagcaccat

SEQ ID NO: 1549 - DNA, 20 bp, Artificial Sequence
  sgRNA
ggcactaaatatagacttca

SEQ ID NO: 1550 - DNA, 20 bp, Artificial Sequence
  sgRNA
tcgttcagtaaattgctctt

SEQ ID NO: 1551 - DNA, 20 bp, Artificial Sequence
  sgRNA
gtacctcaggtttcctgcag

SEQ ID NO: 1552 - DNA, 20 bp, Artificial Sequence
  sgRNA
cacaggaagtggtgacttgt

SEQ ID NO: 1553 - DNA, 20 bp, Artificial Sequence
  sgRNA
aattgctaacaggcttcctt

SEQ ID NO: 1554 - DNA, 20 bp, Artificial Sequence
  sgRNA
gagtggagcttgcacaaccc

SEQ ID NO: 1555 - DNA, 20 bp, Artificial Sequence
  sgRNA
taggagccctggaagtcgcg

SEQ ID NO: 1556 - DNA, 20 bp, Artificial Sequence
  sgRNA
agggaaggagcgaggctaag

SEQ ID NO: 1557 - DNA, 20 bp, Artificial Sequence
  sgRNA
acctaccgggtgcacttcac

SEQ ID NO: 1558 - DNA, 20 bp, Artificial Sequence
  sgRNA
tcagacaagaaatccagttc

SEQ ID NO: 1559 - DNA, 20 bp, Artificial Sequence
  sgRNA
gggaggaccaatctggaaga

SEQ ID NO: 1560 - DNA, 20 bp, Artificial Sequence
  sgRNA
ggagtctgagccgcggaacc

SEQ ID NO: 1561 - DNA, 20 bp, Artificial Sequence
  sgRNA
gcgtattcttgtgggatggc

SEQ ID NO: 1562 - DNA, 20 bp, Artificial Sequence
  sgRNA
cttgtcaccgagcaacaaga

SEQ ID NO: 1563 - DNA, 20 bp, Artificial Sequence
  sgRNA
gggctacaggttagggcgac

SEQ ID NO: 1564 - DNA, 20 bp, Artificial Sequence
  sgRNA
cgggacttccatgcgcgcct

SEQ ID NO: 1565 - DNA, 20 bp, Artificial Sequence
  sgRNA
gttcggcaagaatcctcacg

SEQ ID NO: 1566 - DNA, 20 bp, Artificial Sequence
  sgRNA
ctggacattctattgtctcc

SEQ ID NO: 1567 - DNA, 20 bp, Artificial Sequence
  sgRNA
gggtctgtctacacgggctc

SEQ ID NO: 1568 - DNA, 20 bp, Artificial Sequence
  sgRNA
accctattgatttcttcttc

SEQ ID NO: 1569 - DNA, 20 bp, Artificial Sequence
  sgRNA
gtctgttaattgcatcactt

SEQ ID NO: 1570 - DNA, 20 bp, Artificial Sequence
  sgRNA
ggtggagatggagataagga

SEQ ID NO: 1571 - DNA, 20 bp, Artificial Sequence
  sgRNA
gtacgcgactgtcctccttg

SEQ ID NO: 1572 - DNA, 20 bp, Artificial Sequence
  sgRNA
acacttggtgaggaggtaaa

SEQ ID NO: 1573 - DNA, 20 bp, Artificial Sequence
  sgRNA
tggaagttcatttagactgc

SEQ ID NO: 1574 - DNA, 20 bp, Artificial Sequence
  sgRNA
aatgattatgctgagccatg

SEQ ID NO: 1575 - DNA, 20 bp, Artificial Sequence
  sgRNA
agagagaaatggagagggag

SEQ ID NO: 1576 - DNA, 20 bp, Artificial Sequence
  sgRNA
gcagcgagtctgattgttcc

SEQ ID NO: 1577 - DNA, 20 bp, Artificial Sequence
  sgRNA
actgtgaagctgagggaact

SEQ ID NO: 1578 - DNA, 20 bp, Artificial Sequence
  sgRNA
gagcccatcctcagctaaga

SEQ ID NO: 1579 - DNA, 20 bp, Artificial Sequence
  sgRNA
ggagggtgaagtgatgtgac

SEQ ID NO: 1580 - DNA, 20 bp, Artificial Sequence
  sgRNA
gggcgctaaccagtccttga

SEQ ID NO: 1581 - DNA, 20 bp, Artificial Sequence
  sgRNA
cgaatgcttatgtgagctct

SEQ ID NO: 1582 - DNA, 20 bp, Artificial Sequence
  sgRNA
cctaaaggataatgtaagaa

SEQ ID NO: 1583 - DNA, 20 bp, Artificial Sequence
  sgRNA
gggcgggtggacccgcttgc

SEQ ID NO: 1584 - DNA, 20 bp, Artificial Sequence
  sgRNA
ttgatgaatcacgtgtgtcg

SEQ ID NO: 1585 - DNA, 20 bp, Artificial Sequence
  sgRNA
tggtaaggtctaggaggctt

SEQ ID NO: 1586 - DNA, 20 bp, Artificial Sequence
  sgRNA
gggcgcgggcggaggctcgg

SEQ ID NO: 1587 - DNA, 20 bp, Artificial Sequence
  sgRNA
agatgacggctctcatatgg

SEQ ID NO: 1588 - DNA, 20 bp, Artificial Sequence
  sgRNA
caggcactggtgccaagcga

SEQ ID NO: 1589 - DNA, 20 bp, Artificial Sequence
  sgRNA
atttgcaacctgattcaaca

SEQ ID NO: 1590 - DNA, 20 bp, Artificial Sequence
  sgRNA
gaagcgttatcatgtgaggc

SEQ ID NO: 1591 - DNA, 20 bp, Artificial Sequence
  sgRNA
aaacttacaaaccttccgat

SEQ ID NO: 1592 - DNA, 20 bp, Artificial Sequence
  sgRNA
cccgccgccagctgtaggga

SEQ ID NO: 1593 - DNA, 20 bp, Artificial Sequence
  sgRNA
tggtccggcagactattcca

SEQ ID NO: 1594 - DNA, 20 bp, Artificial Sequence
  sgRNA
cgctcacggtggcctcccac

SEQ ID NO: 1595 - DNA, 20 bp, Artificial Sequence
  sgRNA
aggagacggagggtgggacc

SEQ ID NO: 1596 - DNA, 20 bp, Artificial Sequence
  sgRNA
agggagttaccagcgagtcg

SEQ ID NO: 1597 - DNA, 20 bp, Artificial Sequence
  sgRNA
gccctggaattcgagaagcc

SEQ ID NO: 1598 - DNA, 20 bp, Artificial Sequence
  sgRNA
aggagagtgtaatcttactc

SEQ ID NO: 1599 - DNA, 20 bp, Artificial Sequence
  sgRNA
ttggattcgcgcgccggccc

SEQ ID NO: 1600 - DNA, 20 bp, Artificial Sequence
  sgRNA
ctttgtaaacaagtgacaat

SEQ ID NO: 1601 - DNA, 20 bp, Artificial Sequence
  sgRNA
ataaaccagtttacccggca

SEQ ID NO: 1602 - DNA, 20 bp, Artificial Sequence
  sgRNA
agatgcatgagagaagcacg

SEQ ID NO: 1603 - DNA, 20 bp, Artificial Sequence
  sgRNA
attggtcggtgttggcgcga

SEQ ID NO: 1604 - DNA, 20 bp, Artificial Sequence
  sgRNA
tccctttaaggtctccagct

SEQ ID NO: 1605 - DNA, 20 bp, Artificial Sequence
  sgRNA
cagggatgtgtttactaagc

SEQ ID NO: 1606 - DNA, 20 bp, Artificial Sequence
  sgRNA
tatgtatgagctccctccct

SEQ ID NO: 1607 - DNA, 20 bp, Artificial Sequence
  sgRNA
agaagtggtcgggacattta

SEQ ID NO: 1608 - DNA, 20 bp, Artificial Sequence
  sgRNA
ggtcactaccaagtttggtt

SEQ ID NO: 1609 - DNA, 20 bp, Artificial Sequence
  sgRNA
caggtggatttctgagttca

SEQ ID NO: 1610 - DNA, 20 bp, Artificial Sequence
  sgRNA
gggtccagcgagcctgaccg

SEQ ID NO: 1611 - DNA, 20 bp, Artificial Sequence
  sgRNA
aacgagctatgctaaagtga

SEQ ID NO: 1612 - DNA, 20 bp, Artificial Sequence
  sgRNA
aaacggattagtgggcatct

SEQ ID NO: 1613 - DNA, 20 bp, Artificial Sequence
  sgRNA
tagaggaagtgcatctgtgc

SEQ ID NO: 1614 - DNA, 20 bp, Artificial Sequence
  sgRNA
tacaaggactcttcgctggt

SEQ ID NO: 1615 - DNA, 20 bp, Artificial Sequence
  sgRNA
agggaatcaaattcgcacaa

SEQ ID NO: 1616 - DNA, 20 bp, Artificial Sequence
  sgRNA
aggaatgggaaatgggatct

SEQ ID NO: 1617 - DNA, 20 bp, Artificial Sequence
  sgRNA
gcactgtgtcatgaaggtgg

SEQ ID NO: 1618 - DNA, 20 bp, Artificial Sequence
  sgRNA
cgccgcagctccggccatag

SEQ ID NO: 1619 - DNA, 20 bp, Artificial Sequence
  sgRNA
cccggtagtgctccattctc

SEQ ID NO: 1620 - DNA, 20 bp, Artificial Sequence
  sgRNA
ctggcatgtccacaatagtg

SEQ ID NO: 1621 - DNA, 20 bp, Artificial Sequence
  sgRNA
catcctaacctcatgcaagg

SEQ ID NO: 1622 - DNA, 20 bp, Artificial Sequence
  sgRNA
gcagaccgtgaagggaggcg

SEQ ID NO: 1623 - DNA, 20 bp, Artificial Sequence
  sgRNA
atggacattgaggctctaag

SEQ ID NO: 1624 - DNA, 20 bp, Artificial Sequence
  sgRNA
agccaactccagtccacgac

SEQ ID NO: 1625 - DNA, 20 bp, Artificial Sequence
  sgRNA
tgagatgcagttagacttac

SEQ ID NO: 1626 - DNA, 20 bp, Artificial Sequence
  sgRNA
agctcacagcaagcggcgcc

SEQ ID NO: 1627 - DNA, 20 bp, Artificial Sequence
  sgRNA
acatgtgcaaagctcccgtt

SEQ ID NO: 1628 - DNA, 20 bp, Artificial Sequence
  sgRNA
gtcaagcgctccgcacctcc

SEQ ID NO: 1629 - DNA, 20 bp, Artificial Sequence
  sgRNA
acgaaacttcaagtaccaaa

SEQ ID NO: 1630 - DNA, 20 bp, Artificial Sequence
  sgRNA
ctgttgtggttgtttaagac

SEQ ID NO: 1631 - DNA, 20 bp, Artificial Sequence
  sgRNA
ggtctcacaatcgcgtggcc

SEQ ID NO: 1632 - DNA, 20 bp, Artificial Sequence
  sgRNA
gattgggtatgaccttcagt

SEQ ID NO: 1633 - DNA, 20 bp, Artificial Sequence
  sgRNA
taagcgacgttcctagttca

SEQ ID NO: 1634 - DNA, 20 bp, Artificial Sequence
  sgRNA
tacagtcgtgggtggaccag

SEQ ID NO: 1635 - DNA, 20 bp, Artificial Sequence
  sgRNA
ctctaggcagaggacagcga

SEQ ID NO: 1636 - DNA, 20 bp, Artificial Sequence
  sgRNA
caagtgtccgagtggcgcgg

SEQ ID NO: 1637 - DNA, 20 bp, Artificial Sequence
  sgRNA
gaggaaaggtcacttgtgac

SEQ ID NO: 1638 - DNA, 20 bp, Artificial Sequence
  sgRNA
ccatttgggagcccatgtta

SEQ ID NO: 1639 - DNA, 20 bp, Artificial Sequence
  sgRNA
tagatgtcggagagtgtgcc

SEQ ID NO: 1640 - DNA, 20 bp, Artificial Sequence
  sgRNA
cccaaagtccagtgcaataa

SEQ ID NO: 1641 - DNA, 20 bp, Artificial Sequence
  sgRNA
tacattggaaagtgttgatt

SEQ ID NO: 1642 - DNA, 20 bp, Artificial Sequence
  sgRNA
gactaagaaatgtgggctgg

SEQ ID NO: 1643 - DNA, 20 bp, Artificial Sequence
  sgRNA
gcagatggtatggtccctca

SEQ ID NO: 1644 - DNA, 20 bp, Artificial Sequence
  sgRNA
tctgatccattctgcgcagc

SEQ ID NO: 1645 - DNA, 20 bp, Artificial Sequence
  sgRNA
gatgagggcggagctaagtg

SEQ ID NO: 1646 - DNA, 20 bp, Artificial Sequence
  sgRNA
ccgctgggctgcgcgctgat

SEQ ID NO: 1647 - DNA, 20 bp, Artificial Sequence
  sgRNA
acgtttatggcggtgttgct

SEQ ID NO: 1648 - DNA, 20 bp, Artificial Sequence
  sgRNA
cacaatagtgggtagtctgg

SEQ ID NO: 1649 - DNA, 20 bp, Artificial Sequence
  sgRNA
tgcctaactcttggcccacg

SEQ ID NO: 1650 - DNA, 20 bp, Artificial Sequence
  sgRNA
aaactgccgagctttcccga

SEQ ID NO: 1651 - DNA, 20 bp, Artificial Sequence
  sgRNA
gccggctgttaagactcctg

SEQ ID NO: 1652 - DNA, 20 bp, Artificial Sequence
  sgRNA
agtggtgggcggagtcatcg

SEQ ID NO: 1653 - DNA, 20 bp, Artificial Sequence
  sgRNA
ttatcaccatttacaagacc

SEQ ID NO: 1654 - DNA, 20 bp, Artificial Sequence
  sgRNA
ctcattggccgccgctcgga

SEQ ID NO: 1655 - DNA, 20 bp, Artificial Sequence
  sgRNA
gtttcacttcctgtggcgac

SEQ ID NO: 1656 - DNA, 20 bp, Artificial Sequence
  sgRNA
agaactttctaagatgcact

SEQ ID NO: 1657 - DNA, 20 bp, Artificial Sequence
  sgRNA
tgatgattaactatctcttc

SEQ ID NO: 1658 - DNA, 20 bp, Artificial Sequence
  sgRNA
tgcgccgatgctccaaggcc

SEQ ID NO: 1659 - DNA, 20 bp, Artificial Sequence
  sgRNA
gtgcatgtatgcatgcatgt

SEQ ID NO: 1660 - DNA, 20 bp, Artificial Sequence
  sgRNA
cccttcggccaccgtcggag

SEQ ID NO: 1661 - DNA, 20 bp, Artificial Sequence
  sgRNA
actccaaactcgcgcctagc

SEQ ID NO: 1662 - DNA, 20 bp, Artificial Sequence
  sgRNA
actgcctgccagtcccaagc

SEQ ID NO: 1663 - DNA, 20 bp, Artificial Sequence
  sgRNA
aaggacccggcacgcggcaa

SEQ ID NO: 1664 - DNA, 20 bp, Artificial Sequence
  sgRNA
ggctaaaggtgtcagggtat

SEQ ID NO: 1665 - DNA, 20 bp, Artificial Sequence
  sgRNA
gggtcccacgggcgggcgcg

SEQ ID NO: 1666 - DNA, 20 bp, Artificial Sequence
  sgRNA
caatctagggaaggcgggcc

SEQ ID NO: 1667 - DNA, 20 bp, Artificial Sequence
  sgRNA
ccaatgggcagtctctttct

SEQ ID NO: 1668 - DNA, 20 bp, Artificial Sequence
  sgRNA
ctctggttgagagtgccttg

SEQ ID NO: 1669 - DNA, 20 bp, Artificial Sequence
  sgRNA
tggagcagccctggtggtac

SEQ ID NO: 1670 - DNA, 20 bp, Artificial Sequence
  sgRNA
tggctgaggcctccgcttcc

SEQ ID NO: 1671 - DNA, 20 bp, Artificial Sequence
  sgRNA
atctgatactgtttctttag

SEQ ID NO: 1672 - DNA, 20 bp, Artificial Sequence
  sgRNA
ctttcggccacgcctgattc

SEQ ID NO: 1673 - DNA, 20 bp, Artificial Sequence
  sgRNA
gaacagggaaccctagaacc

SEQ ID NO: 1674 - DNA, 20 bp, Artificial Sequence
  sgRNA
gattgtgtagtgctgattgc

SEQ ID NO: 1675 - DNA, 20 bp, Artificial Sequence
  sgRNA
gaggcacctgcctcgctaat

SEQ ID NO: 1676 - DNA, 20 bp, Artificial Sequence
  sgRNA
cgctggactcctcagtctcc

SEQ ID NO: 1677 - DNA, 20 bp, Artificial Sequence
  sgRNA
gcgttgctttagttgatatg

SEQ ID NO: 1678 - DNA, 20 bp, Artificial Sequence
  sgRNA
tgtgtctgccagcgtgcagc

SEQ ID NO: 1679 - DNA, 20 bp, Artificial Sequence
  sgRNA
catttaggccgccaaagctg

SEQ ID NO: 1680 - DNA, 20 bp, Artificial Sequence
  sgRNA
aatactagataaagtcactg

SEQ ID NO: 1681 - DNA, 20 bp, Artificial Sequence
  sgRNA
tgaggttccggcttctttaa

SEQ ID NO: 1682 - DNA, 20 bp, Artificial Sequence
  sgRNA
ggatcaatatcactcacatg

SEQ ID NO: 1683 - DNA, 20 bp, Artificial Sequence
  sgRNA
gtttatttacttccggcttg

SEQ ID NO: 1684 - DNA, 20 bp, Artificial Sequence
  sgRNA
tccgccgtgactttcgcccg

SEQ ID NO: 1685 - DNA, 20 bp, Artificial Sequence
  sgRNA
tgcaccaaatctctcgagtt

SEQ ID NO: 1686 - DNA, 20 bp, Artificial Sequence
  sgRNA
gccgggactcgagggtcgcc

SEQ ID NO: 1687 - DNA, 20 bp, Artificial Sequence
  sgRNA
acagtgtttactaagcacat

SEQ ID NO: 1688 - DNA, 20 bp, Artificial Sequence
  sgRNA
cgcaggcggagactacttaa

SEQ ID NO: 1689 - DNA, 20 bp, Artificial Sequence
  sgRNA
agcaggttagtgggcgccac

SEQ ID NO: 1690 - DNA, 20 bp, Artificial Sequence
  sgRNA
tgggaagctaagaccagaag

SEQ ID NO: 1691 - DNA, 20 bp, Artificial Sequence
  sgRNA
aacacaaagaagaatgaaac

SEQ ID NO: 1692 - DNA, 20 bp, Artificial Sequence
  sgRNA
ctttacatatgcagtcccac

SEQ ID NO: 1693 - DNA, 20 bp, Artificial Sequence
  sgRNA
gtccgcagccgccgcacgtg

SEQ ID NO: 1694 - DNA, 20 bp, Artificial Sequence
  sgRNA
ctggcagcccgcgcgaggtg

SEQ ID NO: 1695 - DNA, 20 bp, Artificial Sequence
  sgRNA
aaacagctacaaggcttgct

SEQ ID NO: 1696 - DNA, 20 bp, Artificial Sequence
  sgRNA
ggcaggacattccggtcaga

SEQ ID NO: 1697 - DNA, 20 bp, Artificial Sequence
  sgRNA
cccgctcaactcacaagagg

SEQ ID NO: 1698 - DNA, 20 bp, Artificial Sequence
  sgRNA
ggaagtgtccgcagttcgcc

SEQ ID NO: 1699 - DNA, 20 bp, Artificial Sequence
  sgRNA
ggcggttcccgtgctctgat

SEQ ID NO: 1700 - DNA, 20 bp, Artificial Sequence
  sgRNA
tatcccaccattccctctag

SEQ ID NO: 1701 - DNA, 20 bp, Artificial Sequence
  sgRNA
gtactgctccctaagctcta

SEQ ID NO: 1702 - DNA, 20 bp, Artificial Sequence
  sgRNA
tttctgacttcctgtcagag

SEQ ID NO: 1703 - DNA, 20 bp, Artificial Sequence
  sgRNA
ccctccatctgtgaagatgg

SEQ ID NO: 1704 - DNA, 20 bp, Artificial Sequence
  sgRNA
gggtgaaccaaaccagtttg

SEQ ID NO: 1705 - DNA, 20 bp, Artificial Sequence
  sgRNA
ggcgggtctgtaaccggaaa

SEQ ID NO: 1706 - DNA, 20 bp, Artificial Sequence
  sgRNA
ggcaagtggagatgtgggcg

SEQ ID NO: 1707 - DNA, 20 bp, Artificial Sequence
  sgRNA
tgttgctggttgtatggagt

SEQ ID NO: 1708 - DNA, 20 bp, Artificial Sequence
  sgRNA
ggaggcgacctcggactctg

SEQ ID NO: 1709 - DNA, 20 bp, Artificial Sequence
  sgRNA
cgggaatgccgcgccgtggg

SEQ ID NO: 1710 - DNA, 20 bp, Artificial Sequence
  sgRNA
gagcggctgtcccatcgccc

SEQ ID NO: 1711 - DNA, 20 bp, Artificial Sequence
  sgRNA
gagggacgatgctaccagcc

SEQ ID NO: 1712 - DNA, 20 bp, Artificial Sequence
  sgRNA
ctttgtctggttctgttgtg

SEQ ID NO: 1713 - DNA, 20 bp, Artificial Sequence
  sgRNA
tcttctctcggttaatgtct

SEQ ID NO: 1714 - DNA, 20 bp, Artificial Sequence
  sgRNA
acgcagcgtcagctcctgat

SEQ ID NO: 1715 - DNA, 20 bp, Artificial Sequence
  sgRNA
atgtgtgagcacagacttcc

SEQ ID NO: 1716 - DNA, 20 bp, Artificial Sequence
  sgRNA
ggaggagctgaaggagggcg

SEQ ID NO: 1717 - DNA, 20 bp, Artificial Sequence
  sgRNA
ccgcccaatctcgggtgtcc

SEQ ID NO: 1718 - DNA, 20 bp, Artificial Sequence
  sgRNA
ctagatggtgcgcttgcgcc

SEQ ID NO: 1719 - DNA, 20 bp, Artificial Sequence
  sgRNA
ctgtagggaagagtgggctg

SEQ ID NO: 1720 - DNA, 20 bp, Artificial Sequence
  sgRNA
ccagattggtgttaagagga

SEQ ID NO: 1721 - DNA, 20 bp, Artificial Sequence
  sgRNA
tgttgtttgtaggtgttgga

SEQ ID NO: 1722 - DNA, 20 bp, Artificial Sequence
  sgRNA
agcttcggaggacaggctgt

SEQ ID NO: 1723 - DNA, 20 bp, Artificial Sequence
  sgRNA
gcagctttggtgtccgggag

SEQ ID NO: 1724 - DNA, 20 bp, Artificial Sequence
  sgRNA
ccttcagagtgtatcctcta

SEQ ID NO: 1725 - DNA, 20 bp, Artificial Sequence
  sgRNA
gcggttgcttagcaactaag

SEQ ID NO: 1726 - DNA, 20 bp, Artificial Sequence
  sgRNA
gggcaatgcgggtccagcca

SEQ ID NO: 1727 - DNA, 20 bp, Artificial Sequence
  sgRNA
aaacggcgagagggcgggac

SEQ ID NO: 1728 - DNA, 20 bp, Artificial Sequence
  sgRNA
atcacatttattaagcacag

SEQ ID NO: 1729 - DNA, 20 bp, Artificial Sequence
  sgRNA
gggcgcgctcccggagggtg

SEQ ID NO: 1730 - DNA, 20 bp, Artificial Sequence
  sgRNA
actcatagtcagtgtgggtg

SEQ ID NO: 1731 - DNA, 20 bp, Artificial Sequence
  sgRNA
acctaacaagtgtaaggccc

SEQ ID NO: 1732 - DNA, 20 bp, Artificial Sequence
  sgRNA
cacacacacactcaaacaga

SEQ ID NO: 1733 - DNA, 20 bp, Artificial Sequence
  sgRNA
aaagccagccttctagatat

SEQ ID NO: 1734 - DNA, 20 bp, Artificial Sequence
  sgRNA
ttgggtaggcgcgcgctggt

SEQ ID NO: 1735 - DNA, 20 bp, Artificial Sequence
  sgRNA
accacgtggtttcgccagct

SEQ ID NO: 1736 - DNA, 20 bp, Artificial Sequence
  sgRNA
aattaatcaatggaacactc

SEQ ID NO: 1737 - DNA, 20 bp, Artificial Sequence
  sgRNA
ccaagcggaccctattctgg

SEQ ID NO: 1738 - DNA, 20 bp, Artificial Sequence
  sgRNA
gttgcacgagatccgatccg

SEQ ID NO: 1739 - DNA, 20 bp, Artificial Sequence
  sgRNA
ttctactctggttgcattcc

SEQ ID NO: 1740 - DNA, 20 bp, Artificial Sequence
  sgRNA
gtggccacgcctctcctcag

SEQ ID NO: 1741 - DNA, 20 bp, Artificial Sequence
  sgRNA
acaaaccgctgtcaagtgaa

SEQ ID NO: 1742 - DNA, 20 bp, Artificial Sequence
  sgRNA
ttagcatgtgagcgcgaccc

SEQ ID NO: 1743 - DNA, 20 bp, Artificial Sequence
  sgRNA
ctgatggtttggcttctgat

SEQ ID NO: 1744 - DNA, 20 bp, Artificial Sequence
  sgRNA
aataccagatgcagtcacta

SEQ ID NO: 1745 - DNA, 20 bp, Artificial Sequence
  sgRNA
gcaggcggtgggtgtagcaa

SEQ ID NO: 1746 - DNA, 20 bp, Artificial Sequence
  sgRNA
cttgcgggtagcagatgctt

SEQ ID NO: 1747 - DNA, 20 bp, Artificial Sequence
  sgRNA
agccggcccagagctctgag

SEQ ID NO: 1748 - DNA, 20 bp, Artificial Sequence
  sgRNA
gccgaccagccgctacgaag

SEQ ID NO: 1749 - DNA, 20 bp, Artificial Sequence
  sgRNA
ccgcccatctcacctgtgat

SEQ ID NO: 1750 - DNA, 20 bp, Artificial Sequence
  sgRNA
tttggatgtgggctggcagc

SEQ ID NO: 1751 - DNA, 20 bp, Artificial Sequence
  sgRNA
gtggaaagttgctttcgttg

SEQ ID NO: 1752 - DNA, 20 bp, Artificial Sequence
  sgRNA
cacgccctgatcacccgcaa

SEQ ID NO: 1753 - DNA, 20 bp, Artificial Sequence
  sgRNA
tagactcgtcaccttcctga

SEQ ID NO: 1754 - DNA, 20 bp, Artificial Sequence
  sgRNA
gaaggaagcgtacaattggc

SEQ ID NO: 1755 - DNA, 20 bp, Artificial Sequence
  sgRNA
cagctgatgtgagctccttc

SEQ ID NO: 1756 - DNA, 20 bp, Artificial Sequence
  sgRNA
gtcagagaccagagcagtgg

SEQ ID NO: 1757 - DNA, 20 bp, Artificial Sequence
  sgRNA
tctgtcctgccctcacatgt

SEQ ID NO: 1758 - DNA, 20 bp, Artificial Sequence
  sgRNA
ctgtgcaactgtagagttgg

SEQ ID NO: 1759 - DNA, 20 bp, Artificial Sequence
  sgRNA
ggattcttaacatttctggt

SEQ ID NO: 1760 - DNA, 20 bp, Artificial Sequence
  sgRNA
agtttctgagtttgggatcg

SEQ ID NO: 1761 - DNA, 20 bp, Artificial Sequence
  sgRNA
cctcgcgcgcatgcgtgaca

SEQ ID NO: 1762 - DNA, 20 bp, Artificial Sequence
  sgRNA
atggtacagatcatagctca

SEQ ID NO: 1763 - DNA, 20 bp, Artificial Sequence
  sgRNA
atgacacacatgaaccgaga

SEQ ID NO: 1764 - DNA, 20 bp, Artificial Sequence
  sgRNA
ccaggagctgcctgtctaaa

SEQ ID NO: 1765 - DNA, 20 bp, Artificial Sequence
  sgRNA
gcacttgtgatgtcgaacgt

SEQ ID NO: 1766 - DNA, 20 bp, Artificial Sequence
  sgRNA
acgtgacgaggccgccttag

SEQ ID NO: 1767 - DNA, 20 bp, Artificial Sequence
  sgRNA
ttcttcttgcggtgtcccgg

SEQ ID NO: 1768 - DNA, 20 bp, Artificial Sequence
  sgRNA
atcaacgctccgaatgaccc

SEQ ID NO: 1769 - DNA, 20 bp, Artificial Sequence
  sgRNA
ctttaagctaaagaagaagt

SEQ ID NO: 1770 - DNA, 20 bp, Artificial Sequence
  sgRNA
aatatttccatccacatgcc

SEQ ID NO: 1771 - DNA, 20 bp, Artificial Sequence
  sgRNA
ccagaactaccatgagcaag

SEQ ID NO: 1772 - DNA, 20 bp, Artificial Sequence
  sgRNA
gggctaactgcatgctaatg

SEQ ID NO: 1773 - DNA, 20 bp, Artificial Sequence
  sgRNA
gcttgcagttcacgtcatca

SEQ ID NO: 1774 - DNA, 20 bp, Artificial Sequence
  sgRNA
gacaaagatctgaacgttat

SEQ ID NO: 1775 - DNA, 20 bp, Artificial Sequence
  sgRNA
tttcctttcccactgcgcgg

SEQ ID NO: 1776 - DNA, 20 bp, Artificial Sequence
  sgRNA
tttcctttccctggttagga

SEQ ID NO: 1777 - DNA, 20 bp, Artificial Sequence
  sgRNA
tccctcctactcacggcgcg

SEQ ID NO: 1778 - DNA, 20 bp, Artificial Sequence
  sgRNA
ggctcactagcacagactgg

SEQ ID NO: 1779 - DNA, 20 bp, Artificial Sequence
  sgRNA
gccatgacgctcatcctccg

SEQ ID NO: 1780 - DNA, 20 bp, Artificial Sequence
  sgRNA
ttccggctcctggcgtacta

SEQ ID NO: 1781 - DNA, 20 bp, Artificial Sequence
  sgRNA
gcgacagtagtggagggacg

SEQ ID NO: 1782 - DNA, 20 bp, Artificial Sequence
  sgRNA
gggaggaagctctatcaagt

SEQ ID NO: 1783 - DNA, 20 bp, Artificial Sequence
  sgRNA
aacgccactagtgagatgca

SEQ ID NO: 1784 - DNA, 20 bp, Artificial Sequence
  sgRNA
caccggcgcttcacccgctg

SEQ ID NO: 1785 - DNA, 20 bp, Artificial Sequence
  sgRNA
ccttgtctctcgcggctgag

SEQ ID NO: 1786 - DNA, 20 bp, Artificial Sequence
  sgRNA
tacgtcagcgtgctgctttc

SEQ ID NO: 1787 - DNA, 20 bp, Artificial Sequence
  sgRNA
gcacatacttatatcctgaa

SEQ ID NO: 1788 - DNA, 20 bp, Artificial Sequence
  sgRNA
gtttggaaggatcactggta

SEQ ID NO: 1789 - DNA, 20 bp, Artificial Sequence
  sgRNA
gatgggagaggacccgactc

SEQ ID NO: 1790 - DNA, 20 bp, Artificial Sequence
  sgRNA
agttgcacaagacatctaca

SEQ ID NO: 1791 - DNA, 20 bp, Artificial Sequence
  sgRNA
tccagggctccctcagctgc

SEQ ID NO: 1792 - DNA, 20 bp, Artificial Sequence
  sgRNA
gatcgcagctgcaagcttgg

SEQ ID NO: 1793 - DNA, 20 bp, Artificial Sequence
  sgRNA
cagatactacatcatcagtc

SEQ ID NO: 1794 - DNA, 20 bp, Artificial Sequence
  sgRNA
gaatgctcaagcattccttt

SEQ ID NO: 1795 - DNA, 20 bp, Artificial Sequence
  sgRNA
atggcgccggaaattggagt

SEQ ID NO: 1796 - DNA, 20 bp, Artificial Sequence
  sgRNA
ttcaagcaatcgactgacgt

SEQ ID NO: 1797 - DNA, 20 bp, Artificial Sequence
  sgRNA
cgcagaacaatgcaagcttg

SEQ ID NO: 1798 - DNA, 20 bp, Artificial Sequence
  sgRNA
attcgcttccaacagtcaac

SEQ ID NO: 1799 - DNA, 20 bp, Artificial Sequence
  sgRNA
tgtgctgtttctgtgtctgt

SEQ ID NO: 1800 - DNA, 20 bp, Artificial Sequence
  sgRNA
acacagtagcattggcttcc

SEQ ID NO: 1801 - DNA, 20 bp, Artificial Sequence
  sgRNA
acgcgaaaccggataaggac

SEQ ID NO: 1802 - DNA, 20 bp, Artificial Sequence
  sgRNA
tctgacatgtttatggcttc

SEQ ID NO: 1803 - DNA, 20 bp, Artificial Sequence
  sgRNA
agctccacctgcagctcgag

SEQ ID NO: 1804 - DNA, 20 bp, Artificial Sequence
  sgRNA
cggttaccttcccaggtctg

SEQ ID NO: 1805 - DNA, 20 bp, Artificial Sequence
  sgRNA
ggtctgttctcggcgttgag

SEQ ID NO: 1806 - DNA, 20 bp, Artificial Sequence
  sgRNA
tccttcagatcaaccataaa

SEQ ID NO: 1807 - DNA, 20 bp, Artificial Sequence
  sgRNA
acgtccgggccctcagcctt

SEQ ID NO: 1808 - DNA, 20 bp, Artificial Sequence
  sgRNA
agagccgagagagatgcttg

SEQ ID NO: 1809 - DNA, 20 bp, Artificial Sequence
  sgRNA
ggtccgaactgggcgggacc

SEQ ID NO: 1810 - DNA, 20 bp, Artificial Sequence
  sgRNA
cagcaaagcgcccagtctct

SEQ ID NO: 1811 - DNA, 20 bp, Artificial Sequence
  sgRNA
cttcaattctctaggtttgc

SEQ ID NO: 1812 - DNA, 20 bp, Artificial Sequence
  sgRNA
ggcgaatccttggctgtgca

SEQ ID NO: 1813 - DNA, 20 bp, Artificial Sequence
  sgRNA
cccgttgtgacctcagcagc

SEQ ID NO: 1814 - DNA, 20 bp, Artificial Sequence
  sgRNA
cagagtctgtagaacaaagg

SEQ ID NO: 1815 - DNA, 20 bp, Artificial Sequence
  sgRNA
gaggagctcgggcagaaccg

SEQ ID NO: 1816 - DNA, 20 bp, Artificial Sequence
  sgRNA
cccgtgtttggctctgggac

SEQ ID NO: 1817 - DNA, 20 bp, Artificial Sequence
  sgRNA
ataaatatcaggaagtcttg

SEQ ID NO: 1818 - DNA, 20 bp, Artificial Sequence
  sgRNA
agtgtggctgatgtgctcac

SEQ ID NO: 1819 - DNA, 20 bp, Artificial Sequence
  sgRNA
ggcccgagtggacctagccc

SEQ ID NO: 1820 - DNA, 20 bp, Artificial Sequence
  sgRNA
ccagctactttcagagcctt

SEQ ID NO: 1821 - DNA, 20 bp, Artificial Sequence
  sgRNA
cttaatccttctgggaattc

SEQ ID NO: 1822 - DNA, 20 bp, Artificial Sequence
  sgRNA
atgccttagtgtatggtgag

SEQ ID NO: 1823 - DNA, 20 bp, Artificial Sequence
  sgRNA
gggcggaagaaacttccaat

SEQ ID NO: 1824 - DNA, 20 bp, Artificial Sequence
  sgRNA
gagtgacgaaggtagtggcg

SEQ ID NO: 1825 - DNA, 20 bp, Artificial Sequence
  sgRNA
ctctctggtcctcagcttgg

SEQ ID NO: 1826 - DNA, 20 bp, Artificial Sequence
  sgRNA
gcaagcccagctttgagagc

SEQ ID NO: 1827 - DNA, 20 bp, Artificial Sequence
  sgRNA
tacatttcccagaagcgcgg

SEQ ID NO: 1828 - DNA, 20 bp, Artificial Sequence
  sgRNA
gggctgctcaggttgctaag

SEQ ID NO: 1829 - DNA, 20 bp, Artificial Sequence
  sgRNA
cgcttagccacacccaccca

SEQ ID NO: 1830 - DNA, 20 bp, Artificial Sequence
  sgRNA
gcgcctcaacagacgatgac

SEQ ID NO: 1831 - DNA, 20 bp, Artificial Sequence
  sgRNA
ttgcccgaccaactacatcc

SEQ ID NO: 1832 - DNA, 20 bp, Artificial Sequence
  sgRNA
gcctgggcccagttaggaaa

SEQ ID NO: 1833 - DNA, 20 bp, Artificial Sequence
  sgRNA
gcgctaaggattctggacgc

SEQ ID NO: 1834 - DNA, 20 bp, Artificial Sequence
  sgRNA
tccgtgcataactgcagagc

SEQ ID NO: 1835 - DNA, 20 bp, Artificial Sequence
  sgRNA
ccacctccagccctgggcgg

SEQ ID NO: 1836 - DNA, 20 bp, Artificial Sequence
  sgRNA
caggtaaacaggtcactcaa

SEQ ID NO: 1837 - DNA, 20 bp, Artificial Sequence
  sgRNA
tcggagaatggaatcttctt

SEQ ID NO: 1838 - DNA, 20 bp, Artificial Sequence
  sgRNA
agcgcaatggccagagcccg

SEQ ID NO: 1839 - DNA, 20 bp, Artificial Sequence
  sgRNA
aataaggaccaattcatgct

SEQ ID NO: 1840 - DNA, 20 bp, Artificial Sequence
  sgRNA
cacagtctctgagcattcat

SEQ ID NO: 1841 - DNA, 20 bp, Artificial Sequence
  sgRNA
cctgcagcataaacatttcc

SEQ ID NO: 1842 - DNA, 20 bp, Artificial Sequence
  sgRNA
tttcagttcatcaactgcat

SEQ ID NO: 1843 - DNA, 20 bp, Artificial Sequence
  sgRNA
gcgctacggcaagccggagg

SEQ ID NO: 1844 - DNA, 20 bp, Artificial Sequence
  sgRNA
agccagagagggagcggcgg

SEQ ID NO: 1845 - DNA, 20 bp, Artificial Sequence
  sgRNA
gaagaaggcgctagaaccgg

SEQ ID NO: 1846 - DNA, 20 bp, Artificial Sequence
  sgRNA
cccaggctgaggaggcgaaa

SEQ ID NO: 1847 - DNA, 20 bp, Artificial Sequence
  sgRNA
atatcctcattatgtaatcc

SEQ ID NO: 1848 - DNA, 20 bp, Artificial Sequence
  sgRNA
aaccacagtagaatgtcctc

SEQ ID NO: 1849 - DNA, 20 bp, Artificial Sequence
  sgRNA
gctgtccaatcatagccaag

SEQ ID NO: 1850 - DNA, 20 bp, Artificial Sequence
  sgRNA
ggcacttccctgcttatcag

SEQ ID NO: 1851 - DNA, 20 bp, Artificial Sequence
  sgRNA
aagatggagcccttaaagaa

SEQ ID NO: 1852 - DNA, 20 bp, Artificial Sequence
  sgRNA
aggtagagtagaacgtgggt

SEQ ID NO: 1853 - DNA, 20 bp, Artificial Sequence
  sgRNA
aggcggagcaggaggcgagt

SEQ ID NO: 1854 - DNA, 20 bp, Artificial Sequence
  sgRNA
taggagctttgcggcccggt

SEQ ID NO: 1855 - DNA, 20 bp, Artificial Sequence
  sgRNA
gcagttgtgcaggtctcacg

SEQ ID NO: 1856 - DNA, 20 bp, Artificial Sequence
  sgRNA
tgcaaactggccaggaggcg

SEQ ID NO: 1857 - DNA, 20 bp, Artificial Sequence
  sgRNA
gcgcgtggtgggagctccct

SEQ ID NO: 1858 - DNA, 20 bp, Artificial Sequence
  sgRNA
aagtccctcgcgccctctgg

SEQ ID NO: 1859 - DNA, 20 bp, Artificial Sequence
  sgRNA
tcagtggtaccgttcaagcg

SEQ ID NO: 1860 - DNA, 20 bp, Artificial Sequence
  sgRNA
atgtccagcactttaactct

SEQ ID NO: 1861 - DNA, 20 bp, Artificial Sequence
  sgRNA
gtgcatgtttgccaggctgc

SEQ ID NO: 1862 - DNA, 20 bp, Artificial Sequence
  sgRNA
gggtgagcgagtggaaggcg

SEQ ID NO: 1863 - DNA, 20 bp, Artificial Sequence
  sgRNA
acgaagtcgcacacccacag

SEQ ID NO: 1864 - DNA, 20 bp, Artificial Sequence
  sgRNA
ctatatttaagacggttaca

SEQ ID NO: 1865 - DNA, 20 bp, Artificial Sequence
  sgRNA
acataccgctcatgcctcac

SEQ ID NO: 1866 - DNA, 20 bp, Artificial Sequence
  sgRNA
tcgtcagctctggtaggtag

SEQ ID NO: 1867 - DNA, 20 bp, Artificial Sequence
  sgRNA
gcatggcaaccgctctctga

SEQ ID NO: 1868 - DNA, 20 bp, Artificial Sequence
  sgRNA
acttagagcgctatgtgccc

SEQ ID NO: 1869 - DNA, 20 bp, Artificial Sequence
  sgRNA
gcgcagcgcgaggcgcctcg

SEQ ID NO: 1870 - DNA, 20 bp, Artificial Sequence
  sgRNA
gggcggacagggcgtgcgtg

SEQ ID NO: 1871 - DNA, 20 bp, Artificial Sequence
  sgRNA
ggatgctctgaggacggctc

SEQ ID NO: 1872 - DNA, 20 bp, Artificial Sequence
  sgRNA
ccggtcctgggcgttcacag

SEQ ID NO: 1873 - DNA, 20 bp, Artificial Sequence
  sgRNA
ctgagggtgcgccacaaatc

SEQ ID NO: 1874 - DNA, 20 bp, Artificial Sequence
  sgRNA
cgggcggcggccgtgcggtg

SEQ ID NO: 1875 - DNA, 20 bp, Artificial Sequence
  sgRNA
actaaagaactaccaaccaa

SEQ ID NO: 1876 - DNA, 20 bp, Artificial Sequence
  sgRNA
acaaagcgatgctaagcatc

SEQ ID NO: 1877 - DNA, 20 bp, Artificial Sequence
  sgRNA
gaatctggcagctctttaag

SEQ ID NO: 1878 - DNA, 20 bp, Artificial Sequence
  sgRNA
ctataagagtcggccgctgc

SEQ ID NO: 1879 - DNA, 20 bp, Artificial Sequence
  sgRNA
tggtggcaacccgcactgct

SEQ ID NO: 1880 - DNA, 20 bp, Artificial Sequence
  sgRNA
ctttatattcagggtctccc

SEQ ID NO: 1881 - DNA, 20 bp, Artificial Sequence
  sgRNA
ggctagcttacctcacaaag

SEQ ID NO: 1882 - DNA, 20 bp, Artificial Sequence
  sgRNA
gtgaagtgcctccagaccaa

SEQ ID NO: 1883 - DNA, 20 bp, Artificial Sequence
  sgRNA
gggagctgcgcggttgtgct

SEQ ID NO: 1884 - DNA, 20 bp, Artificial Sequence
  sgRNA
aaatgcgccaagtagccaga

SEQ ID NO: 1885 - DNA, 20 bp, Artificial Sequence
  sgRNA
agagcggaagttatggcgcg

SEQ ID NO: 1886 - DNA, 20 bp, Artificial Sequence
  sgRNA
cttaactgctcatgcgcgcg

SEQ ID NO: 1887 - DNA, 20 bp, Artificial Sequence
  sgRNA
tggcctgaccttcgtgtagc

SEQ ID NO: 1888 - DNA, 20 bp, Artificial Sequence
  sgRNA
tccgtcatatcccgtcctcg

SEQ ID NO: 1889 - DNA, 20 bp, Artificial Sequence
  sgRNA
tgagcccagtgaagtgggcg

SEQ ID NO: 1890 - DNA, 20 bp, Artificial Sequence
  sgRNA
agcggcgtcttccagtgccg

SEQ ID NO: 1891 - DNA, 20 bp, Artificial Sequence
  sgRNA
gggatgccggcgggctggct

SEQ ID NO: 1892 - DNA, 20 bp, Artificial Sequence
  sgRNA
ccggacaaggatgctgcagc

SEQ ID NO: 1893 - DNA, 20 bp, Artificial Sequence
  sgRNA
ccagacacattgatgtaggg

SEQ ID NO: 1894 - DNA, 20 bp, Artificial Sequence
  sgRNA
ttgaacaggatcgtccaagg

SEQ ID NO: 1895 - DNA, 20 bp, Artificial Sequence
  sgRNA
cgccgcggcgcgtcactgcc

SEQ ID NO: 1896 - DNA, 20 bp, Artificial Sequence
  sgRNA
agccctcagctggcggcgtg

SEQ ID NO: 1897 - DNA, 20 bp, Artificial Sequence
  sgRNA
cgggtctgcgcaccgcacgg

SEQ ID NO: 1898 - DNA, 20 bp, Artificial Sequence
  sgRNA
tgatctctctgtgctttcta

SEQ ID NO: 1899 - DNA, 20 bp, Artificial Sequence
  sgRNA
tcatttaaagggataggctc

SEQ ID NO: 1900 - DNA, 20 bp, Artificial Sequence
  sgRNA
ctcctttctggccgttacca

SEQ ID NO: 1901 - DNA, 20 bp, Artificial Sequence
  sgRNA
gacagtttgatatgagctcc

SEQ ID NO: 1902 - DNA, 20 bp, Artificial Sequence
  sgRNA
cccatgagcccagtgactcc

SEQ ID NO: 1903 - DNA, 20 bp, Artificial Sequence
  sgRNA
gggagagtcagacgctggag

SEQ ID NO: 1904 - DNA, 20 bp, Artificial Sequence
  sgRNA
ctggatcgccggccgaagaa

SEQ ID NO: 1905 - DNA, 20 bp, Artificial Sequence
  sgRNA
agacgtgctctgaagactac

SEQ ID NO: 1906 - DNA, 20 bp, Artificial Sequence
  sgRNA
cacgtgaccgtcgcctcacg

SEQ ID NO: 1907 - DNA, 20 bp, Artificial Sequence
  sgRNA
gacgaagccagagtcccggg

SEQ ID NO: 1908 - DNA, 20 bp, Artificial Sequence
  sgRNA
aaccgattagctgtttaatc

SEQ ID NO: 1909 - DNA, 20 bp, Artificial Sequence
  sgRNA
cgcgcgcggaacatggctga

SEQ ID NO: 1910 - DNA, 20 bp, Artificial Sequence
  sgRNA
tcaggctacaggctgggcct

SEQ ID NO: 1911 - DNA, 20 bp, Artificial Sequence
  sgRNA
acgcctagacaccgacttaa

SEQ ID NO: 1912 - DNA, 20 bp, Artificial Sequence
  sgRNA
tgatggcctagttactgcca

SEQ ID NO: 1913 - DNA, 20 bp, Artificial Sequence
  sgRNA
gactcactgtagggttggta

SEQ ID NO: 1914 - DNA, 20 bp, Artificial Sequence
  sgRNA
acgaagtgatctgtaataaa

SEQ ID NO: 1915 - DNA, 20 bp, Artificial Sequence
  sgRNA
gaggttgccaagaactctct

SEQ ID NO: 1916 - DNA, 20 bp, Artificial Sequence
  sgRNA
taggaaactgaagctcgggc

SEQ ID NO: 1917 - DNA, 20 bp, Artificial Sequence
  sgRNA
aaatgacaccagggcaacgt

SEQ ID NO: 1918 - DNA, 20 bp, Artificial Sequence
  sgRNA
gatgcttccagggcagcccg

SEQ ID NO: 1919 - DNA, 20 bp, Artificial Sequence
  sgRNA
aatgttcttcggtccaatag

SEQ ID NO: 1920 - DNA, 20 bp, Artificial Sequence
  sgRNA
agaactaagtgctaatggaa

SEQ ID NO: 1921 - DNA, 20 bp, Artificial Sequence
  sgRNA
ctggtcgttggtggactttg

SEQ ID NO: 1922 - DNA, 20 bp, Artificial Sequence
  sgRNA
cgagcacgacaagagcgcct

SEQ ID NO: 1923 - DNA, 20 bp, Artificial Sequence
  sgRNA
tagcgcctctgagcggagcg

SEQ ID NO: 1924 - DNA, 20 bp, Artificial Sequence
  sgRNA
actgccctcgcataccttta

SEQ ID NO: 1925 - DNA, 20 bp, Artificial Sequence
  sgRNA
gcatctccaccttgggaggt

SEQ ID NO: 1926 - DNA, 20 bp, Artificial Sequence
  sgRNA
gcgcccgtcgtctaggcgag

SEQ ID NO: 1927 - DNA, 20 bp, Artificial Sequence
  sgRNA
aagactggctgagtcaatcc

SEQ ID NO: 1928 - DNA, 20 bp, Artificial Sequence
  sgRNA
ggcccaggagcgcctctgat

SEQ ID NO: 1929 - DNA, 20 bp, Artificial Sequence
  sgRNA
caaccaatggctggccgcct

SEQ ID NO: 1930 - DNA, 20 bp, Artificial Sequence
  sgRNA
cagggcgaggaagctcggga

SEQ ID NO: 1931 - DNA, 20 bp, Artificial Sequence
  sgRNA
accatcgggccaggcctcgg

SEQ ID NO: 1932 - DNA, 20 bp, Artificial Sequence
  sgRNA
ccgcccggagaccgccatga

SEQ ID NO: 1933 - DNA, 20 bp, Artificial Sequence
  sgRNA
tcagaagcgcagaaacttca

SEQ ID NO: 1934 - DNA, 20 bp, Artificial Sequence
  sgRNA
agctctgtctttcaggagct

SEQ ID NO: 1935 - DNA, 20 bp, Artificial Sequence
  sgRNA
ttctcgggcacacaggaggc

SEQ ID NO: 1936 - DNA, 20 bp, Artificial Sequence
  sgRNA
gttcccacctacactgttag

SEQ ID NO: 1937 - DNA, 20 bp, Artificial Sequence
  sgRNA
cccaatttggaacgaagagg

SEQ ID NO: 1938 - DNA, 20 bp, Artificial Sequence
  sgRNA
ctcggatcttggttcccttg

SEQ ID NO: 1939 - DNA, 20 bp, Artificial Sequence
  sgRNA
aggagtgcgctgagacgaag

SEQ ID NO: 1940 - DNA, 20 bp, Artificial Sequence
  sgRNA
ccagccgaagccctgcaagc

SEQ ID NO: 1941 - DNA, 20 bp, Artificial Sequence
  sgRNA
ctgacagatggtcccataaa

SEQ ID NO: 1942 - DNA, 20 bp, Artificial Sequence
  sgRNA
atccagggaggcgtgtccag

SEQ ID NO: 1943 - DNA, 20 bp, Artificial Sequence
  sgRNA
gcatctggctgcagtgagag

SEQ ID NO: 1944 - DNA, 20 bp, Artificial Sequence
  sgRNA
gtaatccatcctgagatttg

SEQ ID NO: 1945 - DNA, 20 bp, Artificial Sequence
  sgRNA
ctgctcacagcaggtagaac

SEQ ID NO: 1946 - DNA, 20 bp, Artificial Sequence
  sgRNA
caccggctctagcagcacgc

SEQ ID NO: 1947 - DNA, 20 bp, Artificial Sequence
  sgRNA
gtgtctgcctgtcctctccg

SEQ ID NO: 1948 - DNA, 20 bp, Artificial Sequence
  sgRNA
acacaatgagttccacattg

SEQ ID NO: 1949 - DNA, 20 bp, Artificial Sequence
  sgRNA
attggcctacagcgtgccgg

SEQ ID NO: 1950 - DNA, 20 bp, Artificial Sequence
  sgRNA
aagagttcttaatactccag

SEQ ID NO: 1951 - DNA, 20 bp, Artificial Sequence
  sgRNA
ctgagctcgtgggacagcct

SEQ ID NO: 1952 - DNA, 20 bp, Artificial Sequence
  sgRNA
ttctataccagctgttgctc

SEQ ID NO: 1953 - DNA, 20 bp, Artificial Sequence
  sgRNA
gtcattcaggatgaaggaac

SEQ ID NO: 1954 - DNA, 20 bp, Artificial Sequence
  sgRNA
acaggagggtaagattcgtg

SEQ ID NO: 1955 - DNA, 20 bp, Artificial Sequence
  sgRNA
acatgcacttcccgccaatt

SEQ ID NO: 1956 - DNA, 20 bp, Artificial Sequence
  sgRNA
acgccgccaccgaggcgcag

SEQ ID NO: 1957 - DNA, 20 bp, Artificial Sequence
  sgRNA
atgggttctttcgtgacgtc

SEQ ID NO: 1958 - DNA, 20 bp, Artificial Sequence
  sgRNA
agtgggcgcgctaagagatg

SEQ ID NO: 1959 - DNA, 20 bp, Artificial Sequence
  sgRNA
tgagtcagggtcaaacagca

SEQ ID NO: 1960 - DNA, 20 bp, Artificial Sequence
  sgRNA
attcccaatgcctatgtaaa

SEQ ID NO: 1961 - DNA, 20 bp, Artificial Sequence
  sgRNA
aatcgaacatgcactgttat

SEQ ID NO: 1962 - DNA, 20 bp, Artificial Sequence
  sgRNA
ttcttcctgaaggcagagac

SEQ ID NO: 1963 - DNA, 20 bp, Artificial Sequence
  sgRNA
tcaccgcgggaatcccaggg

SEQ ID NO: 1964 - DNA, 20 bp, Artificial Sequence
  sgRNA
cacctgcgcagtacgctgcg

SEQ ID NO: 1965 - DNA, 20 bp, Artificial Sequence
  sgRNA
tgccaagtgggcagttctcc

SEQ ID NO: 1966 - DNA, 20 bp, Artificial Sequence
  sgRNA
cgcacgagggttgggcacgt

SEQ ID NO: 1967 - DNA, 20 bp, Artificial Sequence
  sgRNA
agttaaagttgctgaaacca

SEQ ID NO: 1968 - DNA, 20 bp, Artificial Sequence
  sgRNA
aagtaagaaggtaaacacct

SEQ ID NO: 1969 - DNA, 20 bp, Artificial Sequence
  sgRNA
ggctcgtcgccgggaagggc

SEQ ID NO: 1970 - DNA, 20 bp, Artificial Sequence
  sgRNA
agaattggctaataggccac

SEQ ID NO: 1971 - DNA, 20 bp, Artificial Sequence
  sgRNA
atctcgcagatgcagacgac

SEQ ID NO: 1972 - DNA, 20 bp, Artificial Sequence
  sgRNA
cctggccatatgagaagtcc

SEQ ID NO: 1973 - DNA, 20 bp, Artificial Sequence
  sgRNA
ttgaaagggaagctggcgag

SEQ ID NO: 1974 - DNA, 20 bp, Artificial Sequence
  sgRNA
ggctttgcactgatgctagg

SEQ ID NO: 1975 - DNA, 20 bp, Artificial Sequence
  sgRNA
gaatcatgataaacctacca

SEQ ID NO: 1976 - DNA, 20 bp, Artificial Sequence
  sgRNA
ctgggctccactcacgaacc

SEQ ID NO: 1977 - DNA, 20 bp, Artificial Sequence
  sgRNA
gaggaactaggtaggcgagg

SEQ ID NO: 1978 - DNA, 20 bp, Artificial Sequence
  sgRNA
accgtgaacaccactgtgcg

SEQ ID NO: 1979 - DNA, 20 bp, Artificial Sequence
  sgRNA
cgtgggcgagccgacagcgg

SEQ ID NO: 1980 - DNA, 20 bp, Artificial Sequence
  sgRNA
ttcacttggaagtcccttta

SEQ ID NO: 1981 - DNA, 20 bp, Artificial Sequence
  sgRNA
ccgtagccgccgtgcccttt

SEQ ID NO: 1982 - DNA, 20 bp, Artificial Sequence
  sgRNA
aactgcgggtgtagctgcca

SEQ ID NO: 1983 - DNA, 20 bp, Artificial Sequence
  sgRNA
tctttaagcaagaggaggcg

SEQ ID NO: 1984 - DNA, 20 bp, Artificial Sequence
  sgRNA
ccaccggctacccttccggc

SEQ ID NO: 1985 - DNA, 20 bp, Artificial Sequence
  sgRNA
ctacttatcagttctcaatc

SEQ ID NO: 1986 - DNA, 20 bp, Artificial Sequence
  sgRNA
ctgtgaggatttcacaccca

SEQ ID NO: 1987 - DNA, 20 bp, Artificial Sequence
  sgRNA
ttagaccctcttcatctgat

SEQ ID NO: 1988 - DNA, 20 bp, Artificial Sequence
  sgRNA
aactaagagatctctaatct

SEQ ID NO: 1989 - DNA, 20 bp, Artificial Sequence
  sgRNA
accgatccgtctctaggcag

SEQ ID NO: 1990 - DNA, 20 bp, Artificial Sequence
  sgRNA
atcgcctaggactaagggat

SEQ ID NO: 1991 - DNA, 20 bp, Artificial Sequence
  sgRNA
cttcatggagattgttgcta

SEQ ID NO: 1992 - DNA, 20 bp, Artificial Sequence
  sgRNA
tgggtggagcccaaccacag

SEQ ID NO: 1993 - DNA, 20 bp, Artificial Sequence
  sgRNA
tagcaggcgtcaggcaatcc

SEQ ID NO: 1994 - DNA, 20 bp, Artificial Sequence
  sgRNA
cctgatgtcatggagtcctg

SEQ ID NO: 1995 - DNA, 20 bp, Artificial Sequence
  sgRNA
ttgaatttgacgggaagtgt

SEQ ID NO: 1996 - DNA, 20 bp, Artificial Sequence
  sgRNA
tccactgcggacgaatcccg

SEQ ID NO: 1997 - DNA, 20 bp, Artificial Sequence
  sgRNA
agtggactacaagtcccgtg

SEQ ID NO: 1998 - DNA, 20 bp, Artificial Sequence
  sgRNA
tcaatgcacttcctgtagcc

SEQ ID NO: 1999 - DNA, 20 bp, Artificial Sequence
  sgRNA
cagacctctaggctccactg

SEQ ID NO: 2000 - DNA, 20 bp, Artificial Sequence
  sgRNA
gggcagatgtatcagagtgc

SEQ ID NO: 2001 - DNA, 20 bp, Artificial Sequence
  sgRNA
gttagccaatggcacggcgg

SEQ ID NO: 2002 - DNA, 20 bp, Artificial Sequence
  sgRNA
gactggctagagagcgactc

SEQ ID NO: 2003 - DNA, 20 bp, Artificial Sequence
  sgRNA
ctgtgcaaagctgaggttcc

SEQ ID NO: 2004 - DNA, 20 bp, Artificial Sequence
  sgRNA
cctcaggccgcgctccctga

SEQ ID NO: 2005 - DNA, 20 bp, Artificial Sequence
  sgRNA
agtagcttgctgcatttctc

SEQ ID NO: 2006 - DNA, 20 bp, Artificial Sequence
  sgRNA
gtgtgtgttggttagtgact

SEQ ID NO: 2007 - DNA, 20 bp, Artificial Sequence
  sgRNA
cttatcaacacatctacctc

SEQ ID NO: 2008 - DNA, 20 bp, Artificial Sequence
  sgRNA
ctaaattggttgcattcaaa

SEQ ID NO: 2009 - DNA, 20 bp, Artificial Sequence
  sgRNA
tgggaggaactaaagttgac

SEQ ID NO: 2010 - DNA, 20 bp, Artificial Sequence
  sgRNA
acttaagttctatgtgattc

SEQ ID NO: 2011 - DNA, 20 bp, Artificial Sequence
  sgRNA
caagtaaatcagcttagcac

SEQ ID NO: 2012 - DNA, 20 bp, Artificial Sequence
  sgRNA
gcgacgtccctccgaccgat

SEQ ID NO: 2013 - DNA, 20 bp, Artificial Sequence
  sgRNA
ctggagagcactcagaccgc

SEQ ID NO: 2014 - DNA, 20 bp, Artificial Sequence
  sgRNA
gccgcggaccgtgagacgcg

SEQ ID NO: 2015 - DNA, 20 bp, Artificial Sequence
  sgRNA
ccgcctctgggctgactgca

SEQ ID NO: 2016 - DNA, 20 bp, Artificial Sequence
  sgRNA
aaacagtgtaggtggagctg

SEQ ID NO: 2017 - DNA, 20 bp, Artificial Sequence
  sgRNA
ctgctgtgcacacctggacc

SEQ ID NO: 2018 - DNA, 20 bp, Artificial Sequence
  sgRNA
gttgcaggaacacggctcac

SEQ ID NO: 2019 - DNA, 20 bp, Artificial Sequence
  sgRNA
ctctgcgcgggatgacgccc

SEQ ID NO: 2020 - DNA, 20 bp, Artificial Sequence
  sgRNA
aacgagccggagctagtggt

SEQ ID NO: 2021 - DNA, 20 bp, Artificial Sequence
  sgRNA
catttacatcacaattgggc

SEQ ID NO: 2022 - DNA, 20 bp, Artificial Sequence
  sgRNA
agagcgcggcgagcagcgag

SEQ ID NO: 2023 - DNA, 20 bp, Artificial Sequence
  sgRNA
aaccggagcaggcaggactg

SEQ ID NO: 2024 - DNA, 20 bp, Artificial Sequence
  sgRNA
tgagatgcgtggagggatgg

SEQ ID NO: 2025 - DNA, 20 bp, Artificial Sequence
  sgRNA
tttcagtcctaccagagcca

SEQ ID NO: 2026 - DNA, 20 bp, Artificial Sequence
  sgRNA
aagttagttagtgacagtgt

SEQ ID NO: 2027 - DNA, 20 bp, Artificial Sequence
  sgRNA
ctctgcctactgtgcagccc

SEQ ID NO: 2028 - DNA, 20 bp, Artificial Sequence
  sgRNA
tgaggatgaccaacacagca

SEQ ID NO: 2029 - DNA, 20 bp, Artificial Sequence
  sgRNA
agacggacttaagcgacagc

SEQ ID NO: 2030 - DNA, 20 bp, Artificial Sequence
  sgRNA
tttaatgttgggtggtgatg

SEQ ID NO: 2031 - DNA, 20 bp, Artificial Sequence
  sgRNA
aaactatatgccgccaaatt

SEQ ID NO: 2032 - DNA, 20 bp, Artificial Sequence
  sgRNA
gctggatagggcgtgtctcc

SEQ ID NO: 2033 - DNA, 20 bp, Artificial Sequence
  sgRNA
tctgctcacgctacatggtg

SEQ ID NO: 2034 - DNA, 20 bp, Artificial Sequence
  sgRNA
atatgtcaccatgtagatag

SEQ ID NO: 2035 - DNA, 20 bp, Artificial Sequence
  sgRNA
gcacatctagaggagatttc

SEQ ID NO: 2036 - DNA, 20 bp, Artificial Sequence
  sgRNA
tgactttagtccattggaag

SEQ ID NO: 2037 - DNA, 20 bp, Artificial Sequence
  sgRNA
cagtattggtttctgtggcc

SEQ ID NO: 2038 - DNA, 20 bp, Artificial Sequence
  sgRNA
atggaacaaggaggatctag

SEQ ID NO: 2039 - DNA, 20 bp, Artificial Sequence
  sgRNA
gcactccggctgtgattgct

SEQ ID NO: 2040 - DNA, 20 bp, Artificial Sequence
  sgRNA
gatctgcgccgctccgccct

SEQ ID NO: 2041 - DNA, 20 bp, Artificial Sequence
  sgRNA
agtttgagcagtggccatcg

SEQ ID NO: 2042 - DNA, 20 bp, Artificial Sequence
  sgRNA
cactgggccgcgaccctccc

SEQ ID NO: 2043 - DNA, 20 bp, Artificial Sequence
  sgRNA
ggcttccggaagccgtcccg

SEQ ID NO: 2044 - DNA, 20 bp, Artificial Sequence
  sgRNA
gtggaaataggcgcgctccc

SEQ ID NO: 2045 - DNA, 20 bp, Artificial Sequence
  sgRNA
ctttgtaacaaccatgcatt

SEQ ID NO: 2046 - DNA, 20 bp, Artificial Sequence
  sgRNA
attgggccgcgccagtgact

SEQ ID NO: 2047 - DNA, 20 bp, Artificial Sequence
  sgRNA
cggaccctaggcgcgggcgg

SEQ ID NO: 2048 - DNA, 20 bp, Artificial Sequence
  sgRNA
actgcgtcttcccgtcgccc

SEQ ID NO: 2049 - DNA, 20 bp, Artificial Sequence
  sgRNA
aattgcccttctggctagag

SEQ ID NO: 2050 - DNA, 20 bp, Artificial Sequence
  sgRNA
aatctagtgcgcatgctctt

SEQ ID NO: 2051 - DNA, 20 bp, Artificial Sequence
  sgRNA
ctggtgtggactggaagcgc

SEQ ID NO: 2052 - DNA, 20 bp, Artificial Sequence
  sgRNA
gaagttggagctgctgaacc

SEQ ID NO: 2053 - DNA, 20 bp, Artificial Sequence
  sgRNA
caactaagaaagctggtgca

SEQ ID NO: 2054 - DNA, 20 bp, Artificial Sequence
  sgRNA
aagggtactttcaaagtgcc

SEQ ID NO: 2055 - DNA, 20 bp, Artificial Sequence
  sgRNA
acctagacaattagttcttg

SEQ ID NO: 2056 - DNA, 20 bp, Artificial Sequence
  sgRNA
acagcgggtgcaccgcgatg

SEQ ID NO: 2057 - DNA, 20 bp, Artificial Sequence
  sgRNA
aaaggcatagcccagattaa

SEQ ID NO: 2058 - DNA, 20 bp, Artificial Sequence
  sgRNA
agtctgtgcgcgcatcccgc

SEQ ID NO: 2059 - DNA, 20 bp, Artificial Sequence
  sgRNA
aacagggacaggcggtgaga

SEQ ID NO: 2060 - DNA, 20 bp, Artificial Sequence
  sgRNA
aaggatgcagggttaggaaa

SEQ ID NO: 2061 - DNA, 20 bp, Artificial Sequence
  sgRNA
tcaactgtaccataaccctc

SEQ ID NO: 2062 - DNA, 20 bp, Artificial Sequence
  sgRNA
aaggcgtggcctcaccagag

SEQ ID NO: 2063 - DNA, 20 bp, Artificial Sequence
  sgRNA
ggaggcacccagatctgcac

SEQ ID NO: 2064 - DNA, 20 bp, Artificial Sequence
  sgRNA
gactctgggccaacgaggtg

SEQ ID NO: 2065 - DNA, 20 bp, Artificial Sequence
  sgRNA
tgcactaatctggcttccaa

SEQ ID NO: 2066 - DNA, 20 bp, Artificial Sequence
  sgRNA
gcaggcttcaactgcattcc

SEQ ID NO: 2067 - DNA, 20 bp, Artificial Sequence
  sgRNA
gaaacgggcttctgtctgat

SEQ ID NO: 2068 - DNA, 20 bp, Artificial Sequence
  sgRNA
ggcgcaacagcagaaggagg

SEQ ID NO: 2069 - DNA, 20 bp, Artificial Sequence
  sgRNA
acctgatacccaacaaagac

SEQ ID NO: 2070 - DNA, 20 bp, Artificial Sequence
  sgRNA
ggacctgggttgagatgaac

SEQ ID NO: 2071 - DNA, 20 bp, Artificial Sequence
  sgRNA
gcccgacttccgcttaaccc

SEQ ID NO: 2072 - DNA, 20 bp, Artificial Sequence
  sgRNA
aattataaataccctacggc

SEQ ID NO: 2073 - DNA, 20 bp, Artificial Sequence
  sgRNA
aatgtcagtgtcttaagccc

SEQ ID NO: 2074 - DNA, 20 bp, Artificial Sequence
  sgRNA
ggagacgaaagcccagatgt

SEQ ID NO: 2075 - DNA, 20 bp, Artificial Sequence
  sgRNA
aagccacgcccatcctcaga

SEQ ID NO: 2076 - DNA, 20 bp, Artificial Sequence
  sgRNA
ggtgatgcaagacagattat

SEQ ID NO: 2077 - DNA, 20 bp, Artificial Sequence
  sgRNA
gcacaatctggcagcgggat

SEQ ID NO: 2078 - DNA, 20 bp, Artificial Sequence
  sgRNA
tgtttggatgacacgccttt

SEQ ID NO: 2079 - DNA, 20 bp, Artificial Sequence
  sgRNA
cctactgcagaggcagcacc

SEQ ID NO: 2080 - DNA, 20 bp, Artificial Sequence
  sgRNA
ggctagtgcctggcgtagcc

SEQ ID NO: 2081 - DNA, 20 bp, Artificial Sequence
  sgRNA
tcagcaagagttaacctagg

SEQ ID NO: 2082 - DNA, 20 bp, Artificial Sequence
  sgRNA
acctgcactagacgcgtcat

SEQ ID NO: 2083 - DNA, 20 bp, Artificial Sequence
  sgRNA
agagttggactaatctaggg

SEQ ID NO: 2084 - DNA, 20 bp, Artificial Sequence
  sgRNA
ttcttagatcttgcgcaaag

SEQ ID NO: 2085 - DNA, 20 bp, Artificial Sequence
  sgRNA
atgggcagggccaaactccc

SEQ ID NO: 2086 - DNA, 20 bp, Artificial Sequence
  sgRNA
agccacagttaacaggcgta

SEQ ID NO: 2087 - DNA, 20 bp, Artificial Sequence
  sgRNA
ttagggcgtggtggagggag

SEQ ID NO: 2088 - DNA, 20 bp, Artificial Sequence
  sgRNA
tcaggtgagaactcatgtat

SEQ ID NO: 2089 - DNA, 20 bp, Artificial Sequence
  sgRNA
gggtctctctaggtgttagc

SEQ ID NO: 2090 - DNA, 20 bp, Artificial Sequence
  sgRNA
aggtagaactatcaagtctc

SEQ ID NO: 2091 - DNA, 20 bp, Artificial Sequence
  sgRNA
gttgagggtgggaccagaag

SEQ ID NO: 2092 - DNA, 20 bp, Artificial Sequence
  sgRNA
gcagacgtccttcctgcgaa

SEQ ID NO: 2093 - DNA, 20 bp, Artificial Sequence
  sgRNA
gcccatagcatctgtaaagc

SEQ ID NO: 2094 - DNA, 20 bp, Artificial Sequence
  sgRNA
cacataaatctggtgcttgt

SEQ ID NO: 2095 - DNA, 20 bp, Artificial Sequence
  sgRNA
ggaggaccgctgccgacgtg

SEQ ID NO: 2096 - DNA, 20 bp, Artificial Sequence
  sgRNA
aatgggccatatctttatca

SEQ ID NO: 2097 - DNA, 20 bp, Artificial Sequence
  sgRNA
aagctatttagaaagcgatg

SEQ ID NO: 2098 - DNA, 20 bp, Artificial Sequence
  sgRNA
agtgggcacgtgacactctc

SEQ ID NO: 2099 - DNA, 20 bp, Artificial Sequence
  sgRNA
ggtcgtagggcgtggcgaag

SEQ ID NO: 2100 - DNA, 20 bp, Artificial Sequence
  sgRNA
ggatgcaggacaagtcctac

SEQ ID NO: 2101 - DNA, 20 bp, Artificial Sequence
  sgRNA
cttatcagcacaactacctc

SEQ ID NO: 2102 - DNA, 20 bp, Artificial Sequence
  sgRNA
taatcacccagtaattgctt

SEQ ID NO: 2103 - DNA, 20 bp, Artificial Sequence
  sgRNA
gagaaattggtgttgctctt

SEQ ID NO: 2104 - DNA, 20 bp, Artificial Sequence
  sgRNA
ctgtggcttgctcgtcattg

SEQ ID NO: 2105 - DNA, 20 bp, Artificial Sequence
  sgRNA
aacattattaggaaccatgg

SEQ ID NO: 2106 - DNA, 20 bp, Artificial Sequence
  sgRNA
tgtgtgaatgtgattactcc

SEQ ID NO: 2107 - DNA, 20 bp, Artificial Sequence
  sgRNA
cttgcagactcatagacacc

SEQ ID NO: 2108 - DNA, 20 bp, Artificial Sequence
  sgRNA
tcactccgcactctgaccaa

SEQ ID NO: 2109 - DNA, 20 bp, Artificial Sequence
  sgRNA
caactgtgttccgtgaattg

SEQ ID NO: 2110 - DNA, 20 bp, Artificial Sequence
  sgRNA
ggaaggtgttctccctcccg

SEQ ID NO: 2111 - DNA, 20 bp, Artificial Sequence
  sgRNA
caaaccctgtcattctgttc

SEQ ID NO: 2112 - DNA, 20 bp, Artificial Sequence
  sgRNA
cgcgagagttgaggaagttg

SEQ ID NO: 2113 - DNA, 20 bp, Artificial Sequence
  sgRNA
ggttctgcggtaggactccc

SEQ ID NO: 2114 - DNA, 20 bp, Artificial Sequence
  sgRNA
aatagtccagctgtcaactt

SEQ ID NO: 2115 - DNA, 20 bp, Artificial Sequence
  sgRNA
gaaccctgtttgctagggaa

SEQ ID NO: 2116 - DNA, 20 bp, Artificial Sequence
  sgRNA
ctaaggagcacaacgcttgc

SEQ ID NO: 2117 - DNA, 20 bp, Artificial Sequence
  sgRNA
gacagaaggacacaccaatc

SEQ ID NO: 2118 - DNA, 20 bp, Artificial Sequence
  sgRNA
tctgtttgctttctcctaac

SEQ ID NO: 2119 - DNA, 20 bp, Artificial Sequence
  sgRNA
gggcagccgggcgccctcag

SEQ ID NO: 2120 - DNA, 20 bp, Artificial Sequence
  sgRNA
gggcgtgaccagggagttag

SEQ ID NO: 2121 - DNA, 20 bp, Artificial Sequence
  sgRNA
cagagtagttgtcccgggcc

SEQ ID NO: 2122 - DNA, 20 bp, Artificial Sequence
  sgRNA
atcagtgcgtccatcccgcg

SEQ ID NO: 2123 - DNA, 20 bp, Artificial Sequence
  sgRNA
cgggcgtagaggtacgatgc

SEQ ID NO: 2124 - DNA, 20 bp, Artificial Sequence
  sgRNA
ccgggccggttgggtcgccc

SEQ ID NO: 2125 - DNA, 20 bp, Artificial Sequence
  sgRNA
gaagagagaattcaaccgca

SEQ ID NO: 2126 - DNA, 20 bp, Artificial Sequence
  sgRNA
aagtcttgcaactgttgtga

SEQ ID NO: 2127 - DNA, 20 bp, Artificial Sequence
  sgRNA
ctctgaaagccttagcctcg

SEQ ID NO: 2128 - DNA, 20 bp, Artificial Sequence
  sgRNA
catgaagacaagagtctgca

SEQ ID NO: 2129 - DNA, 20 bp, Artificial Sequence
  sgRNA
aaggtgtttccacgctcttc

SEQ ID NO: 2130 - DNA, 20 bp, Artificial Sequence
  sgRNA
tactatggaaatcagagtac

SEQ ID NO: 2131 - DNA, 20 bp, Artificial Sequence
  sgRNA
cttcgaaatatctgtctgat

SEQ ID NO: 2132 - DNA, 20 bp, Artificial Sequence
  sgRNA
gccctcagcttcggctgccc

SEQ ID NO: 2133 - DNA, 20 bp, Artificial Sequence
  sgRNA
cagccttcagagctaagtgc

SEQ ID NO: 2134 - DNA, 20 bp, Artificial Sequence
  sgRNA
aaacttccgcatttccacct

SEQ ID NO: 2135 - DNA, 20 bp, Artificial Sequence
  sgRNA
gaagtgaacagcaggcgacc

SEQ ID NO: 2136 - DNA, 20 bp, Artificial Sequence
  sgRNA
aaggcgtgcgccaccacgct

SEQ ID NO: 2137 - DNA, 20 bp, Artificial Sequence
  sgRNA
agcgggcgggacgtaagggt

SEQ ID NO: 2138 - DNA, 20 bp, Artificial Sequence
  sgRNA
tatgcgcgcagggcggcggg

SEQ ID NO: 2139 - DNA, 20 bp, Artificial Sequence
  sgRNA
gggcagctaaggtgacatta

SEQ ID NO: 2140 - DNA, 20 bp, Artificial Sequence
  sgRNA
tgaacccgaaaggttagcgt

SEQ ID NO: 2141 - DNA, 20 bp, Artificial Sequence
  sgRNA
acagtaggcctagctggcac

SEQ ID NO: 2142 - DNA, 20 bp, Artificial Sequence
  sgRNA
aagctgccacgagattctgg

SEQ ID NO: 2143 - DNA, 20 bp, Artificial Sequence
  sgRNA
ctgcccgagccaaggcaata

SEQ ID NO: 2144 - DNA, 20 bp, Artificial Sequence
  sgRNA
gcccagcggcagcccagagc

SEQ ID NO: 2145 - DNA, 20 bp, Artificial Sequence
  sgRNA
agtaggtagcccagtccgtg

SEQ ID NO: 2146 - DNA, 20 bp, Artificial Sequence
  sgRNA
tgcggaaggacgagcacaaa

SEQ ID NO: 2147 - DNA, 20 bp, Artificial Sequence
  sgRNA
cttcctacggaaacaaggcg

SEQ ID NO: 2148 - DNA, 20 bp, Artificial Sequence
  sgRNA
ggcgggtgtacgtcacgggc

SEQ ID NO: 2149 - DNA, 20 bp, Artificial Sequence
  sgRNA
acgtggtgctctcgcgagag

SEQ ID NO: 2150 - DNA, 20 bp, Artificial Sequence
  sgRNA
aatagctctgaagagttcat

SEQ ID NO: 2151 - DNA, 20 bp, Artificial Sequence
  sgRNA
cagtgctttccaagcgcgta

SEQ ID NO: 2152 - DNA, 20 bp, Artificial Sequence
  sgRNA
ctcagccctgtgtccgtgcc

SEQ ID NO: 2153 - DNA, 20 bp, Artificial Sequence
  sgRNA
cccaggattctttaaacaac

SEQ ID NO: 2154 - DNA, 20 bp, Artificial Sequence
  sgRNA
cgtcagctgttctgccaagg

SEQ ID NO: 2155 - DNA, 20 bp, Artificial Sequence
  sgRNA
taaatcatccaggcatacgg

SEQ ID NO: 2156 - DNA, 20 bp, Artificial Sequence
  sgRNA
gcggagtagttgagagatgc

SEQ ID NO: 2157 - DNA, 20 bp, Artificial Sequence
  sgRNA
attgtactttacgttgggaa

SEQ ID NO: 2158 - DNA, 20 bp, Artificial Sequence
  sgRNA
ttgagcgtaggcaaaggtta

SEQ ID NO: 2159 - DNA, 20 bp, Artificial Sequence
  sgRNA
ggctctaccctgtgaccaat

SEQ ID NO: 2160 - DNA, 20 bp, Artificial Sequence
  sgRNA
gctgtttcataacagacttt

SEQ ID NO: 2161 - DNA, 20 bp, Artificial Sequence
  sgRNA
tgttccattagcctcttggc

SEQ ID NO: 2162 - DNA, 20 bp, Artificial Sequence
  sgRNA
ctatgctaaagacacgcctc

SEQ ID NO: 2163 - DNA, 20 bp, Artificial Sequence
  sgRNA
ggagctcacgcagcttccgg

SEQ ID NO: 2164 - DNA, 20 bp, Artificial Sequence
  sgRNA
acctgcagtcagggactccc

SEQ ID NO: 2165 - DNA, 20 bp, Artificial Sequence
  sgRNA
tgcgcaaccaatcctgggct

SEQ ID NO: 2166 - DNA, 20 bp, Artificial Sequence
  sgRNA
tgtgcgagctggtgcgaact

SEQ ID NO: 2167 - DNA, 20 bp, Artificial Sequence
  sgRNA
gtggagaaattctggagttg

SEQ ID NO: 2168 - DNA, 20 bp, Artificial Sequence
  sgRNA
gctaccatcgggccaggcct

SEQ ID NO: 2169 - DNA, 20 bp, Artificial Sequence
  sgRNA
ccatcggccgtgctgggagc

SEQ ID NO: 2170 - DNA, 20 bp, Artificial Sequence
  sgRNA
tgtgctggtgaagaggcaag

SEQ ID NO: 2171 - DNA, 20 bp, Artificial Sequence
  sgRNA
tagccgatctgacagaggag

SEQ ID NO: 2172 - DNA, 20 bp, Artificial Sequence
  sgRNA
gctattggtggccgctctcg

SEQ ID NO: 2173 - DNA, 20 bp, Artificial Sequence
  sgRNA
ggtgtgtatcgcctccagcc

SEQ ID NO: 2174 - DNA, 20 bp, Artificial Sequence
  sgRNA
gagctgttacgaggctccta

SEQ ID NO: 2175 - DNA, 20 bp, Artificial Sequence
  sgRNA
gaagcctccgcctgaagatt

SEQ ID NO: 2176 - DNA, 20 bp, Artificial Sequence
  sgRNA
tttacaccgctttatttgtc

SEQ ID NO: 2177 - DNA, 20 bp, Artificial Sequence
  sgRNA
taaagaagtagtaggtctca

SEQ ID NO: 2178 - DNA, 20 bp, Artificial Sequence
  sgRNA
aggccaagtgtccaccgtga

SEQ ID NO: 2179 - DNA, 20 bp, Artificial Sequence
  sgRNA
atcaagagttgactgaagac

SEQ ID NO: 2180 - DNA, 20 bp, Artificial Sequence
  sgRNA
cgttgggcgatggacaagct

SEQ ID NO: 2181 - DNA, 20 bp, Artificial Sequence
  sgRNA
ctgcgaatttgggattctat

SEQ ID NO: 2182 - DNA, 20 bp, Artificial Sequence
  sgRNA
tcttcagttaggaacagtcc

SEQ ID NO: 2183 - DNA, 20 bp, Artificial Sequence
  sgRNA
cccgccctgtcaaggcagcc

SEQ ID NO: 2184 - DNA, 20 bp, Artificial Sequence
  sgRNA
aaaggaaacacttggccttt

SEQ ID NO: 2185 - DNA, 20 bp, Artificial Sequence
  sgRNA
gcgtcctggatactttagga

SEQ ID NO: 2186 - DNA, 20 bp, Artificial Sequence
  sgRNA
ttagcaggagtctgattggc

SEQ ID NO: 2187 - DNA, 20 bp, Artificial Sequence
  sgRNA
tatctgcgactccagcgcgg

SEQ ID NO: 2188 - DNA, 20 bp, Artificial Sequence
  sgRNA
gacagtctcccgcgggaccg

SEQ ID NO: 2189 - DNA, 20 bp, Artificial Sequence
  sgRNA
caggaaggaggaactcaaga

SEQ ID NO: 2190 - DNA, 20 bp, Artificial Sequence
  sgRNA
ctactaagcaataagtcaag

SEQ ID NO: 2191 - DNA, 20 bp, Artificial Sequence
  sgRNA
gagcttccttctttcaaacc

SEQ ID NO: 2192 - DNA, 20 bp, Artificial Sequence
  sgRNA
agtcccagttaaccctttcc

SEQ ID NO: 2193 - DNA, 20 bp, Artificial Sequence
  sgRNA
ttgggccctcctaatacatg

SEQ ID NO: 2194 - DNA, 20 bp, Artificial Sequence
  sgRNA
ggtgcctgcagtttcctgcc

SEQ ID NO: 2195 - DNA, 20 bp, Artificial Sequence
  sgRNA
agatggagtttagtaggcta

SEQ ID NO: 2196 - DNA, 20 bp, Artificial Sequence
  sgRNA
cttcttcccagggcgaggtg

SEQ ID NO: 2197 - DNA, 20 bp, Artificial Sequence
  sgRNA
gcgtgcgccgaacgtgtctg

SEQ ID NO: 2198 - DNA, 20 bp, Artificial Sequence
  sgRNA
acagtcgggcccaaccacag

SEQ ID NO: 2199 - DNA, 20 bp, Artificial Sequence
  sgRNA
tgtgctacggtggccgcgcg

SEQ ID NO: 2200 - DNA, 20 bp, Artificial Sequence
  sgRNA
ggagacaccaaccactaaga

SEQ ID NO: 2201 - DNA, 20 bp, Artificial Sequence
  sgRNA
gcatcacgtgggccaaggag

SEQ ID NO: 2202 - DNA, 20 bp, Artificial Sequence
  sgRNA
gggttgctgcaaagcgctca

SEQ ID NO: 2203 - DNA, 20 bp, Artificial Sequence
  sgRNA
aaagaaaggagcatgatgat

SEQ ID NO: 2204 - DNA, 20 bp, Artificial Sequence
  sgRNA
ttgcagtaattacaagtagt

SEQ ID NO: 2205 - DNA, 20 bp, Artificial Sequence
  sgRNA
tcttagtctcgtcgtacgat

SEQ ID NO: 2206 - DNA, 20 bp, Artificial Sequence
  sgRNA
tcctgcaggactggtgcacc

SEQ ID NO: 2207 - DNA, 20 bp, Artificial Sequence
  sgRNA
ctgcgcatgactgaagggcg

SEQ ID NO: 2208 - DNA, 20 bp, Artificial Sequence
  sgRNA
ggctgggcacgcgcagtgcg

SEQ ID NO: 2209 - DNA, 20 bp, Artificial Sequence
  sgRNA
agcgcactgggcgtggttag

SEQ ID NO: 2210 - DNA, 20 bp, Artificial Sequence
  sgRNA
gtgttccgggataggcatcc

SEQ ID NO: 2211 - DNA, 20 bp, Artificial Sequence
  sgRNA
gcacacctacctctccctca

SEQ ID NO: 2212 - DNA, 20 bp, Artificial Sequence
  sgRNA
gttctgacgcgcggaaaccc

SEQ ID NO: 2213 - DNA, 20 bp, Artificial Sequence
  sgRNA
aattgaactggtggcatatc

SEQ ID NO: 2214 - DNA, 20 bp, Artificial Sequence
  sgRNA
ttgagtaggtgtagccttgt

SEQ ID NO: 2215 - DNA, 20 bp, Artificial Sequence
  sgRNA
ctctgcacagggcaggctgg

SEQ ID NO: 2216 - DNA, 20 bp, Artificial Sequence
  sgRNA
tcagcggtagatctagcaaa

SEQ ID NO: 2217 - DNA, 20 bp, Artificial Sequence
  sgRNA
agctttgcccaccgtgctcc

SEQ ID NO: 2218 - DNA, 20 bp, Artificial Sequence
  sgRNA
ggctccaagaatggcctcag

SEQ ID NO: 2219 - DNA, 20 bp, Artificial Sequence
  sgRNA
tccgaccgatgctcgatgct

SEQ ID NO: 2220 - DNA, 20 bp, Artificial Sequence
  sgRNA
gacatctgctgagacttaac

SEQ ID NO: 2221 - DNA, 20 bp, Artificial Sequence
  sgRNA
tttaaagcttgcctttagct

SEQ ID NO: 2222 - DNA, 20 bp, Artificial Sequence
  sgRNA
gagatactctgttgcagcca

SEQ ID NO: 2223 - DNA, 20 bp, Artificial Sequence
  sgRNA
gcacctcagacagctcccgc

SEQ ID NO: 2224 - DNA, 20 bp, Artificial Sequence
  sgRNA
ctaactgcagtgagccgcca

SEQ ID NO: 2225 - DNA, 20 bp, Artificial Sequence
  sgRNA
ccgccatcttgtcattgagt

SEQ ID NO: 2226 - DNA, 20 bp, Artificial Sequence
  sgRNA
taggatgtgactcaatgttt

SEQ ID NO: 2227 - DNA, 20 bp, Artificial Sequence
  sgRNA
cagatgtgtcagttggctga

SEQ ID NO: 2228 - DNA, 20 bp, Artificial Sequence
  sgRNA
agttgatatattcagctgaa

SEQ ID NO: 2229 - DNA, 20 bp, Artificial Sequence
  sgRNA
catctcgtgcgtaagatcca

SEQ ID NO: 2230 - DNA, 20 bp, Artificial Sequence
  sgRNA
tgtctcctaagctagagcag

SEQ ID NO: 2231 - DNA, 20 bp, Artificial Sequence
  sgRNA
ggcatgtcattgttaggcat

SEQ ID NO: 2232 - DNA, 20 bp, Artificial Sequence
  sgRNA
cccgctcggcgggacgggag

SEQ ID NO: 2233 - DNA, 20 bp, Artificial Sequence
  sgRNA
tgtgtggtacgtgtcgcgtg

SEQ ID NO: 2234 - DNA, 20 bp, Artificial Sequence
  sgRNA
gccaggctgcccgtcaaccc

SEQ ID NO: 2235 - DNA, 20 bp, Artificial Sequence
  sgRNA
tgcagagttgcatctaaccc

SEQ ID NO: 2236 - DNA, 20 bp, Artificial Sequence
  sgRNA
gagcgggccgcttagaattg

SEQ ID NO: 2237 - DNA, 20 bp, Artificial Sequence
  sgRNA
ctcagatctagttgcatgat

SEQ ID NO: 2238 - DNA, 20 bp, Artificial Sequence
  sgRNA
gggaatgtagtcccgccttg

SEQ ID NO: 2239 - DNA, 20 bp, Artificial Sequence
  sgRNA
ttatgaagggcccacttgtt

SEQ ID NO: 2240 - DNA, 20 bp, Artificial Sequence
  sgRNA
gctagattgactttcataaa

SEQ ID NO: 2241 - DNA, 20 bp, Artificial Sequence
  sgRNA
ggaggcacgcacgcgacgca

SEQ ID NO: 2242 - DNA, 20 bp, Artificial Sequence
  sgRNA
cctggaaatggctagcttgt

SEQ ID NO: 2243 - DNA, 20 bp, Artificial Sequence
  sgRNA
gttgaggctgcctgtgacgg

SEQ ID NO: 2244 - DNA, 20 bp, Artificial Sequence
  sgRNA
acacaggcgcgcggcgagcc

SEQ ID NO: 2245 - DNA, 20 bp, Artificial Sequence
  sgRNA
cagagggtacctcgctagcc

SEQ ID NO: 2246 - DNA, 20 bp, Artificial Sequence
  sgRNA
cggtgtcgatgcgaaaccct

SEQ ID NO: 2247 - DNA, 20 bp, Artificial Sequence
  sgRNA
cacctcagttcctacagcaa

SEQ ID NO: 2248 - DNA, 20 bp, Artificial Sequence
  sgRNA
gggcccggattacgagggcg

SEQ ID NO: 2249 - DNA, 20 bp, Artificial Sequence
  sgRNA
gagaagaattagctctacaa

SEQ ID NO: 2250 - DNA, 20 bp, Artificial Sequence
  sgRNA
gcctccaactgcgatggccg

SEQ ID NO: 2251 - DNA, 20 bp, Artificial Sequence
  sgRNA
gtagagcaaggcctgctgag

SEQ ID NO: 2252 - DNA, 20 bp, Artificial Sequence
  sgRNA
tgccctccctccctgcctaa

SEQ ID NO: 2253 - DNA, 20 bp, Artificial Sequence
  sgRNA
tttccggcagtgccgcaagt

SEQ ID NO: 2254 - DNA, 20 bp, Artificial Sequence
  sgRNA
gcgtcggcgcggacttctcg

SEQ ID NO: 2255 - DNA, 20 bp, Artificial Sequence
  sgRNA
atttattacctccgactccg

SEQ ID NO: 2256 - DNA, 20 bp, Artificial Sequence
  sgRNA
agtttagagggtctgggtgc

SEQ ID NO: 2257 - DNA, 20 bp, Artificial Sequence
  sgRNA
gcgtggagtgactgagatgt

SEQ ID NO: 2258 - DNA, 20 bp, Artificial Sequence
  sgRNA
ttcctaggcccttctgcatt

SEQ ID NO: 2259 - DNA, 20 bp, Artificial Sequence
  sgRNA
tccttagggccctactttaa

SEQ ID NO: 2260 - DNA, 20 bp, Artificial Sequence
  sgRNA
cccaggctgcctgtcacttg

SEQ ID NO: 2261 - DNA, 20 bp, Artificial Sequence
  sgRNA
ccggtagggtttggccttgg

SEQ ID NO: 2262 - DNA, 20 bp, Artificial Sequence
  sgRNA
ttcgccaaagtccggctgcc

SEQ ID NO: 2263 - DNA, 20 bp, Artificial Sequence
  sgRNA
taactgcactgtggttgatt

SEQ ID NO: 2264 - DNA, 20 bp, Artificial Sequence
  sgRNA
attgtaagaccgggacaatc

SEQ ID NO: 2265 - DNA, 20 bp, Artificial Sequence
  sgRNA
tctggaactcagcagaagag

SEQ ID NO: 2266 - DNA, 20 bp, Artificial Sequence
  sgRNA
cctagctcggagggatgtca

SEQ ID NO: 2267 - DNA, 20 bp, Artificial Sequence
  sgRNA
ttatatccctcactaacctg

SEQ ID NO: 2268 - DNA, 20 bp, Artificial Sequence
  sgRNA
gactaagcaggagaggttga

SEQ ID NO: 2269 - DNA, 20 bp, Artificial Sequence
  sgRNA
cgcagctctcatgatggtcg

SEQ ID NO: 2270 - DNA, 20 bp, Artificial Sequence
  sgRNA
gatccctgccaggccctcac

SEQ ID NO: 2271 - DNA, 20 bp, Artificial Sequence
  sgRNA
ggttaatgcttggactcctg

SEQ ID NO: 2272 - DNA, 20 bp, Artificial Sequence
  sgRNA
ttcccagcagccaacagcag

SEQ ID NO: 2273 - DNA, 20 bp, Artificial Sequence
  sgRNA
tctttaaatgcctgcatcaa

SEQ ID NO: 2274 - DNA, 20 bp, Artificial Sequence
  sgRNA
ttcataaagagagtgcctat

SEQ ID NO: 2275 - DNA, 20 bp, Artificial Sequence
  sgRNA
gagataccaccgcgccggtg

SEQ ID NO: 2276 - DNA, 20 bp, Artificial Sequence
  sgRNA
aatctgaatccacagctccc

SEQ ID NO: 2277 - DNA, 20 bp, Artificial Sequence
  sgRNA
agatccttcctcaaagggcc

SEQ ID NO: 2278 - DNA, 20 bp, Artificial Sequence
  sgRNA
taggttcactgctgcccgac

SEQ ID NO: 2279 - DNA, 20 bp, Artificial Sequence
  sgRNA
tggagcacctagctcttagc

SEQ ID NO: 2280 - DNA, 20 bp, Artificial Sequence
  sgRNA
tctgtgacgtcagggacggc

SEQ ID NO: 2281 - DNA, 20 bp, Artificial Sequence
  sgRNA
ccatgctgtgagtgaacttt

SEQ ID NO: 2282 - DNA, 20 bp, Artificial Sequence
  sgRNA
gaacgcagatccaacctact

SEQ ID NO: 2283 - DNA, 20 bp, Artificial Sequence
  sgRNA
gagagaagtcttcctagtgt

SEQ ID NO: 2284 - DNA, 20 bp, Artificial Sequence
  sgRNA
gcggagttcgagacactcat

SEQ ID NO: 2285 - DNA, 20 bp, Artificial Sequence
  sgRNA
cacggttcccacaatactcc

SEQ ID NO: 2286 - DNA, 20 bp, Artificial Sequence
  sgRNA
ttgcagaaacttggtgagat

SEQ ID NO: 2287 - DNA, 20 bp, Artificial Sequence
  sgRNA
acaaacgcagggcggaaata

SEQ ID NO: 2288 - DNA, 20 bp, Artificial Sequence
  sgRNA
ctgagacagtgcggtgacaa

SEQ ID NO: 2289 - DNA, 20 bp, Artificial Sequence
  sgRNA
ggttaggtgtcttatgaaac

SEQ ID NO: 2290 - DNA, 20 bp, Artificial Sequence
  sgRNA
ggagtatctttagaacatcc

SEQ ID NO: 2291 - DNA, 20 bp, Artificial Sequence
  sgRNA
gcggcggtcgggccattgtg

SEQ ID NO: 2292 - DNA, 20 bp, Artificial Sequence
  sgRNA
ttgatctcatcatatctgaa

SEQ ID NO: 2293 - DNA, 20 bp, Artificial Sequence
  sgRNA
cgatgggctggcaaccgagg

SEQ ID NO: 2294 - DNA, 20 bp, Artificial Sequence
  sgRNA
tcagcgctgagaacaccagg

SEQ ID NO: 2295 - DNA, 20 bp, Artificial Sequence
  sgRNA
gcaggaggagcgcagccggg

SEQ ID NO: 2296 - DNA, 20 bp, Artificial Sequence
  sgRNA
aaagtcacgtcttctctcat

SEQ ID NO: 2297 - DNA, 20 bp, Artificial Sequence
  sgRNA
aaaccacgacctggctccac

SEQ ID NO: 2298 - DNA, 20 bp, Artificial Sequence
  sgRNA
taggccagccaatcagaact

SEQ ID NO: 2299 - DNA, 20 bp, Artificial Sequence
  sgRNA
gccggcgaggaacccgcgct

SEQ ID NO: 2300 - DNA, 20 bp, Artificial Sequence
  sgRNA
tacatatgttgttgtgcagc

SEQ ID NO: 2301 - DNA, 20 bp, Artificial Sequence
  sgRNA
tgagcagtcggtgccggtgc

SEQ ID NO: 2302 - DNA, 20 bp, Artificial Sequence
  sgRNA
cactggaaatatggcagggc

SEQ ID NO: 2303 - DNA, 20 bp, Artificial Sequence
  sgRNA
tggtagagcttctgaggatc

SEQ ID NO: 2304 - DNA, 20 bp, Artificial Sequence
  sgRNA
tctggtcccggtctccgagc

SEQ ID NO: 2305 - DNA, 20 bp, Artificial Sequence
  sgRNA
aacaatcacagatgaagtca

SEQ ID NO: 2306 - DNA, 20 bp, Artificial Sequence
  sgRNA
cagacggcgagccgcctagg

SEQ ID NO: 2307 - DNA, 20 bp, Artificial Sequence
  sgRNA
acactgcactctttcgggtc

SEQ ID NO: 2308 - DNA, 20 bp, Artificial Sequence
  sgRNA
tttccggcgagctgcatacg

SEQ ID NO: 2309 - DNA, 20 bp, Artificial Sequence
  sgRNA
gagagcagcggttcaacagc

SEQ ID NO: 2310 - DNA, 20 bp, Artificial Sequence
  sgRNA
aaggttcgcgaagtgccgct

SEQ ID NO: 2311 - DNA, 20 bp, Artificial Sequence
  sgRNA
acggtagcagcgcagcggca

SEQ ID NO: 2312 - DNA, 20 bp, Artificial Sequence
  sgRNA
aacacaatcaagaaacagtt

SEQ ID NO: 2313 - DNA, 20 bp, Artificial Sequence
  sgRNA
atctgagattaaagatgtgg

SEQ ID NO: 2314 - DNA, 20 bp, Artificial Sequence
  sgRNA
atgaaggactctaagcccag

SEQ ID NO: 2315 - DNA, 20 bp, Artificial Sequence
  sgRNA
aggacaaatccctgcagcag

SEQ ID NO: 2316 - DNA, 20 bp, Artificial Sequence
  sgRNA
gggcagctggccaaggccta

SEQ ID NO: 2317 - DNA, 20 bp, Artificial Sequence
  sgRNA
gggaggagggcagtgggttt

SEQ ID NO: 2318 - DNA, 20 bp, Artificial Sequence
  sgRNA
cgcccactgtatatttagat

SEQ ID NO: 2319 - DNA, 20 bp, Artificial Sequence
  sgRNA
atcggatcaatagcagtctg

SEQ ID NO: 2320 - DNA, 20 bp, Artificial Sequence
  sgRNA
gcagctgacctcttgaccac

SEQ ID NO: 2321 - DNA, 20 bp, Artificial Sequence
  sgRNA
aagtccgtatgctaataaag

SEQ ID NO: 2322 - DNA, 20 bp, Artificial Sequence
  sgRNA
gggtgaggaaacagaagcca

SEQ ID NO: 2323 - DNA, 20 bp, Artificial Sequence
  sgRNA
taagatagatgccatttcaa

SEQ ID NO: 2324 - DNA, 20 bp, Artificial Sequence
  sgRNA
tcgggaccaatgagctgcgc

SEQ ID NO: 2325 - DNA, 20 bp, Artificial Sequence
  sgRNA
gttaggctcccttgctaagg

SEQ ID NO: 2326 - DNA, 20 bp, Artificial Sequence
  sgRNA
gcagaagtgtgtgtgatgag

SEQ ID NO: 2327 - DNA, 20 bp, Artificial Sequence
  sgRNA
agagcagggcgcgctgtgat

SEQ ID NO: 2328 - DNA, 20 bp, Artificial Sequence
  sgRNA
cacggcctgctggactagcc

SEQ ID NO: 2329 - DNA, 20 bp, Artificial Sequence
  sgRNA
agtgaatgcgctcagcttga

SEQ ID NO: 2330 - DNA, 20 bp, Artificial Sequence
  sgRNA
cggttggttgtgggttcccg

SEQ ID NO: 2331 - DNA, 20 bp, Artificial Sequence
  sgRNA
aatcaatggccttcaatccg

SEQ ID NO: 2332 - DNA, 20 bp, Artificial Sequence
  sgRNA
tttgagagaatgcagaagca

SEQ ID NO: 2333 - DNA, 20 bp, Artificial Sequence
  sgRNA
ggatagcccgacccaccgac

SEQ ID NO: 2334 - DNA, 20 bp, Artificial Sequence
  sgRNA
atataaggacattggaagaa

SEQ ID NO: 2335 - DNA, 20 bp, Artificial Sequence
  sgRNA
gtccggaggacgtcacactg

SEQ ID NO: 2336 - DNA, 20 bp, Artificial Sequence
  sgRNA
gttgctgcaggacgcagtcg

SEQ ID NO: 2337 - DNA, 20 bp, Artificial Sequence
  sgRNA
ggcagggcagtagtagaaag

SEQ ID NO: 2338 - DNA, 20 bp, Artificial Sequence
  sgRNA
cctggcactctttgatgaag

SEQ ID NO: 2339 - DNA, 20 bp, Artificial Sequence
  sgRNA
cgggcggctggcgagggact

SEQ ID NO: 2340 - DNA, 20 bp, Artificial Sequence
  sgRNA
ttagtccttagcgcagtcta

SEQ ID NO: 2341 - DNA, 20 bp, Artificial Sequence
  sgRNA
gtttccgcatacccagcttc

SEQ ID NO: 2342 - DNA, 20 bp, Artificial Sequence
  sgRNA
ggttagcactcgtgattctg

SEQ ID NO: 2343 - DNA, 20 bp, Artificial Sequence
  sgRNA
cttctggcgtggagcgccgc

SEQ ID NO: 2344 - DNA, 20 bp, Artificial Sequence
  sgRNA
ggaggaggagacacctcagc

SEQ ID NO: 2345 - DNA, 20 bp, Artificial Sequence
  sgRNA
cagacgtatttctgagttcg

SEQ ID NO: 2346 - DNA, 20 bp, Artificial Sequence
  sgRNA
ccacctgagtcaaacagaac

SEQ ID NO: 2347 - DNA, 20 bp, Artificial Sequence
  sgRNA
actcttcggtaggacgatag

SEQ ID NO: 2348 - DNA, 20 bp, Artificial Sequence
  sgRNA
ctcccagagccttctgtccc

SEQ ID NO: 2349 - DNA, 20 bp, Artificial Sequence
  sgRNA
tgtgggttggagctagggaa

SEQ ID NO: 2350 - DNA, 20 bp, Artificial Sequence
  sgRNA
gcgccctgcgacgcaccagt

SEQ ID NO: 2351 - DNA, 20 bp, Artificial Sequence
  sgRNA
cgcgtgtcttctgtaggatg

SEQ ID NO: 2352 - DNA, 20 bp, Artificial Sequence
  sgRNA
gttggcactgattgttcctg

SEQ ID NO: 2353 - DNA, 20 bp, Artificial Sequence
  sgRNA
ggatcctcatcctaaccaag

SEQ ID NO: 2354 - DNA, 20 bp, Artificial Sequence
  sgRNA
ggtttcctagctacatcttg

SEQ ID NO: 2355 - DNA, 20 bp, Artificial Sequence
  sgRNA
catcaaaggatcacgtagga

SEQ ID NO: 2356 - DNA, 20 bp, Artificial Sequence
  sgRNA
agataactgtgtaagagctc

SEQ ID NO: 2357 - DNA, 20 bp, Artificial Sequence
  sgRNA
cccgcacaatagcggtggga

SEQ ID NO: 2358 - DNA, 20 bp, Artificial Sequence
  sgRNA
aagagaggcgacggttagta

SEQ ID NO: 2359 - DNA, 20 bp, Artificial Sequence
  sgRNA
gggctaatccctggacgccc

SEQ ID NO: 2360 - DNA, 20 bp, Artificial Sequence
  sgRNA
ctgtcacgcggtctgcttgc

SEQ ID NO: 2361 - DNA, 20 bp, Artificial Sequence
  sgRNA
ggttgaaattgtattgaaga

SEQ ID NO: 2362 - DNA, 20 bp, Artificial Sequence
  sgRNA
aaagggaggagacaaacgtt

SEQ ID NO: 2363 - DNA, 20 bp, Artificial Sequence
  sgRNA
tacgcgcttgagtgcgcgag

SEQ ID NO: 2364 - DNA, 20 bp, Artificial Sequence
  sgRNA
ttggaagggagaaagactta

SEQ ID NO: 2365 - DNA, 20 bp, Artificial Sequence
  sgRNA
ccgctctccattcataaatc

SEQ ID NO: 2366 - DNA, 20 bp, Artificial Sequence
  sgRNA
gacgcgcatgcgtgtctcca

SEQ ID NO: 2367 - DNA, 20 bp, Artificial Sequence
  sgRNA
acacttgtgagggctgctct

SEQ ID NO: 2368 - DNA, 20 bp, Artificial Sequence
  sgRNA
aaaggccaccagcactgaaa

SEQ ID NO: 2369 - DNA, 20 bp, Artificial Sequence
  sgRNA
ggcctcagagcaggaactaa

SEQ ID NO: 2370 - DNA, 20 bp, Artificial Sequence
  sgRNA
gggcgcgaggaacccaggga

SEQ ID NO: 2371 - DNA, 20 bp, Artificial Sequence
  sgRNA
tgttgctaaacatgattaag

SEQ ID NO: 2372 - DNA, 20 bp, Artificial Sequence
  sgRNA
tttataacgtgtcgttgaga

SEQ ID NO: 2373 - DNA, 20 bp, Artificial Sequence
  sgRNA
atcttcaagatcctggttgg

SEQ ID NO: 2374 - DNA, 20 bp, Artificial Sequence
  sgRNA
gttcccagtgaggtttgtcc

SEQ ID NO: 2375 - DNA, 20 bp, Artificial Sequence
  sgRNA
aacataagcacccatcagct

SEQ ID NO: 2376 - DNA, 20 bp, Artificial Sequence
  sgRNA
aacatgcgctcctgggaaga

SEQ ID NO: 2377 - DNA, 20 bp, Artificial Sequence
  sgRNA
aaggcagggtctgagagcac

SEQ ID NO: 2378 - DNA, 20 bp, Artificial Sequence
  sgRNA
aagtacagtggagctacagc

SEQ ID NO: 2379 - DNA, 20 bp, Artificial Sequence
  sgRNA
gcaagtccttctagcgactg

SEQ ID NO: 2380 - DNA, 20 bp, Artificial Sequence
  sgRNA
gcggctcgggctggccgctt

SEQ ID NO: 2381 - DNA, 20 bp, Artificial Sequence
  sgRNA
gacagggtatcctagcggag

SEQ ID NO: 2382 - DNA, 20 bp, Artificial Sequence
  sgRNA
gatgtgatcgcagcggtgat

SEQ ID NO: 2383 - DNA, 20 bp, Artificial Sequence
  sgRNA
tgctgatgctgtagcctgca

SEQ ID NO: 2384 - DNA, 20 bp, Artificial Sequence
  sgRNA
gagcgtcactgacaaccacc

SEQ ID NO: 2385 - DNA, 20 bp, Artificial Sequence
  sgRNA
gctctcgaccaatcggcgct

SEQ ID NO: 2386 - DNA, 20 bp, Artificial Sequence
  sgRNA
actaattggagcccatgaga

SEQ ID NO: 2387 - DNA, 20 bp, Artificial Sequence
  sgRNA
cgccgtgcggagtccttcct

SEQ ID NO: 2388 - DNA, 20 bp, Artificial Sequence
  sgRNA
tttgccttggttcccggagc

SEQ ID NO: 2389 - DNA, 20 bp, Artificial Sequence
  sgRNA
gcagagtagggtttcaaagc

SEQ ID NO: 2390 - DNA, 20 bp, Artificial Sequence
  sgRNA
acactcaagagttcttgacc

SEQ ID NO: 2391 - DNA, 20 bp, Artificial Sequence
  sgRNA
tttccctaagaagtcaagta

SEQ ID NO: 2392 - DNA, 20 bp, Artificial Sequence
  sgRNA
gcggctttctctagcccggt

SEQ ID NO: 2393 - DNA, 20 bp, Artificial Sequence
  sgRNA
atatatgatagtagcgttag

SEQ ID NO: 2394 - DNA, 20 bp, Artificial Sequence
  sgRNA
taacctagtggctgtgttgg

SEQ ID NO: 2395 - DNA, 20 bp, Artificial Sequence
  sgRNA
aagtaatctgcaggctgccg

SEQ ID NO: 2396 - DNA, 20 bp, Artificial Sequence
  sgRNA
ctagagtaggagtatacttt

SEQ ID NO: 2397 - DNA, 20 bp, Artificial Sequence
  sgRNA
gaataagtcgccagaacttg

SEQ ID NO: 2398 - DNA, 20 bp, Artificial Sequence
  sgRNA
aggccatgatggactccgcg

SEQ ID NO: 2399 - DNA, 20 bp, Artificial Sequence
  sgRNA
acgtgggtagtgaggtgtcc

SEQ ID NO: 2400 - DNA, 20 bp, Artificial Sequence
  sgRNA
tgcaagatgctgcgcgcccg

SEQ ID NO: 2401 - DNA, 20 bp, Artificial Sequence
  sgRNA
tggtggagcgtcacgtcgcc

SEQ ID NO: 2402 - DNA, 20 bp, Artificial Sequence
  sgRNA
ggatgggaggatagtcagag

SEQ ID NO: 2403 - DNA, 20 bp, Artificial Sequence
  sgRNA
gattggacaggaggtgttag

SEQ ID NO: 2404 - DNA, 20 bp, Artificial Sequence
  sgRNA
gtttgcacctagaaggtgtt

SEQ ID NO: 2405 - DNA, 20 bp, Artificial Sequence
  sgRNA
agaccgcctaaaggcgaagc

SEQ ID NO: 2406 - DNA, 20 bp, Artificial Sequence
  sgRNA
gggacccggtctattgtcaa

SEQ ID NO: 2407 - DNA, 20 bp, Artificial Sequence
  sgRNA
tacgtagctggcgggctctg

SEQ ID NO: 2408 - DNA, 20 bp, Artificial Sequence
  sgRNA
ataagagcaagagagagctt

SEQ ID NO: 2409 - DNA, 20 bp, Artificial Sequence
  sgRNA
catctatcttgacaatttca

SEQ ID NO: 2410 - DNA, 20 bp, Artificial Sequence
  sgRNA
ggtgaagagggtcctggatg

SEQ ID NO: 2411 - DNA, 20 bp, Artificial Sequence
  sgRNA
gtttctggctgcagtgagag

SEQ ID NO: 2412 - DNA, 20 bp, Artificial Sequence
  sgRNA
atgcagacatggagtctctc

SEQ ID NO: 2413 - DNA, 20 bp, Artificial Sequence
  sgRNA
agaggtagttaagccaatcc

SEQ ID NO: 2414 - DNA, 20 bp, Artificial Sequence
  sgRNA
gaggacttcgccagcggctt

SEQ ID NO: 2415 - DNA, 20 bp, Artificial Sequence
  sgRNA
aagggcagggacggtactca

SEQ ID NO: 2416 - DNA, 20 bp, Artificial Sequence
  sgRNA
taagggaggaagggtcccgg

SEQ ID NO: 2417 - DNA, 20 bp, Artificial Sequence
  sgRNA
cctgattggttgccaagagg

SEQ ID NO: 2418 - DNA, 20 bp, Artificial Sequence
  sgRNA
cagaacctccagagagtgtg

SEQ ID NO: 2419 - DNA, 20 bp, Artificial Sequence
  sgRNA
gcacaggacatgatgctcct

SEQ ID NO: 2420 - DNA, 20 bp, Artificial Sequence
  sgRNA
gtggccgaagaggagcgaac

SEQ ID NO: 2421 - DNA, 20 bp, Artificial Sequence
  sgRNA
ctacttgacagaattccaaa

SEQ ID NO: 2422 - DNA, 20 bp, Artificial Sequence
  sgRNA
gcacagagtctccgctactc

SEQ ID NO: 2423 - DNA, 20 bp, Artificial Sequence
  sgRNA
taagctaggaaagatggagg

SEQ ID NO: 2424 - DNA, 20 bp, Artificial Sequence
  sgRNA
aactggcgggaggcagagaa

SEQ ID NO: 2425 - DNA, 20 bp, Artificial Sequence
  sgRNA
gaactacctacaggcacaga

SEQ ID NO: 2426 - DNA, 20 bp, Artificial Sequence
  sgRNA
taacaatgtcctgcgtttcc

SEQ ID NO: 2427 - DNA, 20 bp, Artificial Sequence
  sgRNA
gtctgtcgtaaacctggcac

SEQ ID NO: 2428 - DNA, 20 bp, Artificial Sequence
  sgRNA
ctgggctggcagtaggacaa

SEQ ID NO: 2429 - DNA, 20 bp, Artificial Sequence
  sgRNA
ggtggtgcagcaggtgccca

SEQ ID NO: 2430 - DNA, 20 bp, Artificial Sequence
  sgRNA
aattcctgccatgctgccct

SEQ ID NO: 2431 - DNA, 20 bp, Artificial Sequence
  sgRNA
ggtggagtttccgaccgggc

SEQ ID NO: 2432 - DNA, 20 bp, Artificial Sequence
  sgRNA
ttactatggacgtgagatgt

SEQ ID NO: 2433 - DNA, 20 bp, Artificial Sequence
  sgRNA
cattgttgtgatcactgcac

SEQ ID NO: 2434 - DNA, 20 bp, Artificial Sequence
  sgRNA
gggtgctgacctgcgcaccc

SEQ ID NO: 2435 - DNA, 20 bp, Artificial Sequence
  sgRNA
ttgaggagtaaatagcacct

SEQ ID NO: 2436 - DNA, 20 bp, Artificial Sequence
  sgRNA
ccggatgcggctgtcctcta

SEQ ID NO: 2437 - DNA, 20 bp, Artificial Sequence
  sgRNA
catgacctcgcgcagggaaa

SEQ ID NO: 2438 - DNA, 20 bp, Artificial Sequence
  sgRNA
aggcgcaccgtgcggtgcgg

SEQ ID NO: 2439 - DNA, 20 bp, Artificial Sequence
  sgRNA
aaagcactcagttagctggc

SEQ ID NO: 2440 - DNA, 20 bp, Artificial Sequence
  sgRNA
gctcagcccaagagattgtc

SEQ ID NO: 2441 - DNA, 20 bp, Artificial Sequence
  sgRNA
ttcttctattacaggtggcc

SEQ ID NO: 2442 - DNA, 20 bp, Artificial Sequence
  sgRNA
agctgggcgactggaaccaa

SEQ ID NO: 2443 - DNA, 20 bp, Artificial Sequence
  sgRNA
ttgtctgctgaaccaaagcg

SEQ ID NO: 2444 - DNA, 20 bp, Artificial Sequence
  sgRNA
gcggcctgccactcacgcgc

SEQ ID NO: 2445 - DNA, 20 bp, Artificial Sequence
  sgRNA
ctctcgcctgggcgcggaaa

SEQ ID NO: 2446 - DNA, 20 bp, Artificial Sequence
  sgRNA
aagtaggagcaacttcctca

SEQ ID NO: 2447 - DNA, 20 bp, Artificial Sequence
  sgRNA
cgcagagaactcgagccgga

SEQ ID NO: 2448 - DNA, 20 bp, Artificial Sequence
  sgRNA
ggcggagcatagcgaggact

SEQ ID NO: 2449 - DNA, 20 bp, Artificial Sequence
  sgRNA
tactccaggtacctacaagt

SEQ ID NO: 2450 - DNA, 20 bp, Artificial Sequence
  sgRNA
ctggtgagagtcatcaacct

SEQ ID NO: 2451 - DNA, 20 bp, Artificial Sequence
  sgRNA
gagccaatcagagctggcgg

SEQ ID NO: 2452 - DNA, 20 bp, Artificial Sequence
  sgRNA
gcgcgcgcagcttccactcg

SEQ ID NO: 2453 - DNA, 20 bp, Artificial Sequence
  sgRNA
gtatgtgaaatgtatttcgt

SEQ ID NO: 2454 - DNA, 20 bp, Artificial Sequence
  sgRNA
gtgttgttagaaggagaagc

SEQ ID NO: 2455 - DNA, 20 bp, Artificial Sequence
  sgRNA
aactaacaaggtcacactga

SEQ ID NO: 2456 - DNA, 20 bp, Artificial Sequence
  sgRNA
agccctggcgaaggcactac

SEQ ID NO: 2457 - DNA, 20 bp, Artificial Sequence
  sgRNA
tgcgcacaaagccgccacgg

SEQ ID NO: 2458 - DNA, 20 bp, Artificial Sequence
  sgRNA
tgatggccacgtggcctcgc

SEQ ID NO: 2459 - DNA, 20 bp, Artificial Sequence
  sgRNA
ccatgacaaccagcttgcgc

SEQ ID NO: 2460 - DNA, 20 bp, Artificial Sequence
  sgRNA
gaagcgtgaagtacaaggcg

SEQ ID NO: 2461 - DNA, 20 bp, Artificial Sequence
  sgRNA
cggctccttcgttgggatcc

SEQ ID NO: 2462 - DNA, 20 bp, Artificial Sequence
  sgRNA
gaaggatgtgaatgagccag

SEQ ID NO: 2463 - DNA, 20 bp, Artificial Sequence
  sgRNA
tggcgcaagtcggccggagg

SEQ ID NO: 2464 - DNA, 20 bp, Artificial Sequence
  sgRNA
ggtgaggaaagtccgccctc

SEQ ID NO: 2465 - DNA, 20 bp, Artificial Sequence
  sgRNA
tatgatgacgccttgtcctg

SEQ ID NO: 2466 - DNA, 20 bp, Artificial Sequence
  sgRNA
cagacacagatatagagatt

SEQ ID NO: 2467 - DNA, 20 bp, Artificial Sequence
  sgRNA
gcagatgaggagcgcggcga

SEQ ID NO: 2468 - DNA, 20 bp, Artificial Sequence
  sgRNA
gaaagagattccctgctccc

SEQ ID NO: 2469 - DNA, 20 bp, Artificial Sequence
  sgRNA
gcagcggcacctgtacttgc

SEQ ID NO: 2470 - DNA, 20 bp, Artificial Sequence
  sgRNA
tccaggccacgatccagccc

SEQ ID NO: 2471 - DNA, 20 bp, Artificial Sequence
  sgRNA
gcgtgattggagggctgtgc

SEQ ID NO: 2472 - DNA, 20 bp, Artificial Sequence
  sgRNA
agaagttgaaatctagaact

SEQ ID NO: 2473 - DNA, 20 bp, Artificial Sequence
  sgRNA
gcctgcgctcgcagtgcttg

SEQ ID NO: 2474 - DNA, 20 bp, Artificial Sequence
  sgRNA
gaacagactaacaggccacc

SEQ ID NO: 2475 - DNA, 20 bp, Artificial Sequence
  sgRNA
aaagccttaactcaggaatg

SEQ ID NO: 2476 - DNA, 20 bp, Artificial Sequence
  sgRNA
gatggccttggccctaactg

SEQ ID NO: 2477 - DNA, 20 bp, Artificial Sequence
  sgRNA
gatcttcacgtcccaagctg

SEQ ID NO: 2478 - DNA, 20 bp, Artificial Sequence
  sgRNA
tggtgacctggaggacaatg

SEQ ID NO: 2479 - DNA, 20 bp, Artificial Sequence
  sgRNA
gaatgaatcacagtgagagt

SEQ ID NO: 2480 - DNA, 20 bp, Artificial Sequence
  sgRNA
cccgggcgctgagttgggcg

SEQ ID NO: 2481 - DNA, 20 bp, Artificial Sequence
  sgRNA
tctgcgtgggttcccttctc

SEQ ID NO: 2482 - DNA, 20 bp, Artificial Sequence
  sgRNA
acagatgtcatctcttcctt

SEQ ID NO: 2483 - DNA, 20 bp, Artificial Sequence
  sgRNA
tgacagaccaggagagcaag

SEQ ID NO: 2484 - DNA, 20 bp, Artificial Sequence
  sgRNA
agactgctgtgacgaccaat

SEQ ID NO: 2485 - DNA, 20 bp, Artificial Sequence
  sgRNA
gagcgagcgcagcgcagcag

SEQ ID NO: 2486 - DNA, 20 bp, Artificial Sequence
  sgRNA
acagaaggtttggagaagcc

SEQ ID NO: 2487 - DNA, 20 bp, Artificial Sequence
  sgRNA
tgtgacaccagctttcttaa

SEQ ID NO: 2488 - DNA, 20 bp, Artificial Sequence
  sgRNA
attggtcacgagctctggac

SEQ ID NO: 2489 - DNA, 20 bp, Artificial Sequence
  sgRNA
cagtgtcgcggtgaccttta

SEQ ID NO: 2490 - DNA, 20 bp, Artificial Sequence
  sgRNA
atgaatgccttcaagtctga

SEQ ID NO: 2491 - DNA, 20 bp, Artificial Sequence
  sgRNA
ctaggacgcggtaacatggt

SEQ ID NO: 2492 - DNA, 20 bp, Artificial Sequence
  sgRNA
gagcgtaaagtacgcaaaca

SEQ ID NO: 2493 - DNA, 20 bp, Artificial Sequence
  sgRNA
ccgccaccacgcctttatga

SEQ ID NO: 2494 - DNA, 20 bp, Artificial Sequence
  sgRNA
gggcgtcttgggcgagcttg

SEQ ID NO: 2495 - DNA, 20 bp, Artificial Sequence
  sgRNA
aaatacgcaacagcgtgaga

SEQ ID NO: 2496 - DNA, 20 bp, Artificial Sequence
  sgRNA
ggcacgtgcggcgcgtgcgc

SEQ ID NO: 2497 - DNA, 20 bp, Artificial Sequence
  sgRNA
gcagagcctcgtggctgtgg

SEQ ID NO: 2498 - DNA, 20 bp, Artificial Sequence
  sgRNA
cgggtaacccacagacttgt

SEQ ID NO: 2499 - DNA, 20 bp, Artificial Sequence
  sgRNA
acggtgaataatcaaactgg

SEQ ID NO: 2500 - DNA, 20 bp, Artificial Sequence
  sgRNA
gcgaatgaaacccttccggg

SEQ ID NO: 2501 - DNA, 20 bp, Artificial Sequence
  sgRNA
acccaggttgctaaacaatt

SEQ ID NO: 2502 - DNA, 20 bp, Artificial Sequence
  sgRNA
agacaatagaatgtccagga

SEQ ID NO: 2503 - DNA, 20 bp, Artificial Sequence
  sgRNA
acactcaccagagctactgt

SEQ ID NO: 2504 - DNA, 20 bp, Artificial Sequence
  sgRNA
ccgcctccttagacttgaca

SEQ ID NO: 2505 - DNA, 20 bp, Artificial Sequence
  sgRNA
gcgctgcgcatgctcgactg

SEQ ID NO: 2506 - DNA, 20 bp, Artificial Sequence
  sgRNA
tcagttccgcagcttaagga

SEQ ID NO: 2507 - DNA, 20 bp, Artificial Sequence
  sgRNA
agcagtaagcacagtgtgcc

SEQ ID NO: 2508 - DNA, 20 bp, Artificial Sequence
  sgRNA
gcgcactaagctgactgcgc

SEQ ID NO: 2509 - DNA, 20 bp, Artificial Sequence
  sgRNA
agagagcgggaatgctgttc

SEQ ID NO: 2510 - DNA, 20 bp, Artificial Sequence
  sgRNA
ccttctcttcttcatgggac

SEQ ID NO: 2511 - DNA, 20 bp, Artificial Sequence
  sgRNA
cagaaacataggctcgcccg

SEQ ID NO: 2512 - DNA, 20 bp, Artificial Sequence
  sgRNA
ctcggatcggcgggaggcag

SEQ ID NO: 2513 - DNA, 20 bp, Artificial Sequence
  sgRNA
attaagctgtcgtgagcaaa

SEQ ID NO: 2514 - DNA, 20 bp, Artificial Sequence
  sgRNA
caattggtccctccgagagg

SEQ ID NO: 2515 - DNA, 20 bp, Artificial Sequence
  sgRNA
ggtaaatactttgaccgttt

SEQ ID NO: 2516 - DNA, 20 bp, Artificial Sequence
  sgRNA
aggtttagggtctatggact

SEQ ID NO: 2517 - DNA, 20 bp, Artificial Sequence
  sgRNA
tgctagctgacaaatagact

SEQ ID NO: 2518 - DNA, 20 bp, Artificial Sequence
  sgRNA
gggccttgtttgtgccctgt

SEQ ID NO: 2519 - DNA, 20 bp, Artificial Sequence
  sgRNA
cactgctgagtggtaggcag

SEQ ID NO: 2520 - DNA, 20 bp, Artificial Sequence
  sgRNA
cctcccaagcctccaggaca

SEQ ID NO: 2521 - DNA, 20 bp, Artificial Sequence
  sgRNA
gacgccaaacagaccaatcg

SEQ ID NO: 2522 - DNA, 20 bp, Artificial Sequence
  sgRNA
gcgggcggccctgcaggctg

SEQ ID NO: 2523 - DNA, 20 bp, Artificial Sequence
  sgRNA
gggacgagtggaacatcgcg

SEQ ID NO: 2524 - DNA, 20 bp, Artificial Sequence
  sgRNA
cgtggcacaaggaagaagag

SEQ ID NO: 2525 - DNA, 20 bp, Artificial Sequence
  sgRNA
ggccaatcagctgttcgcag

SEQ ID NO: 2526 - DNA, 20 bp, Artificial Sequence
  sgRNA
aatctaaagagttgtcccag

SEQ ID NO: 2527 - DNA, 20 bp, Artificial Sequence
  sgRNA
cgagagcgcggctcgcgagt

SEQ ID NO: 2528 - DNA, 20 bp, Artificial Sequence
  sgRNA
gtgctgcagggaatgtatgg

SEQ ID NO: 2529 - DNA, 20 bp, Artificial Sequence
  sgRNA
gactgtcataggacagctct

SEQ ID NO: 2530 - DNA, 20 bp, Artificial Sequence
  sgRNA
aggtggtgctgtctatccct

SEQ ID NO: 2531 - DNA, 20 bp, Artificial Sequence
  sgRNA
tacagttaccctgatgggcg

SEQ ID NO: 2532 - DNA, 20 bp, Artificial Sequence
  sgRNA
caaatctactctttcaatct

SEQ ID NO: 2533 - DNA, 20 bp, Artificial Sequence
  sgRNA
ttctagcgattgttaacgcc

SEQ ID NO: 2534 - DNA, 20 bp, Artificial Sequence
  sgRNA
caccagattgtcagttattc

SEQ ID NO: 2535 - DNA, 20 bp, Artificial Sequence
  sgRNA
gaggatgctttcgcgaagcc

SEQ ID NO: 2536 - DNA, 20 bp, Artificial Sequence
  sgRNA
catcacctgctgtgaaatgt

SEQ ID NO: 2537 - DNA, 20 bp, Artificial Sequence
  sgRNA
gctgaggaggcggagctccc

SEQ ID NO: 2538 - DNA, 20 bp, Artificial Sequence
  sgRNA
taattgtgacgcaccaaggc

SEQ ID NO: 2539 - DNA, 20 bp, Artificial Sequence
  sgRNA
cacacatcccagattgaggg

SEQ ID NO: 2540 - DNA, 20 bp, Artificial Sequence
  sgRNA
gctggcaggaaggtcggctg

SEQ ID NO: 2541 - DNA, 20 bp, Artificial Sequence
  sgRNA
aactccggccgagaacaccc

SEQ ID NO: 2542 - DNA, 20 bp, Artificial Sequence
  sgRNA
actcgcaacccgactccgct

SEQ ID NO: 2543 - DNA, 20 bp, Artificial Sequence
  sgRNA
tctgggcggataggtgggtg

SEQ ID NO: 2544 - DNA, 20 bp, Artificial Sequence
  sgRNA
ctgaaaggcgcaccctgccc

SEQ ID NO: 2545 - DNA, 20 bp, Artificial Sequence
  sgRNA
tcaccgggctgggccactgc

SEQ ID NO: 2546 - DNA, 20 bp, Artificial Sequence
  sgRNA
tgagtggctgcgaaagggtg

SEQ ID NO: 2547 - DNA, 20 bp, Artificial Sequence
  sgRNA
catgattctgcaagccttac

SEQ ID NO: 2548 - DNA, 20 bp, Artificial Sequence
  sgRNA
gctctgttaggaaggcatga

SEQ ID NO: 2549 - DNA, 20 bp, Artificial Sequence
  sgRNA
tgggaaggaaggaatttatg

SEQ ID NO: 2550 - DNA, 20 bp, Artificial Sequence
  sgRNA
gtttcttcccatcaatgtcc

SEQ ID NO: 2551 - DNA, 20 bp, Artificial Sequence
  sgRNA
tcaaagatacactgcctccc

SEQ ID NO: 2552 - DNA, 20 bp, Artificial Sequence
  sgRNA
tgtctgatgcacagattact

SEQ ID NO: 2553 - DNA, 20 bp, Artificial Sequence
  sgRNA
gaggctgttccctagcgccg

SEQ ID NO: 2554 - DNA, 20 bp, Artificial Sequence
  sgRNA
cagcttcgcctttgcgcaac

SEQ ID NO: 2555 - DNA, 20 bp, Artificial Sequence
  sgRNA
tccatcatgacctttcaagg

SEQ ID NO: 2556 - DNA, 20 bp, Artificial Sequence
  sgRNA
agcattcaccaggatattgt

SEQ ID NO: 2557 - DNA, 20 bp, Artificial Sequence
  sgRNA
cctccttcccttcaaactga

SEQ ID NO: 2558 - DNA, 20 bp, Artificial Sequence
  sgRNA
gtctgcaatatgctgggacc

SEQ ID NO: 2559 - DNA, 20 bp, Artificial Sequence
  sgRNA
agagcgaagcttgcgctttg

SEQ ID NO: 2560 - DNA, 20 bp, Artificial Sequence
  sgRNA
cccaccgcgtatgcaaaggc

SEQ ID NO: 2561 - DNA, 20 bp, Artificial Sequence
  sgRNA
aagggttgctgacagatagg

SEQ ID NO: 2562 - DNA, 20 bp, Artificial Sequence
  sgRNA
agagccaaagggttaggaac

SEQ ID NO: 2563 - DNA, 20 bp, Artificial Sequence
  sgRNA
gcgtaatcttactgcatccc

SEQ ID NO: 2564 - DNA, 20 bp, Artificial Sequence
  sgRNA
cgtcgctttacggccggagg

SEQ ID NO: 2565 - DNA, 20 bp, Artificial Sequence
  sgRNA
gggcgaggtacctaggcgtg

SEQ ID NO: 2566 - DNA, 20 bp, Artificial Sequence
  sgRNA
cgagtgacgcggcgccagcc

SEQ ID NO: 2567 - DNA, 20 bp, Artificial Sequence
  sgRNA
aacgggagataggcggagtc

SEQ ID NO: 2568 - DNA, 20 bp, Artificial Sequence
  sgRNA
aggtctgcacttgtccgctc

SEQ ID NO: 2569 - DNA, 20 bp, Artificial Sequence
  sgRNA
caatcgctgttgccctgccg

SEQ ID NO: 2570 - DNA, 20 bp, Artificial Sequence
  sgRNA
gggcgccaaattcaaatctg

SEQ ID NO: 2571 - DNA, 20 bp, Artificial Sequence
  sgRNA
gactagtcagtttctacttt

SEQ ID NO: 2572 - DNA, 20 bp, Artificial Sequence
  sgRNA
gcggaattggtgtggctggc

SEQ ID NO: 2573 - DNA, 20 bp, Artificial Sequence
  sgRNA
ccgcccatccgagccaacac

SEQ ID NO: 2574 - DNA, 20 bp, Artificial Sequence
  sgRNA
tgggtttgaaattctctatc

SEQ ID NO: 2575 - DNA, 20 bp, Artificial Sequence
  sgRNA
accgacgctaacgacgacct

SEQ ID NO: 2576 - DNA, 20 bp, Artificial Sequence
  sgRNA
aaaggactgcggtttcccgc

SEQ ID NO: 2577 - DNA, 20 bp, Artificial Sequence
  sgRNA
cacatgtatacagtatttgt

SEQ ID NO: 2578 - DNA, 20 bp, Artificial Sequence
  sgRNA
gggctaagtggctacccgct

SEQ ID NO: 2579 - DNA, 20 bp, Artificial Sequence
  sgRNA
ccttagggaggcaaggcgtg

SEQ ID NO: 2580 - DNA, 20 bp, Artificial Sequence
  sgRNA
aagctagaagcgccctagcc

SEQ ID NO: 2581 - DNA, 20 bp, Artificial Sequence
  sgRNA
gaatggaatctctctagagc

SEQ ID NO: 2582 - DNA, 20 bp, Artificial Sequence
  sgRNA
tcagcttctaataaccgcgc

SEQ ID NO: 2583 - DNA, 20 bp, Artificial Sequence
  sgRNA
ggtcactcggccaagacatc

SEQ ID NO: 2584 - DNA, 20 bp, Artificial Sequence
  sgRNA
gggcgcacttccgtgcgcgc

SEQ ID NO: 2585 - DNA, 20 bp, Artificial Sequence
  sgRNA
gtctgcatggctatggcctc

SEQ ID NO: 2586 - DNA, 20 bp, Artificial Sequence
  sgRNA
accttattggcttgtcagaa

SEQ ID NO: 2587 - DNA, 20 bp, Artificial Sequence
  sgRNA
taggacactgctgacggtgg

SEQ ID NO: 2588 - DNA, 20 bp, Artificial Sequence
  sgRNA
ctgagaggcgtgacctgctc

SEQ ID NO: 2589 - DNA, 20 bp, Artificial Sequence
  sgRNA
tggttagaggtccagggccg

SEQ ID NO: 2590 - DNA, 20 bp, Artificial Sequence
  sgRNA
cgcacgtgacccgcagtttg

SEQ ID NO: 2591 - DNA, 20 bp, Artificial Sequence
  sgRNA
cgccatggaggccaacgctg

SEQ ID NO: 2592 - DNA, 20 bp, Artificial Sequence
  sgRNA
gtctgctttccctcagtgtg

SEQ ID NO: 2593 - DNA, 20 bp, Artificial Sequence
  sgRNA
aactaggatgaagcctttga

SEQ ID NO: 2594 - DNA, 20 bp, Artificial Sequence
  sgRNA
aagggagtgtgcggagtcta

SEQ ID NO: 2595 - DNA, 20 bp, Artificial Sequence
  sgRNA
acaacaatacactgtctctc

SEQ ID NO: 2596 - DNA, 20 bp, Artificial Sequence
  sgRNA
tagaaggtaagggaaacgcc

SEQ ID NO: 2597 - DNA, 20 bp, Artificial Sequence
  sgRNA
tctctgtctctttgctactg

SEQ ID NO: 2598 - DNA, 20 bp, Artificial Sequence
  sgRNA
gtcaaagtaagtactttcca

SEQ ID NO: 2599 - DNA, 20 bp, Artificial Sequence
  sgRNA
ggatgggcctcctgaataag

SEQ ID NO: 2600 - DNA, 20 bp, Artificial Sequence
  sgRNA
tatcagagcttgagcgagcg

SEQ ID NO: 2601 - DNA, 20 bp, Artificial Sequence
  sgRNA
atcatagggtgagttgtggg

SEQ ID NO: 2602 - DNA, 20 bp, Artificial Sequence
  sgRNA
gacgcggcggactgaacgct

SEQ ID NO: 2603 - DNA, 20 bp, Artificial Sequence
  sgRNA
ttcacatgacttgcttagcc

SEQ ID NO: 2604 - DNA, 20 bp, Artificial Sequence
  sgRNA
gggaggcctggcagcctgcc

SEQ ID NO: 2605 - DNA, 20 bp, Artificial Sequence
  sgRNA
ggtctgccacctgcatatgt

SEQ ID NO: 2606 - DNA, 20 bp, Artificial Sequence
  sgRNA
cccggctgcgggagcgggcc

SEQ ID NO: 2607 - DNA, 20 bp, Artificial Sequence
  sgRNA
cctctttctcctggatgacc

SEQ ID NO: 2608 - DNA, 20 bp, Artificial Sequence
  sgRNA
catcccaggtcaccctcgca

SEQ ID NO: 2609 - DNA, 20 bp, Artificial Sequence
  sgRNA
gaacatgacggctgtgggtg

SEQ ID NO: 2610 - DNA, 20 bp, Artificial Sequence
  sgRNA
ggatcgcatagggcgggaca

SEQ ID NO: 2611 - DNA, 20 bp, Artificial Sequence
  sgRNA
tgtgtccgctaaccctaagc

SEQ ID NO: 2612 - DNA, 20 bp, Artificial Sequence
  sgRNA
ggacagagagggtgtcagac

SEQ ID NO: 2613 - DNA, 20 bp, Artificial Sequence
  sgRNA
aaggaggctggctgaagacc

SEQ ID NO: 2614 - DNA, 20 bp, Artificial Sequence
  sgRNA
tccgaagcttgttaagaacc

SEQ ID NO: 2615 - DNA, 20 bp, Artificial Sequence
  sgRNA
ggtcatagacagtggagcag

SEQ ID NO: 2616 - DNA, 20 bp, Artificial Sequence
  sgRNA
tcacgcggaggctgtgtcag

SEQ ID NO: 2617 - DNA, 20 bp, Artificial Sequence
  sgRNA
ggccaggcatagaaagtatg

SEQ ID NO: 2618 - DNA, 20 bp, Artificial Sequence
  sgRNA
cctggaaggtagacctagag

SEQ ID NO: 2619 - DNA, 20 bp, Artificial Sequence
  sgRNA
caacctagtcttagccattt

SEQ ID NO: 2620 - DNA, 20 bp, Artificial Sequence
  sgRNA
gtttctacaagcatttctcc

SEQ ID NO: 2621 - DNA, 20 bp, Artificial Sequence
  sgRNA
ggaaacagacctcgcagcaa

SEQ ID NO: 2622 - DNA, 20 bp, Artificial Sequence
  sgRNA
cggctaagagctcccggcac

SEQ ID NO: 2623 - DNA, 20 bp, Artificial Sequence
  sgRNA
agacaggcagtcataatcat

SEQ ID NO: 2624 - DNA, 20 bp, Artificial Sequence
  sgRNA
ggcgggcagagggtacgggc

SEQ ID NO: 2625 - DNA, 20 bp, Artificial Sequence
  sgRNA
ctgggaggccctccgcgtcg

SEQ ID NO: 2626 - DNA, 20 bp, Artificial Sequence
  sgRNA
cttctagtcctagctctctc

SEQ ID NO: 2627 - DNA, 20 bp, Artificial Sequence
  sgRNA
gattggagctcgcatctccg

SEQ ID NO: 2628 - DNA, 20 bp, Artificial Sequence
  sgRNA
tggtatgacttatccttact

SEQ ID NO: 2629 - DNA, 20 bp, Artificial Sequence
  sgRNA
atgtttaagaactgcagttg

SEQ ID NO: 2630 - DNA, 20 bp, Artificial Sequence
  sgRNA
ctcccgaatacatcataatt

SEQ ID NO: 2631 - DNA, 20 bp, Artificial Sequence
  sgRNA
ctgagccagtgcacagtgaa

SEQ ID NO: 2632 - DNA, 20 bp, Artificial Sequence
  sgRNA
tgtgagactgagtgagcttg

SEQ ID NO: 2633 - DNA, 20 bp, Artificial Sequence
  sgRNA
aacattcggaactggactga

SEQ ID NO: 2634 - DNA, 20 bp, Artificial Sequence
  sgRNA
gtttgcccgaagcactctgt

SEQ ID NO: 2635 - DNA, 20 bp, Artificial Sequence
  sgRNA
ccggcgcggacgtgcgcacc

SEQ ID NO: 2636 - DNA, 20 bp, Artificial Sequence
  sgRNA
agtttgttgacactaaacac

SEQ ID NO: 2637 - DNA, 20 bp, Artificial Sequence
  sgRNA
ctaagttgtgtggttcataa

SEQ ID NO: 2638 - DNA, 20 bp, Artificial Sequence
  sgRNA
aacacagaacagcctcttgc

SEQ ID NO: 2639 - DNA, 20 bp, Artificial Sequence
  sgRNA
aaaggtcacttgagagctca

SEQ ID NO: 2640 - DNA, 20 bp, Artificial Sequence
  sgRNA
gtgtgtgaagtgcttgtgtc

SEQ ID NO: 2641 - DNA, 20 bp, Artificial Sequence
  sgRNA
aactaaactggtgttctcta

SEQ ID NO: 2642 - DNA, 20 bp, Artificial Sequence
  sgRNA
tactcagaaattatcgctgc

SEQ ID NO: 2643 - DNA, 20 bp, Artificial Sequence
  sgRNA
cagcggaccgggtttcgaaa

SEQ ID NO: 2644 - DNA, 20 bp, Artificial Sequence
  sgRNA
aagagacagcacaaagcgct

SEQ ID NO: 2645 - DNA, 20 bp, Artificial Sequence
  sgRNA
agaaagccaagagttgggtg

SEQ ID NO: 2646 - DNA, 20 bp, Artificial Sequence
  sgRNA
atgggagcatcagttgaggt

SEQ ID NO: 2647 - DNA, 20 bp, Artificial Sequence
  sgRNA
aaaggcattaacagcgtgag

SEQ ID NO: 2648 - DNA, 20 bp, Artificial Sequence
  sgRNA
cgagtgccctagccgcctgc

SEQ ID NO: 2649 - DNA, 20 bp, Artificial Sequence
  sgRNA
ggcaggccgacgcgccatgg

SEQ ID NO: 2650 - DNA, 20 bp, Artificial Sequence
  sgRNA
acttgaggagtccgtgacgc

SEQ ID NO: 2651 - DNA, 20 bp, Artificial Sequence
  sgRNA
aggcgcgaaacccgcaacct

SEQ ID NO: 2652 - DNA, 20 bp, Artificial Sequence
  sgRNA
acccgcctaagaacctcaag

SEQ ID NO: 2653 - DNA, 20 bp, Artificial Sequence
  sgRNA
gtaaggctagtttacgctag

SEQ ID NO: 2654 - DNA, 20 bp, Artificial Sequence
  sgRNA
ggaggaggagaagggtagga

SEQ ID NO: 2655 - DNA, 20 bp, Artificial Sequence
  sgRNA
gcgggataagaagtggcctg

SEQ ID NO: 2656 - DNA, 20 bp, Artificial Sequence
  sgRNA
tggagtcctttagaagaggc

SEQ ID NO: 2657 - DNA, 20 bp, Artificial Sequence
  sgRNA
gcgtgcgctgtagcgcgcag

SEQ ID NO: 2658 - DNA, 20 bp, Artificial Sequence
  sgRNA
caactgtttgttgcttcttt

SEQ ID NO: 2659 - DNA, 20 bp, Artificial Sequence
  sgRNA
agtcgtctggatcagcttga

SEQ ID NO: 2660 - DNA, 20 bp, Artificial Sequence
  sgRNA
gcacgatctcctgggattct

SEQ ID NO: 2661 - DNA, 20 bp, Artificial Sequence
  sgRNA
ttatccagcctgatcttggg

SEQ ID NO: 2662 - DNA, 20 bp, Artificial Sequence
  sgRNA
ggaagatagttccgagggtg

SEQ ID NO: 2663 - DNA, 20 bp, Artificial Sequence
  sgRNA
cacactttaacattgaggag

SEQ ID NO: 2664 - DNA, 20 bp, Artificial Sequence
  sgRNA
ttcatgttgggtttagactc

SEQ ID NO: 2665 - DNA, 20 bp, Artificial Sequence
  sgRNA
ctgcaatcccgcacgcgcgg

SEQ ID NO: 2666 - DNA, 20 bp, Artificial Sequence
  sgRNA
aggcggtgaggcgttggact

SEQ ID NO: 2667 - DNA, 20 bp, Artificial Sequence
  sgRNA
gttgtcaaggcgacatggat

SEQ ID NO: 2668 - DNA, 20 bp, Artificial Sequence
  sgRNA
cctagtctagagtggtaccg

SEQ ID NO: 2669 - DNA, 20 bp, Artificial Sequence
  sgRNA
cagtggttgccatagcgacc

SEQ ID NO: 2670 - DNA, 20 bp, Artificial Sequence
  sgRNA
ttgatggctttcaaagtgtc

SEQ ID NO: 2671 - DNA, 20 bp, Artificial Sequence
  sgRNA
atttgagaccttcccatagc

SEQ ID NO: 2672 - DNA, 20 bp, Artificial Sequence
  sgRNA
aatttgatttaaaggtgcca

SEQ ID NO: 2673 - DNA, 20 bp, Artificial Sequence
  sgRNA
ctccaataatatcaattagg

SEQ ID NO: 2674 - DNA, 20 bp, Artificial Sequence
  sgRNA
gccgcgagaaggaggcgcgc

SEQ ID NO: 2675 - DNA, 20 bp, Artificial Sequence
  sgRNA
aatttacttcattgctccac

SEQ ID NO: 2676 - DNA, 20 bp, Artificial Sequence
  sgRNA
aggccggttaagatcggagg

SEQ ID NO: 2677 - DNA, 20 bp, Artificial Sequence
  sgRNA
ctgtgagttcgagaccagtc

SEQ ID NO: 2678 - DNA, 20 bp, Artificial Sequence
  sgRNA
gtggagagaagacaagaaag

SEQ ID NO: 2679 - DNA, 20 bp, Artificial Sequence
  sgRNA
acaatgctgccgaaccggga

SEQ ID NO: 2680 - DNA, 20 bp, Artificial Sequence
  sgRNA
tggcagatgcatcccacagg

SEQ ID NO: 2681 - DNA, 20 bp, Artificial Sequence
  sgRNA
gaagagtcacgtttcggaga

SEQ ID NO: 2682 - DNA, 20 bp, Artificial Sequence
  sgRNA
aagagctcccgggaaccgcc

SEQ ID NO: 2683 - DNA, 20 bp, Artificial Sequence
  sgRNA
ccggcgatttgcaaagtgcc

SEQ ID NO: 2684 - DNA, 20 bp, Artificial Sequence
  sgRNA
gggttgacactgggaaggtc

SEQ ID NO: 2685 - DNA, 20 bp, Artificial Sequence
  sgRNA
cgagccactgcgcacacgcc

SEQ ID NO: 2686 - DNA, 20 bp, Artificial Sequence
  sgRNA
agtagactttaagcaggcgg

SEQ ID NO: 2687 - DNA, 20 bp, Artificial Sequence
  sgRNA
gctctgccagaggcgggatg

SEQ ID NO: 2688 - DNA, 20 bp, Artificial Sequence
  sgRNA
acaaccgggcaccgggagcg

SEQ ID NO: 2689 - DNA, 20 bp, Artificial Sequence
  sgRNA
tagcagacgcttacggactt

SEQ ID NO: 2690 - DNA, 20 bp, Artificial Sequence
  sgRNA
atcccgaccaatgagcgcac

SEQ ID NO: 2691 - DNA, 20 bp, Artificial Sequence
  sgRNA
ccttccgattgggcggcggt

SEQ ID NO: 2692 - DNA, 20 bp, Artificial Sequence
  sgRNA
cccgcgtgtcaccgacgcct

SEQ ID NO: 2693 - DNA, 20 bp, Artificial Sequence
  sgRNA
gccgatagaggagtggccac

SEQ ID NO: 2694 - DNA, 20 bp, Artificial Sequence
  sgRNA
gtcctggcgtaagcgaatct

SEQ ID NO: 2695 - DNA, 20 bp, Artificial Sequence
  sgRNA
tgacttcgtattatttgttg

SEQ ID NO: 2696 - DNA, 20 bp, Artificial Sequence
  sgRNA
agatggctttgcataaatgc

SEQ ID NO: 2697 - DNA, 20 bp, Artificial Sequence
  sgRNA
aaagcagcggcggcagcggt

SEQ ID NO: 2698 - DNA, 20 bp, Artificial Sequence
  sgRNA
tggtcgcgtttagtgatcac

SEQ ID NO: 2699 - DNA, 20 bp, Artificial Sequence
  sgRNA
aacacaagttgggcgcagcg

SEQ ID NO: 2700 - DNA, 20 bp, Artificial Sequence
  sgRNA
ccgatgccttgcagatgcct

SEQ ID NO: 2701 - DNA, 20 bp, Artificial Sequence
  sgRNA
cggacgtgacacgtgcggcg

SEQ ID NO: 2702 - DNA, 20 bp, Artificial Sequence
  sgRNA
acttcctgtggcgaccctgc

SEQ ID NO: 2703 - DNA, 20 bp, Artificial Sequence
  sgRNA
ttccttgggtttaagagtgt

SEQ ID NO: 2704 - DNA, 20 bp, Artificial Sequence
  sgRNA
gttctagccaggtctccata

SEQ ID NO: 2705 - DNA, 20 bp, Artificial Sequence
  sgRNA
taaacaagcccttccgctgc

SEQ ID NO: 2706 - DNA, 20 bp, Artificial Sequence
  sgRNA
gctccaccacaggtcgcctt

SEQ ID NO: 2707 - DNA, 20 bp, Artificial Sequence
  sgRNA
gggctgtgagaagacttgag

SEQ ID NO: 2708 - DNA, 20 bp, Artificial Sequence
  sgRNA
cttccagggcacatggctgg

SEQ ID NO: 2709 - DNA, 20 bp, Artificial Sequence
  sgRNA
ttgtgtctcactcgggccca

SEQ ID NO: 2710 - DNA, 20 bp, Artificial Sequence
  sgRNA
ccggcgcgtgtacgactagc

SEQ ID NO: 2711 - DNA, 20 bp, Artificial Sequence
  sgRNA
tacaggattccaggaagagt

SEQ ID NO: 2712 - DNA, 20 bp, Artificial Sequence
  sgRNA
gcttccacggaccgaccact

SEQ ID NO: 2713 - DNA, 20 bp, Artificial Sequence
  sgRNA
gtcactagttgggagggatg

SEQ ID NO: 2714 - DNA, 20 bp, Artificial Sequence
  sgRNA
catatacccgtgcggaggac

SEQ ID NO: 2715 - DNA, 20 bp, Artificial Sequence
  sgRNA
tccggaccggaaagcggaag

SEQ ID NO: 2716 - DNA, 20 bp, Artificial Sequence
  sgRNA
aagctctcccttgaacccgg

SEQ ID NO: 2717 - DNA, 20 bp, Artificial Sequence
  sgRNA
ccactgcctttcgaagttgg

SEQ ID NO: 2718 - DNA, 20 bp, Artificial Sequence
  sgRNA
gcccacggcccgcgggacaa

SEQ ID NO: 2719 - DNA, 20 bp, Artificial Sequence
  sgRNA
ccgaatgcttgatcgacagc

SEQ ID NO: 2720 - DNA, 20 bp, Artificial Sequence
  sgRNA
gagtcttcaagagagctcct

SEQ ID NO: 2721 - DNA, 20 bp, Artificial Sequence
  sgRNA
gatagcactgtcccacaatg

SEQ ID NO: 2722 - DNA, 20 bp, Artificial Sequence
  sgRNA
gtgccgtgccagttccacct

SEQ ID NO: 2723 - DNA, 20 bp, Artificial Sequence
  sgRNA
ggtagattcactcaattccc

SEQ ID NO: 2724 - DNA, 20 bp, Artificial Sequence
  sgRNA
atcacaacccagtgcgcaat

SEQ ID NO: 2725 - DNA, 20 bp, Artificial Sequence
  sgRNA
catcttgtgagatcctgcca

SEQ ID NO: 2726 - DNA, 20 bp, Artificial Sequence
  sgRNA
tcaacaacgctgagcacttc

SEQ ID NO: 2727 - DNA, 20 bp, Artificial Sequence
  sgRNA
gcgacggtggcagcttagcg

SEQ ID NO: 2728 - DNA, 20 bp, Artificial Sequence
  sgRNA
gctaggcgccaatggccacc

SEQ ID NO: 2729 - DNA, 20 bp, Artificial Sequence
  sgRNA
agcagtgaggcgcctggcga

SEQ ID NO: 2730 - DNA, 20 bp, Artificial Sequence
  sgRNA
gagcccggcgatacggccaa

SEQ ID NO: 2731 - DNA, 20 bp, Artificial Sequence
  sgRNA
gggagggtcctggcgcagat

SEQ ID NO: 2732 - DNA, 20 bp, Artificial Sequence
  sgRNA
ggcaaatacctggccacctg

SEQ ID NO: 2733 - DNA, 20 bp, Artificial Sequence
  sgRNA
ggtccttagtgtcgctggat

SEQ ID NO: 2734 - DNA, 20 bp, Artificial Sequence
  sgRNA
ctgggactctgactgacgtc

SEQ ID NO: 2735 - DNA, 20 bp, Artificial Sequence
  sgRNA
tagcccattaacctagagcc

SEQ ID NO: 2736 - DNA, 20 bp, Artificial Sequence
  sgRNA
gggccagctaggaaagattt

SEQ ID NO: 2737 - DNA, 20 bp, Artificial Sequence
  sgRNA
actccgctagaattgcagtg

SEQ ID NO: 2738 - DNA, 20 bp, Artificial Sequence
  sgRNA
cgcagggacatctggagcag

SEQ ID NO: 2739 - DNA, 20 bp, Artificial Sequence
  sgRNA
ggtctacagggcggagaccc

SEQ ID NO: 2740 - DNA, 20 bp, Artificial Sequence
  sgRNA
ccctgctttgggagtagctt

SEQ ID NO: 2741 - DNA, 20 bp, Artificial Sequence
  sgRNA
ctgagaaacatgccaaagac

SEQ ID NO: 2742 - DNA, 20 bp, Artificial Sequence
  sgRNA
acggccgtggcgttgcgacg

SEQ ID NO: 2743 - DNA, 20 bp, Artificial Sequence
  sgRNA
gtgactcggtgcccaccgcg

SEQ ID NO: 2744 - DNA, 20 bp, Artificial Sequence
  sgRNA
tgcacacgtttgatgcttga

SEQ ID NO: 2745 - DNA, 20 bp, Artificial Sequence
  sgRNA
ctcccaggtctccatcgccc

SEQ ID NO: 2746 - DNA, 20 bp, Artificial Sequence
  sgRNA
cctaaactcagaacccacca

SEQ ID NO: 2747 - DNA, 20 bp, Artificial Sequence
  sgRNA
ccgctcgccggcagggagtg

SEQ ID NO: 2748 - DNA, 20 bp, Artificial Sequence
  sgRNA
ataaggcctagacgcgtggc

SEQ ID NO: 2749 - DNA, 20 bp, Artificial Sequence
  sgRNA
cgggccaagcggctaagttc

SEQ ID NO: 2750 - DNA, 20 bp, Artificial Sequence
  sgRNA
aacatcaagtgcttgaaaga

SEQ ID NO: 2751 - DNA, 20 bp, Artificial Sequence
  sgRNA
aaggaagccacgcgactagg

SEQ ID NO: 2752 - DNA, 20 bp, Artificial Sequence
  sgRNA
tttgacctagacgcccacac

SEQ ID NO: 2753 - DNA, 20 bp, Artificial Sequence
  sgRNA
gcagccggacctcgccctcg

SEQ ID NO: 2754 - DNA, 20 bp, Artificial Sequence
  sgRNA
aggcccaattcctctacctt

SEQ ID NO: 2755 - DNA, 20 bp, Artificial Sequence
  sgRNA
ctttgcagaatagtgcgcca

SEQ ID NO: 2756 - DNA, 20 bp, Artificial Sequence
  sgRNA
gcccacctgagccgcagact

SEQ ID NO: 2757 - DNA, 20 bp, Artificial Sequence
  sgRNA
ctcccgtctgctccgacgac

SEQ ID NO: 2758 - DNA, 20 bp, Artificial Sequence
  sgRNA
ggaagagcccagagctcgct

SEQ ID NO: 2759 - DNA, 20 bp, Artificial Sequence
  sgRNA
aggagcgcaaggagcgcgcg

SEQ ID NO: 2760 - DNA, 20 bp, Artificial Sequence
  sgRNA
ttcctttgatttccgtgaaa

SEQ ID NO: 2761 - DNA, 20 bp, Artificial Sequence
  sgRNA
tggcgacctctagaggcgtt

SEQ ID NO: 2762 - DNA, 20 bp, Artificial Sequence
  sgRNA
tggcggcgattgggcaggcg

SEQ ID NO: 2763 - DNA, 20 bp, Artificial Sequence
  sgRNA
gaggatttcatctcaggact

SEQ ID NO: 2764 - DNA, 20 bp, Artificial Sequence
  sgRNA
tctcaaagttccaagggtct

SEQ ID NO: 2765 - DNA, 20 bp, Artificial Sequence
  sgRNA
aaagctgcttcaacaggcta

SEQ ID NO: 2766 - DNA, 20 bp, Artificial Sequence
  sgRNA
tcctatgaccgtaaacgcca

SEQ ID NO: 2767 - DNA, 20 bp, Artificial Sequence
  sgRNA
atccgattggtctttattga

SEQ ID NO: 2768 - DNA, 20 bp, Artificial Sequence
  sgRNA
gccaaaggccaggtgttggg

SEQ ID NO: 2769 - DNA, 20 bp, Artificial Sequence
  sgRNA
ttaactgggcaagctgggcg

SEQ ID NO: 2770 - DNA, 20 bp, Artificial Sequence
  sgRNA
agggtgttaagctgcactgt

SEQ ID NO: 2771 - DNA, 20 bp, Artificial Sequence
  sgRNA
tctgagctgtatataagtcc

SEQ ID NO: 2772 - DNA, 20 bp, Artificial Sequence
  sgRNA
ctagtctgttcttgccttgt

SEQ ID NO: 2773 - DNA, 20 bp, Artificial Sequence
  sgRNA
gctgagcttatggtggcctc

SEQ ID NO: 2774 - DNA, 20 bp, Artificial Sequence
  sgRNA
cagacgcgagagctgggcgg

SEQ ID NO: 2775 - DNA, 20 bp, Artificial Sequence
  sgRNA
tcgtgacctgcagcggacct

SEQ ID NO: 2776 - DNA, 20 bp, Artificial Sequence
  sgRNA
cgagggacccgagggctctt

SEQ ID NO: 2777 - DNA, 20 bp, Artificial Sequence
  sgRNA
gttcgtcgggtcgtgcagcc

SEQ ID NO: 2778 - DNA, 20 bp, Artificial Sequence
  sgRNA
agtacggctgccagttgtca

SEQ ID NO: 2779 - DNA, 20 bp, Artificial Sequence
  sgRNA
cagatcagcatcattcacca

SEQ ID NO: 2780 - DNA, 20 bp, Artificial Sequence
  sgRNA
ccacagcccttctcgttgcc

SEQ ID NO: 2781 - DNA, 20 bp, Artificial Sequence
  sgRNA
agtaagttatccgggaccct

SEQ ID NO: 2782 - DNA, 20 bp, Artificial Sequence
  sgRNA
gacagtgagaagcgcaaacc

SEQ ID NO: 2783 - DNA, 20 bp, Artificial Sequence
  sgRNA
attcccgaagcctaggagtc

SEQ ID NO: 2784 - DNA, 20 bp, Artificial Sequence
  sgRNA
ggagctctcttgccagtggg

SEQ ID NO: 2785 - DNA, 20 bp, Artificial Sequence
  sgRNA
tgaggaatcgactcagggtg

SEQ ID NO: 2786 - DNA, 20 bp, Artificial Sequence
  sgRNA
gggcaggaggacaatgctag

SEQ ID NO: 2787 - DNA, 20 bp, Artificial Sequence
  sgRNA
taattcacactccggtgaag

SEQ ID NO: 2788 - DNA, 20 bp, Artificial Sequence
  sgRNA
atggttggaagctgggttga

SEQ ID NO: 2789 - DNA, 20 bp, Artificial Sequence
  sgRNA
agcccaggacacagcaaagg

SEQ ID NO: 2790 - DNA, 20 bp, Artificial Sequence
  sgRNA
ccttctctcctaccaatcag

SEQ ID NO: 2791 - DNA, 20 bp, Artificial Sequence
  sgRNA
ttgtcgccgtcaggcacagc

SEQ ID NO: 2792 - DNA, 20 bp, Artificial Sequence
  sgRNA
aaccattctagaatgtctgg

SEQ ID NO: 2793 - DNA, 20 bp, Artificial Sequence
  sgRNA
gtacagggagaacattagca

SEQ ID NO: 2794 - DNA, 20 bp, Artificial Sequence
  sgRNA
agtcccgctgtacctaaagg

SEQ ID NO: 2795 - DNA, 20 bp, Artificial Sequence
  sgRNA
tcggtctgagggccgcggcc

SEQ ID NO: 2796 - DNA, 20 bp, Artificial Sequence
  sgRNA
ccagtccaggcgcgcaactc

SEQ ID NO: 2797 - DNA, 20 bp, Artificial Sequence
  sgRNA
acctagtttactgtggttgg

SEQ ID NO: 2798 - DNA, 20 bp, Artificial Sequence
  sgRNA
ggtgacccgcaaggcatagg

SEQ ID NO: 2799 - DNA, 20 bp, Artificial Sequence
  sgRNA
gttattaggaccaattaaga

SEQ ID NO: 2800 - DNA, 20 bp, Artificial Sequence
  sgRNA
aaagaaaggcaagagaagag

SEQ ID NO: 2801 - DNA, 20 bp, Artificial Sequence
  sgRNA
gagagtgagcctgttctgtg

SEQ ID NO: 2802 - DNA, 20 bp, Artificial Sequence
  sgRNA
atttaggtctcaggtgggac

SEQ ID NO: 2803 - DNA, 20 bp, Artificial Sequence
  sgRNA
tgcgctcgaggccttgaggc

SEQ ID NO: 2804 - DNA, 20 bp, Artificial Sequence
  sgRNA
agtagcgtcgtagctctctc

SEQ ID NO: 2805 - DNA, 20 bp, Artificial Sequence
  sgRNA
agatatttcatcttactgca

SEQ ID NO: 2806 - DNA, 20 bp, Artificial Sequence
  sgRNA
ccctcggctttacgactttc

SEQ ID NO: 2807 - DNA, 20 bp, Artificial Sequence
  sgRNA
gagacaaccattaagagtca

SEQ ID NO: 2808 - DNA, 20 bp, Artificial Sequence
  sgRNA
aagtggagtgagggctgtgt

SEQ ID NO: 2809 - DNA, 20 bp, Artificial Sequence
  sgRNA
gggcacttccgaggccgctc

SEQ ID NO: 2810 - DNA, 20 bp, Artificial Sequence
  sgRNA
gcgcgcggagggatccgccg

SEQ ID NO: 2811 - DNA, 20 bp, Artificial Sequence
  sgRNA
tggtcgccttagcaccatct

SEQ ID NO: 2812 - DNA, 20 bp, Artificial Sequence
  sgRNA
tgtgggcgggaggccgagtg

SEQ ID NO: 2813 - DNA, 20 bp, Artificial Sequence
  sgRNA
gagcctgagctcaaacgtcg

SEQ ID NO: 2814 - DNA, 20 bp, Artificial Sequence
  sgRNA
aaagagtgtcacttgctgga

SEQ ID NO: 2815 - DNA, 20 bp, Artificial Sequence
  sgRNA
tgcccgggtcgaggtcgggt

SEQ ID NO: 2816 - DNA, 20 bp, Artificial Sequence
  sgRNA
tagcattgctgcatcttctc

SEQ ID NO: 2817 - DNA, 20 bp, Artificial Sequence
  sgRNA
gtcattagttgtcagggagc

SEQ ID NO: 2818 - DNA, 20 bp, Artificial Sequence
  sgRNA
caaatcagacgcatgcgctt

SEQ ID NO: 2819 - DNA, 20 bp, Artificial Sequence
  sgRNA
ccgcctcctgctcttgtgat

SEQ ID NO: 2820 - DNA, 20 bp, Artificial Sequence
  sgRNA
gcaaagacgctgcggcttgc

SEQ ID NO: 2821 - DNA, 20 bp, Artificial Sequence
  sgRNA
gaatgaatcagctacatata

SEQ ID NO: 2822 - DNA, 20 bp, Artificial Sequence
  sgRNA
tagcggatgggcgggctcta

SEQ ID NO: 2823 - DNA, 20 bp, Artificial Sequence
  sgRNA
tcatttcaaaggctgaccct

SEQ ID NO: 2824 - DNA, 20 bp, Artificial Sequence
  sgRNA
ccctgcactatattcccgcc

SEQ ID NO: 2825 - DNA, 20 bp, Artificial Sequence
  sgRNA
ggtttactagaactagaccc

SEQ ID NO: 2826 - DNA, 20 bp, Artificial Sequence
  sgRNA
aaactgctgttgctcgccgc

SEQ ID NO: 2827 - DNA, 20 bp, Artificial Sequence
  sgRNA
ccctgcacagtgcctaggac

SEQ ID NO: 2828 - DNA, 20 bp, Artificial Sequence
  sgRNA
ggaggaaataggagggaggg

SEQ ID NO: 2829 - DNA, 20 bp, Artificial Sequence
  sgRNA
ataaggacattaaagaagga

SEQ ID NO: 2830 - DNA, 20 bp, Artificial Sequence
  sgRNA
ggagcttgggcgaagctttg

SEQ ID NO: 2831 - DNA, 20 bp, Artificial Sequence
  sgRNA
gctggaaagtgctgcgtccc

SEQ ID NO: 2832 - DNA, 20 bp, Artificial Sequence
  sgRNA
cgtcagcagtgatcgtgccg

SEQ ID NO: 2833 - DNA, 20 bp, Artificial Sequence
  sgRNA
gttaagggcggcaatgtggg

SEQ ID NO: 2834 - DNA, 20 bp, Artificial Sequence
  sgRNA
gagatatggtgtaagcacgc

SEQ ID NO: 2835 - DNA, 20 bp, Artificial Sequence
  sgRNA
cctagaaggaatgctaacag

SEQ ID NO: 2836 - DNA, 20 bp, Artificial Sequence
  sgRNA
gggtttgggagatactgagt

SEQ ID NO: 2837 - DNA, 20 bp, Artificial Sequence
  sgRNA
ggccaattccttcttagctg

SEQ ID NO: 2838 - DNA, 20 bp, Artificial Sequence
  sgRNA
ggtcacagggagcccgactg

SEQ ID NO: 2839 - DNA, 20 bp, Artificial Sequence
  sgRNA
ttgccggagccgcctcgagg

SEQ ID NO: 2840 - DNA, 20 bp, Artificial Sequence
  sgRNA
aagaacaaggaggagagtaa

SEQ ID NO: 2841 - DNA, 20 bp, Artificial Sequence
  sgRNA
ggaattgtgatataaggcat

SEQ ID NO: 2842 - DNA, 20 bp, Artificial Sequence
  sgRNA
cactggaccagagttgggcg

SEQ ID NO: 2843 - DNA, 20 bp, Artificial Sequence
  sgRNA
tttgggtacaattatctaca

SEQ ID NO: 2844 - DNA, 20 bp, Artificial Sequence
  sgRNA
aaacacttgaaggtgtggcc

SEQ ID NO: 2845 - DNA, 20 bp, Artificial Sequence
  sgRNA
actggacgcgcctgtacgtg

SEQ ID NO: 2846 - DNA, 20 bp, Artificial Sequence
  sgRNA
gggtcagcccggcgtggcgt

SEQ ID NO: 2847 - DNA, 20 bp, Artificial Sequence
  sgRNA
gctgacgctgctattagtct

SEQ ID NO: 2848 - DNA, 20 bp, Artificial Sequence
  sgRNA
gcagatagcgcaggcggctt

SEQ ID NO: 2849 - DNA, 20 bp, Artificial Sequence
  sgRNA
ggcgcagaccgtgtcttacc

SEQ ID NO: 2850 - DNA, 20 bp, Artificial Sequence
  sgRNA
gtagtgcagagcccatgctc

SEQ ID NO: 2851 - DNA, 20 bp, Artificial Sequence
  sgRNA
cgggcccagctgacacttat

SEQ ID NO: 2852 - DNA, 20 bp, Artificial Sequence
  sgRNA
tttgaacagctggtacccag

SEQ ID NO: 2853 - DNA, 20 bp, Artificial Sequence
  sgRNA
agaccaacgcacgcggaaga

SEQ ID NO: 2854 - DNA, 20 bp, Artificial Sequence
  sgRNA
aggaatgcggagccgggaag

SEQ ID NO: 2855 - DNA, 20 bp, Artificial Sequence
  sgRNA
gaagtgcatagagactgagg

SEQ ID NO: 2856 - DNA, 20 bp, Artificial Sequence
  sgRNA
ggcacctcccatgcagtggg

SEQ ID NO: 2857 - DNA, 20 bp, Artificial Sequence
  sgRNA
tagaaagacttgctccaccc

SEQ ID NO: 2858 - DNA, 20 bp, Artificial Sequence
  sgRNA
gtgacgtttaagactctgat

SEQ ID NO: 2859 - DNA, 20 bp, Artificial Sequence
  sgRNA
gagcagagtaccctgggacg

SEQ ID NO: 2860 - DNA, 20 bp, Artificial Sequence
  sgRNA
gggacgtgggtgcgggtttg

SEQ ID NO: 2861 - DNA, 20 bp, Artificial Sequence
  sgRNA
cgcttcctccctgtgatgaa

SEQ ID NO: 2862 - DNA, 20 bp, Artificial Sequence
  sgRNA
cgggagagcatttatcagcc

SEQ ID NO: 2863 - DNA, 20 bp, Artificial Sequence
  sgRNA
tctgcggagcgggctgtgct

SEQ ID NO: 2864 - DNA, 20 bp, Artificial Sequence
  sgRNA
ccaagacgggaggaaagcct

SEQ ID NO: 2865 - DNA, 20 bp, Artificial Sequence
  sgRNA
ggtggatgaaactagccttg

SEQ ID NO: 2866 - DNA, 20 bp, Artificial Sequence
  sgRNA
ccctctataccaggttgtga

SEQ ID NO: 2867 - DNA, 20 bp, Artificial Sequence
  sgRNA
ggtcctgcaggaagccctgt

SEQ ID NO: 2868 - DNA, 20 bp, Artificial Sequence
  sgRNA
atattgtcacctacagtcaa

SEQ ID NO: 2869 - DNA, 20 bp, Artificial Sequence
  sgRNA
gcagggcgaccgcccatccg

SEQ ID NO: 2870 - DNA, 20 bp, Artificial Sequence
  sgRNA
ggagacgcgatcgtgagaag

SEQ ID NO: 2871 - DNA, 20 bp, Artificial Sequence
  sgRNA
gatggccgcagatttgaatt

SEQ ID NO: 2872 - DNA, 20 bp, Artificial Sequence
  sgRNA
tttagtctcgcagaggtcaa

SEQ ID NO: 2873 - DNA, 20 bp, Artificial Sequence
  sgRNA
gagtagtttaaggaatgagg

SEQ ID NO: 2874 - DNA, 20 bp, Artificial Sequence
  sgRNA
ccgtgcctttctcgggcctt

SEQ ID NO: 2875 - DNA, 20 bp, Artificial Sequence
  sgRNA
gtttcacagctgaatgatgc

SEQ ID NO: 2876 - DNA, 20 bp, Artificial Sequence
  sgRNA
tgggaggactgccgaggcgg

SEQ ID NO: 2877 - DNA, 20 bp, Artificial Sequence
  sgRNA
caaagccgaaggtcggcctc

SEQ ID NO: 2878 - DNA, 20 bp, Artificial Sequence
  sgRNA
ccggctcctctccggacttc

SEQ ID NO: 2879 - DNA, 20 bp, Artificial Sequence
  sgRNA
ttgctgagacctccgcttcc

SEQ ID NO: 2880 - DNA, 20 bp, Artificial Sequence
  sgRNA
ccacgtgaccgccgatcttc

SEQ ID NO: 2881 - DNA, 20 bp, Artificial Sequence
  sgRNA
aaatgtctaacctcggagaa

SEQ ID NO: 2882 - DNA, 20 bp, Artificial Sequence
  sgRNA
tgccattccgagtgagaagc

SEQ ID NO: 2883 - DNA, 20 bp, Artificial Sequence
  sgRNA
gcacttcctgtagttggagc

SEQ ID NO: 2884 - DNA, 20 bp, Artificial Sequence
  sgRNA
aagacatttacaagtctaag

SEQ ID NO: 2885 - DNA, 20 bp, Artificial Sequence
  sgRNA
ttgcctgcggccgccctggc

SEQ ID NO: 2886 - DNA, 20 bp, Artificial Sequence
  sgRNA
gggagtgggcatgcttcacc

SEQ ID NO: 2887 - DNA, 20 bp, Artificial Sequence
  sgRNA
agctcaggaatgtggcggcg

SEQ ID NO: 2888 - DNA, 20 bp, Artificial Sequence
  sgRNA
atgccggagcttctggcccg

SEQ ID NO: 2889 - DNA, 20 bp, Artificial Sequence
  sgRNA
atcatcagattgctaaggaa

SEQ ID NO: 2890 - DNA, 20 bp, Artificial Sequence
  sgRNA
tttaaggtctaatgcagaag

SEQ ID NO: 2891 - DNA, 20 bp, Artificial Sequence
  sgRNA
cactaactttgctcaaattc

SEQ ID NO: 2892 - DNA, 20 bp, Artificial Sequence
  sgRNA
acagtagccttcaaatgaaa

SEQ ID NO: 2893 - DNA, 20 bp, Artificial Sequence
  sgRNA
aaactcctgacgtcactcca

SEQ ID NO: 2894 - DNA, 20 bp, Artificial Sequence
  sgRNA
ctctggctcagggatgttca

SEQ ID NO: 2895 - DNA, 20 bp, Artificial Sequence
  sgRNA
gaagaatgggttaatgaccc

SEQ ID NO: 2896 - DNA, 20 bp, Artificial Sequence
  sgRNA
ctttaaagaaccttgggata

SEQ ID NO: 2897 - DNA, 20 bp, Artificial Sequence
  sgRNA
gcgtcactcaacaggtctgt

SEQ ID NO: 2898 - DNA, 20 bp, Artificial Sequence
  sgRNA
aataggacagtgatagttaa

SEQ ID NO: 2899 - DNA, 20 bp, Artificial Sequence
  sgRNA
gggcaaagattgcctgagcc

SEQ ID NO: 2900 - DNA, 20 bp, Artificial Sequence
  sgRNA
cccgttccgacagaacccag

SEQ ID NO: 2901 - DNA, 20 bp, Artificial Sequence
  sgRNA
atactccagctcataacatt

SEQ ID NO: 2902 - DNA, 20 bp, Artificial Sequence
  sgRNA
tgacttgatgttactaacgc

SEQ ID NO: 2903 - DNA, 20 bp, Artificial Sequence
  sgRNA
tgtcgacttgtagagctggg

SEQ ID NO: 2904 - DNA, 20 bp, Artificial Sequence
  sgRNA
ggtcccaggcaaatgtcggg

SEQ ID NO: 2905 - DNA, 20 bp, Artificial Sequence
  sgRNA
acagagactcatatttacct

SEQ ID NO: 2906 - DNA, 20 bp, Artificial Sequence
  sgRNA
aattacaacagtctcaggaa

SEQ ID NO: 2907 - DNA, 20 bp, Artificial Sequence
  sgRNA
gcgcatcactggcctgcagg

SEQ ID NO: 2908 - DNA, 20 bp, Artificial Sequence
  sgRNA
cccgcaagccagcttgtgtg

SEQ ID NO: 2909 - DNA, 20 bp, Artificial Sequence
  sgRNA
ggcgagcgagggaacgaaat

SEQ ID NO: 2910 - DNA, 20 bp, Artificial Sequence
  sgRNA
cgcccatgacgcaccctctc

SEQ ID NO: 2911 - DNA, 20 bp, Artificial Sequence
  sgRNA
ctagcattgtgtcttctctt

SEQ ID NO: 2912 - DNA, 20 bp, Artificial Sequence
  sgRNA
ctcaacatcagaacctcgcg

SEQ ID NO: 2913 - DNA, 20 bp, Artificial Sequence
  sgRNA
taattatagacgcatttgcg

SEQ ID NO: 2914 - DNA, 20 bp, Artificial Sequence
  sgRNA
gggaaagtccagcaacgaca

SEQ ID NO: 2915 - DNA, 20 bp, Artificial Sequence
  sgRNA
gaacttgggcgccacgttcc

SEQ ID NO: 2916 - DNA, 20 bp, Artificial Sequence
  sgRNA
tggacgggcgacggccctag

SEQ ID NO: 2917 - DNA, 20 bp, Artificial Sequence
  sgRNA
tgtgctccggcgggcagcgg

SEQ ID NO: 2918 - DNA, 20 bp, Artificial Sequence
  sgRNA
ggacattggcgaaggcgtga

SEQ ID NO: 2919 - DNA, 20 bp, Artificial Sequence
  sgRNA
gacacgatgagtggaggcgt

SEQ ID NO: 2920 - DNA, 20 bp, Artificial Sequence
  sgRNA
ataactgtggaggaggcttc

SEQ ID NO: 2921 - DNA, 20 bp, Artificial Sequence
  sgRNA
cgagagtctgcgattctggc

SEQ ID NO: 2922 - DNA, 20 bp, Artificial Sequence
  sgRNA
ggcagcatggcctgtccgtc

SEQ ID NO: 2923 - DNA, 20 bp, Artificial Sequence
  sgRNA
agtactttatatttagccac

SEQ ID NO: 2924 - DNA, 20 bp, Artificial Sequence
  sgRNA
gctacagccgccgagcgtcg

SEQ ID NO: 2925 - DNA, 20 bp, Artificial Sequence
  sgRNA
gggacttgcggtaggacgca

SEQ ID NO: 2926 - DNA, 20 bp, Artificial Sequence
  sgRNA
ctctgttgggcgtgttgcct

SEQ ID NO: 2927 - DNA, 20 bp, Artificial Sequence
  sgRNA
ggtgtttcttccctatcgtg

SEQ ID NO: 2928 - DNA, 20 bp, Artificial Sequence
  sgRNA
ctgtcttcatcctccaatcg

SEQ ID NO: 2929 - DNA, 20 bp, Artificial Sequence
  sgRNA
tggagactttgaggttatct

SEQ ID NO: 2930 - DNA, 20 bp, Artificial Sequence
  sgRNA
ggaaacaaggtttcttctcc

SEQ ID NO: 2931 - DNA, 20 bp, Artificial Sequence
  sgRNA
ggcgcgtgacgcaaagcggc

SEQ ID NO: 2932 - DNA, 20 bp, Artificial Sequence
  sgRNA
tgtcaggccatgaaatgccc

SEQ ID NO: 2933 - DNA, 20 bp, Artificial Sequence
  sgRNA
aagatgttgcggagacttaa

SEQ ID NO: 2934 - DNA, 20 bp, Artificial Sequence
  sgRNA
atgcggtgcgggacagcctc

SEQ ID NO: 2935 - DNA, 20 bp, Artificial Sequence
  sgRNA
ggtgatttagacggattgcc

SEQ ID NO: 2936 - DNA, 20 bp, Artificial Sequence
  sgRNA
agcaagacagatagccatct

SEQ ID NO: 2937 - DNA, 20 bp, Artificial Sequence
  sgRNA
gtggccaatcagctgttcgc

SEQ ID NO: 2938 - DNA, 20 bp, Artificial Sequence
  sgRNA
cggcgggaaagcgccgctca

SEQ ID NO: 2939 - DNA, 20 bp, Artificial Sequence
  sgRNA
cgggcaccacctcgtaacaa

SEQ ID NO: 2940 - DNA, 20 bp, Artificial Sequence
  sgRNA
ttcaggtggagccagatgtc

SEQ ID NO: 2941 - DNA, 20 bp, Artificial Sequence
  sgRNA
agaactgaagagaggagaaa

SEQ ID NO: 2942 - DNA, 20 bp, Artificial Sequence
  sgRNA
tgtggagctggaaggtgcgg

SEQ ID NO: 2943 - DNA, 20 bp, Artificial Sequence
  sgRNA
agtggcggcccggctggcag

SEQ ID NO: 2944 - DNA, 20 bp, Artificial Sequence
  sgRNA
cgtagagggacgggtgatct

SEQ ID NO: 2945 - DNA, 20 bp, Artificial Sequence
  sgRNA
gccacgcccaagctgtccac

SEQ ID NO: 2946 - DNA, 20 bp, Artificial Sequence
  sgRNA
gaatggagcggcacgtgacc

SEQ ID NO: 2947 - DNA, 20 bp, Artificial Sequence
  sgRNA
aggattacaagggatagcct

SEQ ID NO: 2948 - DNA, 20 bp, Artificial Sequence
  sgRNA
catgcgcaggccgcccggct

SEQ ID NO: 2949 - DNA, 20 bp, Artificial Sequence
  sgRNA
cttagcttatctgtgccttt

SEQ ID NO: 2950 - DNA, 20 bp, Artificial Sequence
  sgRNA
ctgtcttatgctaaagaagg

SEQ ID NO: 2951 - DNA, 20 bp, Artificial Sequence
  sgRNA
cacagttcacagtgctgttc

SEQ ID NO: 2952 - DNA, 20 bp, Artificial Sequence
  sgRNA
tctagtttaccttctcctct

SEQ ID NO: 2953 - DNA, 20 bp, Artificial Sequence
  sgRNA
tgccattagcccacgcaagg

SEQ ID NO: 2954 - DNA, 20 bp, Artificial Sequence
  sgRNA
cctccaggcgcagctaaaga

SEQ ID NO: 2955 - DNA, 20 bp, Artificial Sequence
  sgRNA
ccgcatgcaaagaatagctg

SEQ ID NO: 2956 - DNA, 20 bp, Artificial Sequence
  sgRNA
tcagcctcacctcaatatgg

SEQ ID NO: 2957 - DNA, 20 bp, Artificial Sequence
  sgRNA
tagtgttgctgtctctttaa

SEQ ID NO: 2958 - DNA, 20 bp, Artificial Sequence
  sgRNA
aggaatgaatggccatcagg

SEQ ID NO: 2959 - DNA, 20 bp, Artificial Sequence
  sgRNA
tagaatgtggtacaggcgac

SEQ ID NO: 2960 - DNA, 20 bp, Artificial Sequence
  sgRNA
tgccaactgctgagagaccc

SEQ ID NO: 2961 - DNA, 20 bp, Artificial Sequence
  sgRNA
gtgggtgagcaagctggagt

SEQ ID NO: 2962 - DNA, 20 bp, Artificial Sequence
  sgRNA
gtgaccatttctccaagtaa

SEQ ID NO: 2963 - DNA, 20 bp, Artificial Sequence
  sgRNA
ttaattcctgacccgttagc

SEQ ID NO: 2964 - DNA, 20 bp, Artificial Sequence
  sgRNA
acaaagagtgggtaggcaga

SEQ ID NO: 2965 - DNA, 20 bp, Artificial Sequence
  sgRNA
ggcaccagctctgagctgga

SEQ ID NO: 2966 - DNA, 20 bp, Artificial Sequence
  sgRNA
tccagtagttacagttacga

SEQ ID NO: 2967 - DNA, 20 bp, Artificial Sequence
  sgRNA
tgcagaactggagtaaaccg

SEQ ID NO: 2968 - DNA, 20 bp, Artificial Sequence
  sgRNA
cggaaagtcctggcaggacg

SEQ ID NO: 2969 - DNA, 20 bp, Artificial Sequence
  sgRNA
ggaggaggagggccaggaga

SEQ ID NO: 2970 - DNA, 20 bp, Artificial Sequence
  sgRNA
tcaggataagagttgtagct

SEQ ID NO: 2971 - DNA, 20 bp, Artificial Sequence
  sgRNA
ctccggcgcgctgtccgctg

SEQ ID NO: 2972 - DNA, 20 bp, Artificial Sequence
  sgRNA
ttcacttgagttcaaactcc

SEQ ID NO: 2973 - DNA, 20 bp, Artificial Sequence
  sgRNA
ggctccacgtgggcgcaccc

SEQ ID NO: 2974 - DNA, 20 bp, Artificial Sequence
  sgRNA
ggtgctcgcgcgttgccttt

SEQ ID NO: 2975 - DNA, 20 bp, Artificial Sequence
  sgRNA
acgatctgtgggcgggcacg

SEQ ID NO: 2976 - DNA, 20 bp, Artificial Sequence
  sgRNA
taaacattaagcattaccct

SEQ ID NO: 2977 - DNA, 20 bp, Artificial Sequence
  sgRNA
acacacacacacgcgtcctt

SEQ ID NO: 2978 - DNA, 20 bp, Artificial Sequence
  sgRNA
ctacactggagtgcgttgcc

SEQ ID NO: 2979 - DNA, 20 bp, Artificial Sequence
  sgRNA
ttcggctgtagcagggcttg

SEQ ID NO: 2980 - DNA, 20 bp, Artificial Sequence
  sgRNA
aggcttgagaaactgtgtac

SEQ ID NO: 2981 - DNA, 20 bp, Artificial Sequence
  sgRNA
cagcagggaaggactcgggt

SEQ ID NO: 2982 - DNA, 20 bp, Artificial Sequence
  sgRNA
tgtggtgctacaccttctgc

SEQ ID NO: 2983 - DNA, 20 bp, Artificial Sequence
  sgRNA
gagtcggtaccgacggaggg

SEQ ID NO: 2984 - DNA, 20 bp, Artificial Sequence
  sgRNA
ccagtcagcctgactgcttt

SEQ ID NO: 2985 - DNA, 20 bp, Artificial Sequence
  sgRNA
acatttgccgggcaggcagg

SEQ ID NO: 2986 - DNA, 20 bp, Artificial Sequence
  sgRNA
gccagatgtttggcaacctg

SEQ ID NO: 2987 - DNA, 20 bp, Artificial Sequence
  sgRNA
tctggtctctgttgttgtag

SEQ ID NO: 2988 - DNA, 20 bp, Artificial Sequence
  sgRNA
tagaggtgaggtgtccatca

SEQ ID NO: 2989 - DNA, 20 bp, Artificial Sequence
  sgRNA
ctgccacggttggtcgcgcc

SEQ ID NO: 2990 - DNA, 20 bp, Artificial Sequence
  sgRNA
gcctcaaggcgcctacactc

SEQ ID NO: 2991 - DNA, 20 bp, Artificial Sequence
  sgRNA
caacagggctccaccgcttc

SEQ ID NO: 2992 - DNA, 20 bp, Artificial Sequence
  sgRNA
tgatcacctgctccagcacc

SEQ ID NO: 2993 - DNA, 20 bp, Artificial Sequence
  sgRNA
cactccttccacactcagat

SEQ ID NO: 2994 - DNA, 20 bp, Artificial Sequence
  sgRNA
gtcagcatgatctccagacc

SEQ ID NO: 2995 - DNA, 20 bp, Artificial Sequence
  sgRNA
aggtatgtcagtgtggatgt

SEQ ID NO: 2996 - DNA, 20 bp, Artificial Sequence
  sgRNA
gctagctaggaaaggaggcg

SEQ ID NO: 2997 - DNA, 20 bp, Artificial Sequence
  sgRNA
gtgaatagtggcagaggaga

SEQ ID NO: 2998 - DNA, 20 bp, Artificial Sequence
  sgRNA
tgttggacaccgacatcgaa

SEQ ID NO: 2999 - DNA, 20 bp, Artificial Sequence
  sgRNA
ctgagaaccttctccggcag

SEQ ID NO: 3000 - DNA, 20 bp, Artificial Sequence
  sgRNA
ttggctcattgaccatccag

SEQ ID NO: 3001 - DNA, 20 bp, Artificial Sequence
  sgRNA
aggtccacgtcaatccctcc

SEQ ID NO: 3002 - DNA, 20 bp, Artificial Sequence
  sgRNA
ggcggacacaaagcctcccg

SEQ ID NO: 3003 - DNA, 20 bp, Artificial Sequence
  sgRNA
agcggaataacggcagaagg

SEQ ID NO: 3004 - DNA, 20 bp, Artificial Sequence
  sgRNA
gcgctccgagcgctcagccc

SEQ ID NO: 3005 - DNA, 20 bp, Artificial Sequence
  sgRNA
cccaacaaagcagagaccag

SEQ ID NO: 3006 - DNA, 20 bp, Artificial Sequence
  sgRNA
cgactggcaattcgctccgg

SEQ ID NO: 3007 - DNA, 20 bp, Artificial Sequence
  sgRNA
acgtcacttccggcaacaat

SEQ ID NO: 3008 - DNA, 20 bp, Artificial Sequence
  sgRNA
tgacgcgagcgggcttccgg

SEQ ID NO: 3009 - DNA, 20 bp, Artificial Sequence
  sgRNA
aaggacagaggtagttcagt

SEQ ID NO: 3010 - DNA, 20 bp, Artificial Sequence
  sgRNA
ctgctgtactgggaagtggg

SEQ ID NO: 3011 - DNA, 20 bp, Artificial Sequence
  sgRNA
atcaaatcagtttagtagag

SEQ ID NO: 3012 - DNA, 20 bp, Artificial Sequence
  sgRNA
gcagggcatgacctagtacc

SEQ ID NO: 3013 - DNA, 20 bp, Artificial Sequence
  sgRNA
tcaggcgcgtggaacgttta

SEQ ID NO: 3014 - DNA, 20 bp, Artificial Sequence
  sgRNA
gggcctgaggcaggagtgcg

SEQ ID NO: 3015 - DNA, 20 bp, Artificial Sequence
  sgRNA
gcggtgccgcgggctctcta

SEQ ID NO: 3016 - DNA, 20 bp, Artificial Sequence
  sgRNA
ggcagcaggcgggcctgcgc

SEQ ID NO: 3017 - DNA, 20 bp, Artificial Sequence
  sgRNA
gggacagagctgctcgctag

SEQ ID NO: 3018 - DNA, 20 bp, Artificial Sequence
  sgRNA
cgcagtagtcccttcggctg

SEQ ID NO: 3019 - DNA, 20 bp, Artificial Sequence
  sgRNA
gctactcaagtgtgtgcagc

SEQ ID NO: 3020 - DNA, 20 bp, Artificial Sequence
  sgRNA
tgaaggaaggcagtccgcac

SEQ ID NO: 3021 - DNA, 20 bp, Artificial Sequence
  sgRNA
ggtctgagttgggcccgaga

SEQ ID NO: 3022 - DNA, 20 bp, Artificial Sequence
  sgRNA
ggtcagggccacgacagaga

SEQ ID NO: 3023 - DNA, 20 bp, Artificial Sequence
  sgRNA
gtgctacgcgggtccggcgg

SEQ ID NO: 3024 - DNA, 20 bp, Artificial Sequence
  sgRNA
ctctgcgtcgctagcgctcc

SEQ ID NO: 3025 - DNA, 20 bp, Artificial Sequence
  sgRNA
atcatgttcgaagtggcgtg

SEQ ID NO: 3026 - DNA, 20 bp, Artificial Sequence
  sgRNA
ggatgggctgaaataattgc

SEQ ID NO: 3027 - DNA, 20 bp, Artificial Sequence
  sgRNA
agccgttccctcggagctaa

SEQ ID NO: 3028 - DNA, 20 bp, Artificial Sequence
  sgRNA
actcaagacatcatgcagta

SEQ ID NO: 3029 - DNA, 20 bp, Artificial Sequence
  sgRNA
ctttacaaaccactctgcct

SEQ ID NO: 3030 - DNA, 20 bp, Artificial Sequence
  sgRNA
gtgtcacatgactctggcac

SEQ ID NO: 3031 - DNA, 20 bp, Artificial Sequence
  sgRNA
cctcagtataaagtccagcc

SEQ ID NO: 3032 - DNA, 20 bp, Artificial Sequence
  sgRNA
ctcctttcacttcgggcgag

SEQ ID NO: 3033 - DNA, 20 bp, Artificial Sequence
  sgRNA
catgttaagaattacagtac

SEQ ID NO: 3034 - DNA, 20 bp, Artificial Sequence
  sgRNA
tcagagtttccctgtgaccc

SEQ ID NO: 3035 - DNA, 20 bp, Artificial Sequence
  sgRNA
tgagatcagctgaagcccta

SEQ ID NO: 3036 - DNA, 20 bp, Artificial Sequence
  sgRNA
tgcttcgcgtgagcgccctc

SEQ ID NO: 3037 - DNA, 20 bp, Artificial Sequence
  sgRNA
tggatttattgagaagggtc

SEQ ID NO: 3038 - DNA, 20 bp, Artificial Sequence
  sgRNA
ttgagagctgggtggaagcc

SEQ ID NO: 3039 - DNA, 20 bp, Artificial Sequence
  sgRNA
agaatttgaattgcaaatcc

SEQ ID NO: 3040 - DNA, 20 bp, Artificial Sequence
  sgRNA
atctcaacggccagcccggc

SEQ ID NO: 3041 - DNA, 20 bp, Artificial Sequence
  sgRNA
gttcgcgacgacgtcatcac

SEQ ID NO: 3042 - DNA, 20 bp, Artificial Sequence
  sgRNA
gctgtgccgcgggcaactcc

SEQ ID NO: 3043 - DNA, 20 bp, Artificial Sequence
  sgRNA
tatggatgtttgtcatgcca

SEQ ID NO: 3044 - DNA, 20 bp, Artificial Sequence
  sgRNA
gtctaggagaagccaatgtg

SEQ ID NO: 3045 - DNA, 20 bp, Artificial Sequence
  sgRNA
tgggcagcccgagaccggcc

SEQ ID NO: 3046 - DNA, 20 bp, Artificial Sequence
  sgRNA
ctgaaaccaccaatcgcgac

SEQ ID NO: 3047 - DNA, 20 bp, Artificial Sequence
  sgRNA
gggctctgaaagactaagaa

SEQ ID NO: 3048 - DNA, 20 bp, Artificial Sequence
  sgRNA
aatctggcttcttggtaagg

SEQ ID NO: 3049 - DNA, 20 bp, Artificial Sequence
  sgRNA
tcagagcccgcgtccattcc

SEQ ID NO: 3050 - DNA, 20 bp, Artificial Sequence
  sgRNA
tccagctgcctggcgctctc

SEQ ID NO: 3051 - DNA, 20 bp, Artificial Sequence
  sgRNA
ctgttctctctcccgggagg

SEQ ID NO: 3052 - DNA, 20 bp, Artificial Sequence
  sgRNA
cccttgcaacctctttcgct

SEQ ID NO: 3053 - DNA, 20 bp, Artificial Sequence
  sgRNA
tggttcgttagagagcctct

SEQ ID NO: 3054 - DNA, 20 bp, Artificial Sequence
  sgRNA
ttcttcgcgagactccgcct

SEQ ID NO: 3055 - DNA, 20 bp, Artificial Sequence
  sgRNA
cggccggtagctggaagagc

SEQ ID NO: 3056 - DNA, 20 bp, Artificial Sequence
  sgRNA
ctccgagccactggagcctt

SEQ ID NO: 3057 - DNA, 20 bp, Artificial Sequence
  sgRNA
gagagatggatagcaagcaa

SEQ ID NO: 3058 - DNA, 20 bp, Artificial Sequence
  sgRNA
agttagggcgccgcgggagc

SEQ ID NO: 3059 - DNA, 20 bp, Artificial Sequence
  sgRNA
gtattccctggaaggtgaca

SEQ ID NO: 3060 - DNA, 20 bp, Artificial Sequence
  sgRNA
ctacgaagcctccactcttc

SEQ ID NO: 3061 - DNA, 20 bp, Artificial Sequence
  sgRNA
gggtcgagacgtcggcccga

SEQ ID NO: 3062 - DNA, 20 bp, Artificial Sequence
  sgRNA
tggaaacaagttcacatttc

SEQ ID NO: 3063 - DNA, 20 bp, Artificial Sequence
  sgRNA
cgccggcctctaggtctggc

SEQ ID NO: 3064 - DNA, 20 bp, Artificial Sequence
  sgRNA
ataggtcctttagaacaatt

SEQ ID NO: 3065 - DNA, 20 bp, Artificial Sequence
  sgRNA
cccggcggcggcgacggtgg

SEQ ID NO: 3066 - DNA, 20 bp, Artificial Sequence
  sgRNA
cgaagacgcttccgggagct

SEQ ID NO: 3067 - DNA, 20 bp, Artificial Sequence
  sgRNA
ggctggagcgtgagtgcgag

SEQ ID NO: 3068 - DNA, 20 bp, Artificial Sequence
  sgRNA
atgtatgaggaagaatgaca

SEQ ID NO: 3069 - DNA, 20 bp, Artificial Sequence
  sgRNA
cgggaaccgccatcaggagg

SEQ ID NO: 3070 - DNA, 20 bp, Artificial Sequence
  sgRNA
ccacgaagaatagccctagg

SEQ ID NO: 3071 - DNA, 20 bp, Artificial Sequence
  sgRNA
actcgagggacctcccagtc

SEQ ID NO: 3072 - DNA, 20 bp, Artificial Sequence
  sgRNA
ggcgttctgtcaatctcaac

SEQ ID NO: 3073 - DNA, 20 bp, Artificial Sequence
  sgRNA
atgccctgtcagtgacctgc

SEQ ID NO: 3074 - DNA, 20 bp, Artificial Sequence
  sgRNA
agcctgaagcaagtcccgcg

SEQ ID NO: 3075 - DNA, 20 bp, Artificial Sequence
  sgRNA
attgcacgagcgtctcccgc

SEQ ID NO: 3076 - DNA, 20 bp, Artificial Sequence
  sgRNA
ggctagggaggcgcgttccc

SEQ ID NO: 3077 - DNA, 20 bp, Artificial Sequence
  sgRNA
agaagcctggaggagagaag

SEQ ID NO: 3078 - DNA, 20 bp, Artificial Sequence
  sgRNA
acagttgctgctaactgccc

SEQ ID NO: 3079 - DNA, 20 bp, Artificial Sequence
  sgRNA
ggagaaaggaggatccaagc

SEQ ID NO: 3080 - DNA, 20 bp, Artificial Sequence
  sgRNA
acaagatctgttctgcctcg

SEQ ID NO: 3081 - DNA, 20 bp, Artificial Sequence
  sgRNA
gctgtacttacaaaggagag

SEQ ID NO: 3082 - DNA, 20 bp, Artificial Sequence
  sgRNA
aaacattcttcgcgacacaa

SEQ ID NO: 3083 - DNA, 20 bp, Artificial Sequence
  sgRNA
ctagtgacgtgagccgtgcc

SEQ ID NO: 3084 - DNA, 20 bp, Artificial Sequence
  sgRNA
cgcgtgctcgtggccaccgt

SEQ ID NO: 3085 - DNA, 20 bp, Artificial Sequence
  sgRNA
aggagcatgtcgggaataac

SEQ ID NO: 3086 - DNA, 20 bp, Artificial Sequence
  sgRNA
taagaagagggaaagggttc

SEQ ID NO: 3087 - DNA, 20 bp, Artificial Sequence
  sgRNA
ggaacaatgtttcaagactg

SEQ ID NO: 3088 - DNA, 20 bp, Artificial Sequence
  sgRNA
ctgcaagcgtttcgaagacc

SEQ ID NO: 3089 - DNA, 20 bp, Artificial Sequence
  sgRNA
aagaggccgcctgcctggca

SEQ ID NO: 3090 - DNA, 20 bp, Artificial Sequence
  sgRNA
tacttggatctcctggttca

SEQ ID NO: 3091 - DNA, 20 bp, Artificial Sequence
  sgRNA
gcactagaaacccgagaacg

SEQ ID NO: 3092 - DNA, 20 bp, Artificial Sequence
  sgRNA
gtttcctgcagagcaagcaa

SEQ ID NO: 3093 - DNA, 20 bp, Artificial Sequence
  sgRNA
ccgaggagccaatcagaggg

SEQ ID NO: 3094 - DNA, 20 bp, Artificial Sequence
  sgRNA
gggtgggctctgcaccgtgg

SEQ ID NO: 3095 - DNA, 20 bp, Artificial Sequence
  sgRNA
ggagctagagaaagaaccca

SEQ ID NO: 3096 - DNA, 20 bp, Artificial Sequence
  sgRNA
ctgccaggagcttccggcgc

SEQ ID NO: 3097 - DNA, 20 bp, Artificial Sequence
  sgRNA
agcccggatcgcatagaccc

SEQ ID NO: 3098 - DNA, 20 bp, Artificial Sequence
  sgRNA
ggaggtcctgggtaggacag

SEQ ID NO: 3099 - DNA, 20 bp, Artificial Sequence
  sgRNA
tcaggatgaccaatgtcaac

SEQ ID NO: 3100 - DNA, 20 bp, Artificial Sequence
  sgRNA
gcagccctgcccagattaag

SEQ ID NO: 3101 - DNA, 20 bp, Artificial Sequence
  sgRNA
tggaagaatcgctcactcgg

SEQ ID NO: 3102 - DNA, 20 bp, Artificial Sequence
  sgRNA
gataggtgtcggtctataaa

SEQ ID NO: 3103 - DNA, 20 bp, Artificial Sequence
  sgRNA
gttctcccgcggctcgcaca

SEQ ID NO: 3104 - DNA, 20 bp, Artificial Sequence
  sgRNA
ctggtatgtagtggatgccc

SEQ ID NO: 3105 - DNA, 20 bp, Artificial Sequence
  sgRNA
cgctttaggcgcgccaatgt

SEQ ID NO: 3106 - DNA, 20 bp, Artificial Sequence
  sgRNA
gaaatggtgcagggagtcta

SEQ ID NO: 3107 - DNA, 20 bp, Artificial Sequence
  sgRNA
agagtgcgagggcgaccagg

SEQ ID NO: 3108 - DNA, 20 bp, Artificial Sequence
  sgRNA
gcggaatgatgctcaaagct

SEQ ID NO: 3109 - DNA, 20 bp, Artificial Sequence
  sgRNA
gatatccaaatagttgtttg

SEQ ID NO: 3110 - DNA, 20 bp, Artificial Sequence
  sgRNA
ccaggccacggagcagggcg

SEQ ID NO: 3111 - DNA, 20 bp, Artificial Sequence
  sgRNA
tctcaggctcatccgacaca

SEQ ID NO: 3112 - DNA, 20 bp, Artificial Sequence
  sgRNA
ggaacgatgatgaggagctg

SEQ ID NO: 3113 - DNA, 20 bp, Artificial Sequence
  sgRNA
taatgctcagatctgataag

SEQ ID NO: 3114 - DNA, 20 bp, Artificial Sequence
  sgRNA
agaactagccctggtgaagt

SEQ ID NO: 3115 - DNA, 20 bp, Artificial Sequence
  sgRNA
tcaatgctcctccttcacgt

SEQ ID NO: 3116 - DNA, 20 bp, Artificial Sequence
  sgRNA
gggcgggacctgacaggctt

SEQ ID NO: 3117 - DNA, 20 bp, Artificial Sequence
  sgRNA
tccgaagctgctggagtcac

SEQ ID NO: 3118 - DNA, 20 bp, Artificial Sequence
  sgRNA
gcgcaggaaggaggtgccgc

SEQ ID NO: 3119 - DNA, 20 bp, Artificial Sequence
  sgRNA
ttgggacatggattggacaa

SEQ ID NO: 3120 - DNA, 20 bp, Artificial Sequence
  sgRNA
acgagcatccttgcatctgc

SEQ ID NO: 3121 - DNA, 20 bp, Artificial Sequence
  sgRNA
cggaatcacggtcgtgggcg

SEQ ID NO: 3122 - DNA, 20 bp, Artificial Sequence
  sgRNA
gggaatcacttgtgtagctc

SEQ ID NO: 3123 - DNA, 20 bp, Artificial Sequence
  sgRNA
ctcctctggccataaatggg

SEQ ID NO: 3124 - DNA, 20 bp, Artificial Sequence
  sgRNA
aagtccaataatccctctat

SEQ ID NO: 3125 - DNA, 20 bp, Artificial Sequence
  sgRNA
tcacccatctgagtccttca

SEQ ID NO: 3126 - DNA, 20 bp, Artificial Sequence
  sgRNA
cgaggaggcccggcagcgtg

SEQ ID NO: 3127 - DNA, 20 bp, Artificial Sequence
  sgRNA
tacccatgaacacaggccac

SEQ ID NO: 3128 - DNA, 20 bp, Artificial Sequence
  sgRNA
gttaacgattggcgagatct

SEQ ID NO: 3129 - DNA, 20 bp, Artificial Sequence
  sgRNA
gagaccatatttgttcacag

SEQ ID NO: 3130 - DNA, 20 bp, Artificial Sequence
  sgRNA
gaatgggtcgggagacacgg

SEQ ID NO: 3131 - DNA, 20 bp, Artificial Sequence
  sgRNA
gcgcctggcttacgaataat

SEQ ID NO: 3132 - DNA, 20 bp, Artificial Sequence
  sgRNA
ctgacccacgtgggccggtt

SEQ ID NO: 3133 - DNA, 20 bp, Artificial Sequence
  sgRNA
aatgagccaagagagagtgc

SEQ ID NO: 3134 - DNA, 20 bp, Artificial Sequence
  sgRNA
gggacgtctccttctgtttg

SEQ ID NO: 3135 - DNA, 20 bp, Artificial Sequence
  sgRNA
atgcccaacttactgaaagt

SEQ ID NO: 3136 - DNA, 20 bp, Artificial Sequence
  sgRNA
actcgtggagctgagccgcc

SEQ ID NO: 3137 - DNA, 20 bp, Artificial Sequence
  sgRNA
gtcagaacatcaaaggatgg

SEQ ID NO: 3138 - DNA, 20 bp, Artificial Sequence
  sgRNA
tcagccctctcacgctccgg

SEQ ID NO: 3139 - DNA, 20 bp, Artificial Sequence
  sgRNA
cagccacaatgaagtaccca

SEQ ID NO: 3140 - DNA, 20 bp, Artificial Sequence
  sgRNA
gctgtgactcatggcgttcc

SEQ ID NO: 3141 - DNA, 20 bp, Artificial Sequence
  sgRNA
cctggcccgctgtgccttgc

SEQ ID NO: 3142 - DNA, 20 bp, Artificial Sequence
  sgRNA
gttgctaagcaacatttaga

SEQ ID NO: 3143 - DNA, 20 bp, Artificial Sequence
  sgRNA
atacggtctcgtgggccgat

SEQ ID NO: 3144 - DNA, 20 bp, Artificial Sequence
  sgRNA
ttgggctagagcggaagtgg

SEQ ID NO: 3145 - DNA, 20 bp, Artificial Sequence
  sgRNA
cttgttaaggttacaagtcc

SEQ ID NO: 3146 - DNA, 20 bp, Artificial Sequence
  sgRNA
gacttcacgttctctaggct

SEQ ID NO: 3147 - DNA, 20 bp, Artificial Sequence
  sgRNA
agtttcactctggcgtacaa

SEQ ID NO: 3148 - DNA, 20 bp, Artificial Sequence
  sgRNA
gttgtaaggagcaagattta

SEQ ID NO: 3149 - DNA, 20 bp, Artificial Sequence
  sgRNA
cctttcacaccggaacctga

SEQ ID NO: 3150 - DNA, 20 bp, Artificial Sequence
  sgRNA
tacagcaagctatggctgag

SEQ ID NO: 3151 - DNA, 20 bp, Artificial Sequence
  sgRNA
agcatgcgcagaacagccgg

SEQ ID NO: 3152 - DNA, 20 bp, Artificial Sequence
  sgRNA
ttcagattgtactctgtacg

SEQ ID NO: 3153 - DNA, 20 bp, Artificial Sequence
  sgRNA
tgtgccgaccttgagcgccc

SEQ ID NO: 3154 - DNA, 20 bp, Artificial Sequence
  sgRNA
gacgtcatgctcagtgcccg

SEQ ID NO: 3155 - DNA, 20 bp, Artificial Sequence
  sgRNA
aaagattatggtaagcatgc

SEQ ID NO: 3156 - DNA, 20 bp, Artificial Sequence
  sgRNA
gttaaaggtcaatctaagca

SEQ ID NO: 3157 - DNA, 20 bp, Artificial Sequence
  sgRNA
tgtagaagagactcaggcct

SEQ ID NO: 3158 - DNA, 20 bp, Artificial Sequence
  sgRNA
cccacgccacgccctataag

SEQ ID NO: 3159 - DNA, 20 bp, Artificial Sequence
  sgRNA
cagaagccagaacccgtgtc

SEQ ID NO: 3160 - DNA, 20 bp, Artificial Sequence
  sgRNA
gcatacttcgagcattcctt

SEQ ID NO: 3161 - DNA, 20 bp, Artificial Sequence
  sgRNA
ggcatctgtctcctgactaa

SEQ ID NO: 3162 - DNA, 20 bp, Artificial Sequence
  sgRNA
gctgcgttgcgtctgccttc

SEQ ID NO: 3163 - DNA, 20 bp, Artificial Sequence
  sgRNA
aaccacatgctttctgcctc

SEQ ID NO: 3164 - DNA, 20 bp, Artificial Sequence
  sgRNA
attggtcgagagcgatgcgg

SEQ ID NO: 3165 - DNA, 20 bp, Artificial Sequence
  sgRNA
caggagagcccatccgccag

SEQ ID NO: 3166 - DNA, 20 bp, Artificial Sequence
  sgRNA
catggacagaggcgccaccc

SEQ ID NO: 3167 - DNA, 20 bp, Artificial Sequence
  sgRNA
tggctggctgtacgtgagaa

SEQ ID NO: 3168 - DNA, 20 bp, Artificial Sequence
  sgRNA
actccgaggaccaatcggtg

SEQ ID NO: 3169 - DNA, 20 bp, Artificial Sequence
  sgRNA
actagtgctatctttaagac

SEQ ID NO: 3170 - DNA, 20 bp, Artificial Sequence
  sgRNA
gacgagcgctgcgccagcga

SEQ ID NO: 3171 - DNA, 20 bp, Artificial Sequence
  sgRNA
ctagggtagagcgggagctg

SEQ ID NO: 3172 - DNA, 20 bp, Artificial Sequence
  sgRNA
ctctgaagccaggcagattg

SEQ ID NO: 3173 - DNA, 20 bp, Artificial Sequence
  sgRNA
cctgacggcagtcgaaacac

SEQ ID NO: 3174 - DNA, 20 bp, Artificial Sequence
  sgRNA
atagagttcgagaggacgtc

SEQ ID NO: 3175 - DNA, 20 bp, Artificial Sequence
  sgRNA
caaactgctggcgagtcaag

SEQ ID NO: 3176 - DNA, 20 bp, Artificial Sequence
  sgRNA
tgctccctgggtcaagcagg

SEQ ID NO: 3177 - DNA, 20 bp, Artificial Sequence
  sgRNA
agacagtaacacccatcttc

SEQ ID NO: 3178 - DNA, 20 bp, Artificial Sequence
  sgRNA
aatcaaagcacatcaagagc

SEQ ID NO: 3179 - DNA, 20 bp, Artificial Sequence
  sgRNA
ggcgcgcaaagagtgaccgc

SEQ ID NO: 3180 - DNA, 20 bp, Artificial Sequence
  sgRNA
gggaggacagcatttagctc

SEQ ID NO: 3181 - DNA, 20 bp, Artificial Sequence
  sgRNA
gtccctgacacttcctttcc

SEQ ID NO: 3182 - DNA, 20 bp, Artificial Sequence
  sgRNA
gttgctccgtcctcctgaaa

SEQ ID NO: 3183 - DNA, 20 bp, Artificial Sequence
  sgRNA
atgaaagggcgagcccacgc

SEQ ID NO: 3184 - DNA, 20 bp, Artificial Sequence
  sgRNA
tcctaggatgttacacttgg

SEQ ID NO: 3185 - DNA, 20 bp, Artificial Sequence
  sgRNA
gctgactcccggcgcgttgg

SEQ ID NO: 3186 - DNA, 20 bp, Artificial Sequence
  sgRNA
aaccacagaaccacaaggcc

SEQ ID NO: 3187 - DNA, 20 bp, Artificial Sequence
  sgRNA
gtacatctattacgttcgtc

SEQ ID NO: 3188 - DNA, 20 bp, Artificial Sequence
  sgRNA
ctggtctctcactatgtact

SEQ ID NO: 3189 - DNA, 20 bp, Artificial Sequence
  sgRNA
gtgggacaaagaactacttc

SEQ ID NO: 3190 - DNA, 20 bp, Artificial Sequence
  sgRNA
ctcacacttatgccctggtc

SEQ ID NO: 3191 - DNA, 20 bp, Artificial Sequence
  sgRNA
acggcgccgctatgcactgt

SEQ ID NO: 3192 - DNA, 20 bp, Artificial Sequence
  sgRNA
ccaatgcagaactttgcatc

SEQ ID NO: 3193 - DNA, 20 bp, Artificial Sequence
  sgRNA
aggagtggaaggtggcgaca

SEQ ID NO: 3194 - DNA, 20 bp, Artificial Sequence
  sgRNA
gcgccgtagtcgccgtgagt

SEQ ID NO: 3195 - DNA, 20 bp, Artificial Sequence
  sgRNA
tattagcgtgcacttcacaa

SEQ ID NO: 3196 - DNA, 20 bp, Artificial Sequence
  sgRNA
gcctgtgggaagggccgacc

SEQ ID NO: 3197 - DNA, 20 bp, Artificial Sequence
  sgRNA
ggagtcgctgtggaaataca

SEQ ID NO: 3198 - DNA, 20 bp, Artificial Sequence
  sgRNA
gttaacccgaagttaactgg

SEQ ID NO: 3199 - DNA, 20 bp, Artificial Sequence
  sgRNA
ccgcaaaggttggccacgtg

SEQ ID NO: 3200 - DNA, 20 bp, Artificial Sequence
  sgRNA
atcatctcacgaaacaaatt

SEQ ID NO: 3201 - DNA, 20 bp, Artificial Sequence
  sgRNA
acgaggcccaactcattccc

SEQ ID NO: 3202 - DNA, 20 bp, Artificial Sequence
  sgRNA
tttcagcgcaccatgtgccg

SEQ ID NO: 3203 - DNA, 20 bp, Artificial Sequence
  sgRNA
ggccggcgactctgagtatc

SEQ ID NO: 3204 - DNA, 20 bp, Artificial Sequence
  sgRNA
ggatgttctgagaggctcag

SEQ ID NO: 3205 - DNA, 20 bp, Artificial Sequence
  sgRNA
cccggcgccggagcgagaag

SEQ ID NO: 3206 - DNA, 20 bp, Artificial Sequence
  sgRNA
tttgtgaaggtctgtgggcg

SEQ ID NO: 3207 - DNA, 20 bp, Artificial Sequence
  sgRNA
tggctggccgctcgaggtgg

SEQ ID NO: 3208 - DNA, 20 bp, Artificial Sequence
  sgRNA
gtactagctgcgggtgctgc

SEQ ID NO: 3209 - DNA, 20 bp, Artificial Sequence
  sgRNA
gcatctgtgtgactgtgttg

SEQ ID NO: 3210 - DNA, 20 bp, Artificial Sequence
  sgRNA
ggctgcaagtcaccagactg

SEQ ID NO: 3211 - DNA, 20 bp, Artificial Sequence
  sgRNA
cccgccgaagtggtgcgggt

SEQ ID NO: 3212 - DNA, 20 bp, Artificial Sequence
  sgRNA
atacacagtacccattaccc

SEQ ID NO: 3213 - DNA, 20 bp, Artificial Sequence
  sgRNA
ggcagcgaaatggtatttcc

SEQ ID NO: 3214 - DNA, 20 bp, Artificial Sequence
  sgRNA
gaaacagtacttccggcctc

SEQ ID NO: 3215 - DNA, 20 bp, Artificial Sequence
  sgRNA
ggtggaggaggcccacctgt

SEQ ID NO: 3216 - DNA, 20 bp, Artificial Sequence
  sgRNA
aggaactgggtgttgagata

SEQ ID NO: 3217 - DNA, 20 bp, Artificial Sequence
  sgRNA
agtcgggcgtggctcgaaag

SEQ ID NO: 3218 - DNA, 20 bp, Artificial Sequence
  sgRNA
ccagacccggagttaaaggg

SEQ ID NO: 3219 - DNA, 20 bp, Artificial Sequence
  sgRNA
gcaaggtaaatgcaaacaac

SEQ ID NO: 3220 - DNA, 20 bp, Artificial Sequence
  sgRNA
gggacgacccaggagtgaag

SEQ ID NO: 3221 - DNA, 20 bp, Artificial Sequence
  sgRNA
ctcccagaagctttaagttt

SEQ ID NO: 3222 - DNA, 20 bp, Artificial Sequence
  sgRNA
attaggagtgagtgctgcgc

SEQ ID NO: 3223 - DNA, 20 bp, Artificial Sequence
  sgRNA
ctaggtaagtggatggtgag

SEQ ID NO: 3224 - DNA, 20 bp, Artificial Sequence
  sgRNA
aggacagcagaagcaggagc

SEQ ID NO: 3225 - DNA, 20 bp, Artificial Sequence
  sgRNA
tgacactatagtgagctgca

SEQ ID NO: 3226 - DNA, 20 bp, Artificial Sequence
  sgRNA
gagtggctgtgtcggttgtg

SEQ ID NO: 3227 - DNA, 20 bp, Artificial Sequence
  sgRNA
acctgcaacttgccaggttt

SEQ ID NO: 3228 - DNA, 20 bp, Artificial Sequence
  sgRNA
gagcgctgggcaggtgatgg

SEQ ID NO: 3229 - DNA, 20 bp, Artificial Sequence
  sgRNA
attctagagaagctttaggg

SEQ ID NO: 3230 - DNA, 20 bp, Artificial Sequence
  sgRNA
gataactacggctatgcagt

SEQ ID NO: 3231 - DNA, 20 bp, Artificial Sequence
  sgRNA
tttatggtaaggcgcgcgcg

SEQ ID NO: 3232 - DNA, 20 bp, Artificial Sequence
  sgRNA
aagttggaaggtatctccgt

SEQ ID NO: 3233 - DNA, 20 bp, Artificial Sequence
  sgRNA
gaaagaagcacctttaccat

SEQ ID NO: 3234 - DNA, 20 bp, Artificial Sequence
  sgRNA
tgaattcggagtgctcgtgg

SEQ ID NO: 3235 - DNA, 20 bp, Artificial Sequence
  sgRNA
gggaggagctgaagtcgccg

SEQ ID NO: 3236 - DNA, 20 bp, Artificial Sequence
  sgRNA
gagagtgaggtgagtgttgc

SEQ ID NO: 3237 - DNA, 20 bp, Artificial Sequence
  sgRNA
tctcaaccaatcacagaaca

SEQ ID NO: 3238 - DNA, 20 bp, Artificial Sequence
  sgRNA
atgctgccattatgataacg

SEQ ID NO: 3239 - DNA, 20 bp, Artificial Sequence
  sgRNA
cttcctgtggcgaccctgcg

SEQ ID NO: 3240 - DNA, 20 bp, Artificial Sequence
  sgRNA
aaggaaccagattagtgtgc

SEQ ID NO: 3241 - DNA, 20 bp, Artificial Sequence
  sgRNA
cagtgtatcacaggcagagg

SEQ ID NO: 3242 - DNA, 20 bp, Artificial Sequence
  sgRNA
agagagcactgtgcaatcaa

SEQ ID NO: 3243 - DNA, 20 bp, Artificial Sequence
  sgRNA
aaatgtctataaccgatacc

SEQ ID NO: 3244 - DNA, 20 bp, Artificial Sequence
  sgRNA
ctactcctaacctgaaagtc

SEQ ID NO: 3245 - DNA, 20 bp, Artificial Sequence
  sgRNA
gagctcggtttcgaggtcct

SEQ ID NO: 3246 - DNA, 20 bp, Artificial Sequence
  sgRNA
tgtgcccgcctgccaccgcc

SEQ ID NO: 3247 - DNA, 20 bp, Artificial Sequence
  sgRNA
tagagcacccacaccacaga

SEQ ID NO: 3248 - DNA, 20 bp, Artificial Sequence
  sgRNA
gaatgtgcgtatgttataaa

SEQ ID NO: 3249 - DNA, 20 bp, Artificial Sequence
  sgRNA
tgctctggcttggacgaagg

SEQ ID NO: 3250 - DNA, 20 bp, Artificial Sequence
  sgRNA
gggccaaggaagggttaacg

SEQ ID NO: 3251 - DNA, 20 bp, Artificial Sequence
  sgRNA
ggcggctgcggcgctgacac

SEQ ID NO: 3252 - DNA, 20 bp, Artificial Sequence
  sgRNA
cctcggctctgaacaaggcc

SEQ ID NO: 3253 - DNA, 20 bp, Artificial Sequence
  sgRNA
acgagattcagcgttcagta

SEQ ID NO: 3254 - DNA, 20 bp, Artificial Sequence
  sgRNA
gctcgcgcctgattggatga

SEQ ID NO: 3255 - DNA, 20 bp, Artificial Sequence
  sgRNA
agagccgagacgcttaagaa

SEQ ID NO: 3256 - DNA, 20 bp, Artificial Sequence
  sgRNA
acatgacctcacagttagtc

SEQ ID NO: 3257 - DNA, 20 bp, Artificial Sequence
  sgRNA
ccagatcacccagcaggtat

SEQ ID NO: 3258 - DNA, 20 bp, Artificial Sequence
  sgRNA
ttaacattaagatcaaaggc

SEQ ID NO: 3259 - DNA, 20 bp, Artificial Sequence
  sgRNA
gtctccctggtctctcggag

SEQ ID NO: 3260 - DNA, 20 bp, Artificial Sequence
  sgRNA
gctgcaagcagccatttcag

SEQ ID NO: 3261 - DNA, 20 bp, Artificial Sequence
  sgRNA
caaacgttctgtatagggat

SEQ ID NO: 3262 - DNA, 20 bp, Artificial Sequence
  sgRNA
cggaagaccgctcggaaagg

SEQ ID NO: 3263 - DNA, 20 bp, Artificial Sequence
  sgRNA
ggctccttcctcccgcccat

SEQ ID NO: 3264 - DNA, 20 bp, Artificial Sequence
  sgRNA
ctagattaacagtactaacg

SEQ ID NO: 3265 - DNA, 20 bp, Artificial Sequence
  sgRNA
caaatgtcatggctcttcat

SEQ ID NO: 3266 - DNA, 20 bp, Artificial Sequence
  sgRNA
gaccagggaagccggaatcc

SEQ ID NO: 3267 - DNA, 20 bp, Artificial Sequence
  sgRNA
ggataggatagacagatggc

SEQ ID NO: 3268 - DNA, 20 bp, Artificial Sequence
  sgRNA
atgaggattgcctagttgag

SEQ ID NO: 3269 - DNA, 20 bp, Artificial Sequence
  sgRNA
actcgcccacctttcacctt

SEQ ID NO: 3270 - DNA, 20 bp, Artificial Sequence
  sgRNA
cctctggatcgcttgctccc

SEQ ID NO: 3271 - DNA, 20 bp, Artificial Sequence
  sgRNA
ttatctaatccctagaaagc

SEQ ID NO: 3272 - DNA, 20 bp, Artificial Sequence
  sgRNA
gtgacaaagagaatcattgc

SEQ ID NO: 3273 - DNA, 20 bp, Artificial Sequence
  sgRNA
gggcgcgcgcaggctttgtc

SEQ ID NO: 3274 - DNA, 20 bp, Artificial Sequence
  sgRNA
cagtgacaattccggccagt

SEQ ID NO: 3275 - DNA, 20 bp, Artificial Sequence
  sgRNA
ctctgttagtgatcactatt

SEQ ID NO: 3276 - DNA, 20 bp, Artificial Sequence
  sgRNA
catacacctgaggagctact

SEQ ID NO: 3277 - DNA, 20 bp, Artificial Sequence
  sgRNA
gagagagatggaaactaaga

SEQ ID NO: 3278 - DNA, 20 bp, Artificial Sequence
  sgRNA
cggagcctagctaccagtgg

SEQ ID NO: 3279 - DNA, 20 bp, Artificial Sequence
  sgRNA
ggagccagcagcgcgctgtc

SEQ ID NO: 3280 - DNA, 20 bp, Artificial Sequence
  sgRNA
actcctacagaactttctga

SEQ ID NO: 3281 - DNA, 20 bp, Artificial Sequence
  sgRNA
cggtgaaggaggtctacttt

SEQ ID NO: 3282 - DNA, 20 bp, Artificial Sequence
  sgRNA
gcggcattcctaaggtgggt

SEQ ID NO: 3283 - DNA, 20 bp, Artificial Sequence
  sgRNA
cagtcttctcaggctgttct

SEQ ID NO: 3284 - DNA, 20 bp, Artificial Sequence
  sgRNA
actagggtcgatcgtattgt

SEQ ID NO: 3285 - DNA, 20 bp, Artificial Sequence
  sgRNA
agcagggtattctgggaggc

SEQ ID NO: 3286 - DNA, 20 bp, Artificial Sequence
  sgRNA
gggactcttaaatcggcgcc

SEQ ID NO: 3287 - DNA, 20 bp, Artificial Sequence
  sgRNA
aactaacattggtctgtctg

SEQ ID NO: 3288 - DNA, 20 bp, Artificial Sequence
  sgRNA
cgcgcaatgctcaccgtccg

SEQ ID NO: 3289 - DNA, 20 bp, Artificial Sequence
  sgRNA
ggtttgaactcggaactggg

SEQ ID NO: 3290 - DNA, 20 bp, Artificial Sequence
  sgRNA
tagaatgtctgggtggaaca

SEQ ID NO: 3291 - DNA, 20 bp, Artificial Sequence
  sgRNA
cgggtaccgcgagactcgcg

SEQ ID NO: 3292 - DNA, 20 bp, Artificial Sequence
  sgRNA
ggcggtcctggagtcgctcg

SEQ ID NO: 3293 - DNA, 20 bp, Artificial Sequence
  sgRNA
ctgcgcgcgcgctctagatc

SEQ ID NO: 3294 - DNA, 20 bp, Artificial Sequence
  sgRNA
ggatacttgtaaatcttgag

SEQ ID NO: 3295 - DNA, 20 bp, Artificial Sequence
  sgRNA
aaactggaggaagtaaaggg

SEQ ID NO: 3296 - DNA, 20 bp, Artificial Sequence
  sgRNA
gcgggaccatagagagcccg

SEQ ID NO: 3297 - DNA, 20 bp, Artificial Sequence
  sgRNA
aagcaagatggccgcaccgg

SEQ ID NO: 3298 - DNA, 20 bp, Artificial Sequence
  sgRNA
attggtccctgcatgcgacc

SEQ ID NO: 3299 - DNA, 20 bp, Artificial Sequence
  sgRNA
tcgaaagttactagtgggaa

SEQ ID NO: 3300 - DNA, 20 bp, Artificial Sequence
  sgRNA
aggatgtgttacctagtgcg

SEQ ID NO: 3301 - DNA, 20 bp, Artificial Sequence
  sgRNA
agactctcccgcttgattgg

SEQ ID NO: 3302 - DNA, 20 bp, Artificial Sequence
  sgRNA
gcttagctgctggaactagg

SEQ ID NO: 3303 - DNA, 20 bp, Artificial Sequence
  sgRNA
gggtgtaccggacgaattgc

SEQ ID NO: 3304 - DNA, 20 bp, Artificial Sequence
  sgRNA
aaaccttgcctgagcactag

SEQ ID NO: 3305 - DNA, 20 bp, Artificial Sequence
  sgRNA
gcgaggccagcacggctctg

SEQ ID NO: 3306 - DNA, 20 bp, Artificial Sequence
  sgRNA
gcgagccaagcacttagcgc

SEQ ID NO: 3307 - DNA, 20 bp, Artificial Sequence
  sgRNA
atagaccatggcctgtgacg

SEQ ID NO: 3308 - DNA, 20 bp, Artificial Sequence
  sgRNA
tgtttgaagacccagggcac

SEQ ID NO: 3309 - DNA, 20 bp, Artificial Sequence
  sgRNA
caaacagcagtaggacgcta

SEQ ID NO: 3310 - DNA, 20 bp, Artificial Sequence
  sgRNA
ttcccagaaggttctagtcc

SEQ ID NO: 3311 - DNA, 20 bp, Artificial Sequence
  sgRNA
ctgggcaagtatctttagcc

SEQ ID NO: 3312 - DNA, 20 bp, Artificial Sequence
  sgRNA
actgtcaagagctgtcatga

SEQ ID NO: 3313 - DNA, 20 bp, Artificial Sequence
  sgRNA
aggagtatatgtttaagcag

SEQ ID NO: 3314 - DNA, 20 bp, Artificial Sequence
  sgRNA
caactgtgctcctgtaccca

SEQ ID NO: 3315 - DNA, 20 bp, Artificial Sequence
  sgRNA
ttgttgagagaccatatgaa

SEQ ID NO: 3316 - DNA, 20 bp, Artificial Sequence
  sgRNA
ttaacccatgctggatttgc

SEQ ID NO: 3317 - DNA, 20 bp, Artificial Sequence
  sgRNA
acgttagcaactatcaaacc

SEQ ID NO: 3318 - DNA, 20 bp, Artificial Sequence
  sgRNA
agagcaaggcgtcgcacaaa

SEQ ID NO: 3319 - DNA, 20 bp, Artificial Sequence
  sgRNA
ggagctgtcggccgcatttg

SEQ ID NO: 3320 - DNA, 20 bp, Artificial Sequence
  sgRNA
gcagtgtgagatgtgtcagg

SEQ ID NO: 3321 - DNA, 20 bp, Artificial Sequence
  sgRNA
gagctgcggagggtcagtct

SEQ ID NO: 3322 - DNA, 20 bp, Artificial Sequence
  sgRNA
tgagtcctaaatccctgaga

SEQ ID NO: 3323 - DNA, 20 bp, Artificial Sequence
  sgRNA
tggatgcaattcatctgaat

SEQ ID NO: 3324 - DNA, 20 bp, Artificial Sequence
  sgRNA
gggcggtagaaaggacgcgg

SEQ ID NO: 3325 - DNA, 20 bp, Artificial Sequence
  sgRNA
ggacacggccgcctcgcgga

SEQ ID NO: 3326 - DNA, 20 bp, Artificial Sequence
  sgRNA
acgtcaggcggcgtcacgcg

SEQ ID NO: 3327 - DNA, 20 bp, Artificial Sequence
  sgRNA
tgactttgcgagcgcttccc

SEQ ID NO: 3328 - DNA, 20 bp, Artificial Sequence
  sgRNA
gttatgcaagctcagactgc

SEQ ID NO: 3329 - DNA, 20 bp, Artificial Sequence
  sgRNA
gaagcctctgcgcaggcgag

SEQ ID NO: 3330 - DNA, 20 bp, Artificial Sequence
  sgRNA
ggccatattgcgcagggagg

SEQ ID NO: 3331 - DNA, 20 bp, Artificial Sequence
  sgRNA
gcgaagggctgccaagtgag

SEQ ID NO: 3332 - DNA, 20 bp, Artificial Sequence
  sgRNA
ggcgcacaaaggaagcgcgc

SEQ ID NO: 3333 - DNA, 20 bp, Artificial Sequence
  sgRNA
gtaatttcatccttatctcc

SEQ ID NO: 3334 - DNA, 20 bp, Artificial Sequence
  sgRNA
aactgccttgcaatccaatc

SEQ ID NO: 3335 - DNA, 20 bp, Artificial Sequence
  sgRNA
aatgagctacctggatgttg

SEQ ID NO: 3336 - DNA, 20 bp, Artificial Sequence
  sgRNA
cccgccgggaacgcgtcctg

SEQ ID NO: 3337 - DNA, 20 bp, Artificial Sequence
  sgRNA
accggtttaaagagatagag

SEQ ID NO: 3338 - DNA, 20 bp, Artificial Sequence
  sgRNA
ggttctcaagaacctggcat

SEQ ID NO: 3339 - DNA, 20 bp, Artificial Sequence
  sgRNA
acacacagaaccagttgttc

SEQ ID NO: 3340 - DNA, 20 bp, Artificial Sequence
  sgRNA
cagagacgcgtggactctac

SEQ ID NO: 3341 - DNA, 20 bp, Artificial Sequence
  sgRNA
tcatcatcccgagccggatc

SEQ ID NO: 3342 - DNA, 20 bp, Artificial Sequence
  sgRNA
tttattgggcctccgaagcg

SEQ ID NO: 3343 - DNA, 20 bp, Artificial Sequence
  sgRNA
acccatttatatcctgacaa

SEQ ID NO: 3344 - DNA, 20 bp, Artificial Sequence
  sgRNA
ctaaggaaggagagcctcga

SEQ ID NO: 3345 - DNA, 20 bp, Artificial Sequence
  sgRNA
tgaaactttggtgtggttct

SEQ ID NO: 3346 - DNA, 20 bp, Artificial Sequence
  sgRNA
aagaaactgataatgtgcac

SEQ ID NO: 3347 - DNA, 20 bp, Artificial Sequence
  sgRNA
ggagtatcccaaaggaggtg

SEQ ID NO: 3348 - DNA, 20 bp, Artificial Sequence
  sgRNA
ctcacgtgagcgacagagat

SEQ ID NO: 3349 - DNA, 20 bp, Artificial Sequence
  sgRNA
gcttggagacctgccgcgcc

SEQ ID NO: 3350 - DNA, 20 bp, Artificial Sequence
  sgRNA
tgtatggttgccttatctcg

SEQ ID NO: 3351 - DNA, 20 bp, Artificial Sequence
  sgRNA
ctggtcacgcaatgctttgt

SEQ ID NO: 3352 - DNA, 20 bp, Artificial Sequence
  sgRNA
ggataatgaatggaatgccc

SEQ ID NO: 3353 - DNA, 20 bp, Artificial Sequence
  sgRNA
cagagtcaagaaaggaagtg

SEQ ID NO: 3354 - DNA, 20 bp, Artificial Sequence
  sgRNA
tgcaggaagcttcactgtgc

SEQ ID NO: 3355 - DNA, 20 bp, Artificial Sequence
  sgRNA
gggcgggacaaccgtcacca

SEQ ID NO: 3356 - DNA, 20 bp, Artificial Sequence
  sgRNA
gcatgaaactcagcctcatt

SEQ ID NO: 3357 - DNA, 20 bp, Artificial Sequence
  sgRNA
accaaggagtaaaggacttc

SEQ ID NO: 3358 - DNA, 20 bp, Artificial Sequence
  sgRNA
gcggccagcctctgggcaga

SEQ ID NO: 3359 - DNA, 20 bp, Artificial Sequence
  sgRNA
cagaggtgtgtgctgatgta

SEQ ID NO: 3360 - DNA, 20 bp, Artificial Sequence
  sgRNA
cccgcccagagagcacgcgt

SEQ ID NO: 3361 - DNA, 20 bp, Artificial Sequence
  sgRNA
gcgggagaatttcatcccgt

SEQ ID NO: 3362 - DNA, 20 bp, Artificial Sequence
  sgRNA
tggcggacatcacctgttcg

SEQ ID NO: 3363 - DNA, 20 bp, Artificial Sequence
  sgRNA
gcagaatttgtaccgatagc

SEQ ID NO: 3364 - DNA, 20 bp, Artificial Sequence
  sgRNA
atgttggcacagtaaagagg

SEQ ID NO: 3365 - DNA, 20 bp, Artificial Sequence
  sgRNA
ctcagtcacgttgtctagct

SEQ ID NO: 3366 - DNA, 20 bp, Artificial Sequence
  sgRNA
tatactactggagcggcggg

SEQ ID NO: 3367 - DNA, 20 bp, Artificial Sequence
  sgRNA
ttatctcttataggtctcct

SEQ ID NO: 3368 - DNA, 20 bp, Artificial Sequence
  sgRNA
ggaaatgaactagggctggg

SEQ ID NO: 3369 - DNA, 20 bp, Artificial Sequence
  sgRNA
gagggtggcagaagggcttc

SEQ ID NO: 3370 - DNA, 20 bp, Artificial Sequence
  sgRNA
gcactggtggtactgggagg

SEQ ID NO: 3371 - DNA, 20 bp, Artificial Sequence
  sgRNA
ttggtaggaaggaagccagc

SEQ ID NO: 3372 - DNA, 20 bp, Artificial Sequence
  sgRNA
ccctgtcctctgcagctact

SEQ ID NO: 3373 - DNA, 20 bp, Artificial Sequence
  sgRNA
gcagccaaagcagatcgtga

SEQ ID NO: 3374 - DNA, 20 bp, Artificial Sequence
  sgRNA
tgcgggctcgggcgctgagg

SEQ ID NO: 3375 - DNA, 20 bp, Artificial Sequence
  sgRNA
tggtgatgctggtggtgcgc

SEQ ID NO: 3376 - DNA, 20 bp, Artificial Sequence
  sgRNA
ctgttctccttccgtccact

SEQ ID NO: 3377 - DNA, 20 bp, Artificial Sequence
  sgRNA
gcccttcccgcagaaactgg

SEQ ID NO: 3378 - DNA, 20 bp, Artificial Sequence
  sgRNA
tggttattgattgacttgtg

SEQ ID NO: 3379 - DNA, 20 bp, Artificial Sequence
  sgRNA
attatgcagtgtaaatgagc

SEQ ID NO: 3380 - DNA, 20 bp, Artificial Sequence
  sgRNA
gtctgaagagggccagcgcg

SEQ ID NO: 3381 - DNA, 20 bp, Artificial Sequence
  sgRNA
aggaagaggaggcaggaagc

SEQ ID NO: 3382 - DNA, 20 bp, Artificial Sequence
  sgRNA
ctctcccagcctatgccaca

SEQ ID NO: 3383 - DNA, 20 bp, Artificial Sequence
  sgRNA
aacagggagggagctaacct

SEQ ID NO: 3384 - DNA, 20 bp, Artificial Sequence
  sgRNA
aagcattctggctccaatcc

SEQ ID NO: 3385 - DNA, 20 bp, Artificial Sequence
  sgRNA
ggcctggtgcgcaggccctt

SEQ ID NO: 3386 - DNA, 20 bp, Artificial Sequence
  sgRNA
aaccgaagatctcaccggag

SEQ ID NO: 3387 - DNA, 20 bp, Artificial Sequence
  sgRNA
ggttctctaacagctgttgt

SEQ ID NO: 3388 - DNA, 20 bp, Artificial Sequence
  sgRNA
ccagactcctaccaagcctc

SEQ ID NO: 3389 - DNA, 20 bp, Artificial Sequence
  sgRNA
ccaggatgaagacgctactc

SEQ ID NO: 3390 - DNA, 20 bp, Artificial Sequence
  sgRNA
gcgctgagcggcaggcgaag

SEQ ID NO: 3391 - DNA, 20 bp, Artificial Sequence
  sgRNA
agtcctgcccaatcacaaga

SEQ ID NO: 3392 - DNA, 20 bp, Artificial Sequence
  sgRNA
cagagtttgcaaagtcgccg

SEQ ID NO: 3393 - DNA, 20 bp, Artificial Sequence
  sgRNA
ccacacttgcttgtattcag

SEQ ID NO: 3394 - DNA, 20 bp, Artificial Sequence
  sgRNA
ccgtggaactcgagcgatcc

SEQ ID NO: 3395 - DNA, 20 bp, Artificial Sequence
  sgRNA
ggaggcagctccgggcccgg

SEQ ID NO: 3396 - DNA, 20 bp, Artificial Sequence
  sgRNA
tctgggcaagagcgcggcac

SEQ ID NO: 3397 - DNA, 20 bp, Artificial Sequence
  sgRNA
gtgaggatctttgctgcaga

SEQ ID NO: 3398 - DNA, 20 bp, Artificial Sequence
  sgRNA
acgcgggagcgcacagtcag

SEQ ID NO: 3399 - DNA, 20 bp, Artificial Sequence
  sgRNA
atacagtaactgctcaagaa

SEQ ID NO: 3400 - DNA, 20 bp, Artificial Sequence
  sgRNA
cgcgcactgcgaaagtgaga

SEQ ID NO: 3401 - DNA, 20 bp, Artificial Sequence
  sgRNA
gtcggtgaggaggtgcaagg

SEQ ID NO: 3402 - DNA, 20 bp, Artificial Sequence
  sgRNA
tagactagaggccacagctg

SEQ ID NO: 3403 - DNA, 20 bp, Artificial Sequence
  sgRNA
aagtgagggacttcgaggcc

SEQ ID NO: 3404 - DNA, 20 bp, Artificial Sequence
  sgRNA
tggttgtaagggattgggcc

SEQ ID NO: 3405 - DNA, 20 bp, Artificial Sequence
  sgRNA
ggatccctggctgggcggac

SEQ ID NO: 3406 - DNA, 20 bp, Artificial Sequence
  sgRNA
gacagagttaagaaatcaaa

SEQ ID NO: 3407 - DNA, 20 bp, Artificial Sequence
  sgRNA
gagcgggcaggccttgcgcc

SEQ ID NO: 3408 - DNA, 20 bp, Artificial Sequence
  sgRNA
cgttccctgtagagttctag

SEQ ID NO: 3409 - DNA, 20 bp, Artificial Sequence
  sgRNA
aaaggtcagatctgtactcc

SEQ ID NO: 3410 - DNA, 20 bp, Artificial Sequence
  sgRNA
ggaatgcaatgttaattctg

SEQ ID NO: 3411 - DNA, 20 bp, Artificial Sequence
  sgRNA
ccctcttcttggccagtatc

SEQ ID NO: 3412 - DNA, 20 bp, Artificial Sequence
  sgRNA
tctgtgtggctgacgtggca

SEQ ID NO: 3413 - DNA, 20 bp, Artificial Sequence
  sgRNA
cagaacctggattgacgttt

SEQ ID NO: 3414 - DNA, 20 bp, Artificial Sequence
  sgRNA
ccacccgcacttccggacct

SEQ ID NO: 3415 - DNA, 20 bp, Artificial Sequence
  sgRNA
catgtcactcagagagaagc

SEQ ID NO: 3416 - DNA, 20 bp, Artificial Sequence
  sgRNA
tcccggacgcctcccgctaa

SEQ ID NO: 3417 - DNA, 20 bp, Artificial Sequence
  sgRNA
tttgtgacaaggtgtggtta

SEQ ID NO: 3418 - DNA, 20 bp, Artificial Sequence
  sgRNA
ccaagtttgtgaagtcatga

SEQ ID NO: 3419 - DNA, 20 bp, Artificial Sequence
  sgRNA
tacgctggcaggctgtgggc

SEQ ID NO: 3420 - DNA, 20 bp, Artificial Sequence
  sgRNA
ctgctgctgcgaaagagagc

SEQ ID NO: 3421 - DNA, 20 bp, Artificial Sequence
  sgRNA
tagggagagacacccgccaa

SEQ ID NO: 3422 - DNA, 20 bp, Artificial Sequence
  sgRNA
tgactttacaagaatgcctg

SEQ ID NO: 3423 - DNA, 20 bp, Artificial Sequence
  sgRNA
tgaccagggtgattcagttt

SEQ ID NO: 3424 - DNA, 20 bp, Artificial Sequence
  sgRNA
gtgactctggagtactgtat

SEQ ID NO: 3425 - DNA, 20 bp, Artificial Sequence
  sgRNA
tcacctgctgtcctctgcga

SEQ ID NO: 3426 - DNA, 20 bp, Artificial Sequence
  sgRNA
ggtcaacgtgaggaatttag

SEQ ID NO: 3427 - DNA, 20 bp, Artificial Sequence
  sgRNA
gggaacagttagacatgaaa

SEQ ID NO: 3428 - DNA, 20 bp, Artificial Sequence
  sgRNA
ggcggaggaagaaaggtggc

SEQ ID NO: 3429 - DNA, 20 bp, Artificial Sequence
  sgRNA
ggaagagatcgctcactcgg

SEQ ID NO: 3430 - DNA, 20 bp, Artificial Sequence
  sgRNA
actaaatgcctgacaaatac

SEQ ID NO: 3431 - DNA, 20 bp, Artificial Sequence
  sgRNA
tttgtattctggcatcctgg

SEQ ID NO: 3432 - DNA, 20 bp, Artificial Sequence
  sgRNA
aagtgcagtccgggtgcttg

SEQ ID NO: 3433 - DNA, 20 bp, Artificial Sequence
  sgRNA
gcgcggccgcttcttgagcc

SEQ ID NO: 3434 - DNA, 20 bp, Artificial Sequence
  sgRNA
gccgcagccgccgcttgttt

SEQ ID NO: 3435 - DNA, 20 bp, Artificial Sequence
  sgRNA
gttgctaacgcggtgtctgg

SEQ ID NO: 3436 - DNA, 20 bp, Artificial Sequence
  sgRNA
tgcgttggtttggcgggttg

SEQ ID NO: 3437 - DNA, 20 bp, Artificial Sequence
  sgRNA
gtcaacagcatttactgtgt

SEQ ID NO: 3438 - DNA, 20 bp, Artificial Sequence
  sgRNA
cactaacaactactctgcgg

SEQ ID NO: 3439 - DNA, 20 bp, Artificial Sequence
  sgRNA
aacacacgagagtggagaga

SEQ ID NO: 3440 - DNA, 20 bp, Artificial Sequence
  sgRNA
aatcagtcatctaaacttct

SEQ ID NO: 3441 - DNA, 20 bp, Artificial Sequence
  sgRNA
gaacttcctcctcagccgag

SEQ ID NO: 3442 - DNA, 20 bp, Artificial Sequence
  sgRNA
cttggctgcagttgtgcggc

SEQ ID NO: 3443 - DNA, 20 bp, Artificial Sequence
  sgRNA
agaagagtcagtgtcgactt

SEQ ID NO: 3444 - DNA, 20 bp, Artificial Sequence
  sgRNA
tagtctagttaatctacgcc

SEQ ID NO: 3445 - DNA, 20 bp, Artificial Sequence
  sgRNA
ccgctctgctgtgcgattta

SEQ ID NO: 3446 - DNA, 20 bp, Artificial Sequence
  sgRNA
gacagtagctgcgtaggaga

SEQ ID NO: 3447 - DNA, 20 bp, Artificial Sequence
  sgRNA
gtatgcatttgtcccagccc

SEQ ID NO: 3448 - DNA, 20 bp, Artificial Sequence
  sgRNA
gaaaggctggaaaggtgtgg

SEQ ID NO: 3449 - DNA, 20 bp, Artificial Sequence
  sgRNA
tcccgcaggaacaggagctt

SEQ ID NO: 3450 - DNA, 20 bp, Artificial Sequence
  sgRNA
caacttacatttgcagccgg

SEQ ID NO: 3451 - DNA, 20 bp, Artificial Sequence
  sgRNA
gacgcggttgctaaggaagt

SEQ ID NO: 3452 - DNA, 20 bp, Artificial Sequence
  sgRNA
gagaaggcagtcacatctgc

SEQ ID NO: 3453 - DNA, 20 bp, Artificial Sequence
  sgRNA
gaactgagtgcgccagagag

SEQ ID NO: 3454 - DNA, 20 bp, Artificial Sequence
  sgRNA
tctgggtaacctcacgtgac

SEQ ID NO: 3455 - DNA, 20 bp, Artificial Sequence
  sgRNA
gtgacagcgcggagcgggag

SEQ ID NO: 3456 - DNA, 20 bp, Artificial Sequence
  sgRNA
aaagaaaggttccagtagag

SEQ ID NO: 3457 - DNA, 20 bp, Artificial Sequence
  sgRNA
tacataactgagattaagtg

SEQ ID NO: 3458 - DNA, 20 bp, Artificial Sequence
  sgRNA
gggcttcagagtccaccttg

SEQ ID NO: 3459 - DNA, 20 bp, Artificial Sequence
  sgRNA
ctttgaccgcctcaccagtc

SEQ ID NO: 3460 - DNA, 20 bp, Artificial Sequence
  sgRNA
gggcttgatcagccacactg

SEQ ID NO: 3461 - DNA, 20 bp, Artificial Sequence
  sgRNA
cacactcctcggaggaggga

SEQ ID NO: 3462 - DNA, 20 bp, Artificial Sequence
  sgRNA
cgcgcggagcccgcgtggag

SEQ ID NO: 3463 - DNA, 20 bp, Artificial Sequence
  sgRNA
ttctactcaccatctaatcc

SEQ ID NO: 3464 - DNA, 20 bp, Artificial Sequence
  sgRNA
ggagtctgccagcgatctct

SEQ ID NO: 3465 - DNA, 20 bp, Artificial Sequence
  sgRNA
cccatctccggcgcagcggg

SEQ ID NO: 3466 - DNA, 20 bp, Artificial Sequence
  sgRNA
ctgcgcagccgagaggcggg

SEQ ID NO: 3467 - DNA, 20 bp, Artificial Sequence
  sgRNA
cgcccgcggattgcgagcag

SEQ ID NO: 3468 - DNA, 20 bp, Artificial Sequence
  sgRNA
ttgaaatattctgtagggtt

SEQ ID NO: 3469 - DNA, 20 bp, Artificial Sequence
  sgRNA
cgtaacctacagtcatttag

SEQ ID NO: 3470 - DNA, 20 bp, Artificial Sequence
  sgRNA
aatggcgtctccggagcccg

SEQ ID NO: 3471 - DNA, 20 bp, Artificial Sequence
  sgRNA
gtcggcatctcaggcagccc

SEQ ID NO: 3472 - DNA, 20 bp, Artificial Sequence
  sgRNA
cctgagcaccagggtagggt

SEQ ID NO: 3473 - DNA, 20 bp, Artificial Sequence
  sgRNA
aaacatttgcagtggcatgt

SEQ ID NO: 3474 - DNA, 20 bp, Artificial Sequence
  sgRNA
catctactctctgggtgcac

SEQ ID NO: 3475 - DNA, 20 bp, Artificial Sequence
  sgRNA
caactaatattggttccttt

SEQ ID NO: 3476 - DNA, 20 bp, Artificial Sequence
  sgRNA
cgcaagcattgtgagaaccg

SEQ ID NO: 3477 - DNA, 20 bp, Artificial Sequence
  sgRNA
gggacaggagccagtcagac

SEQ ID NO: 3478 - DNA, 20 bp, Artificial Sequence
  sgRNA
ttcaccttgccactgggtct

SEQ ID NO: 3479 - DNA, 20 bp, Artificial Sequence
  sgRNA
agaggacattgtgccttagg

SEQ ID NO: 3480 - DNA, 20 bp, Artificial Sequence
  sgRNA
ggcggcccgctctcaggtca

SEQ ID NO: 3481 - DNA, 20 bp, Artificial Sequence
  sgRNA
gagctataaagctgcgctcc

SEQ ID NO: 3482 - DNA, 20 bp, Artificial Sequence
  sgRNA
cttagactaagcctttccgg

SEQ ID NO: 3483 - DNA, 20 bp, Artificial Sequence
  sgRNA
agaatgagatgtcaattcag

SEQ ID NO: 3484 - DNA, 20 bp, Artificial Sequence
  sgRNA
tggcagatctgctccctaaa

SEQ ID NO: 3485 - DNA, 20 bp, Artificial Sequence
  sgRNA
ggagggagggaaatgaataa

SEQ ID NO: 3486 - DNA, 20 bp, Artificial Sequence
  sgRNA
cgagtctagttctattaagt

SEQ ID NO: 3487 - DNA, 20 bp, Artificial Sequence
  sgRNA
ctgcgctagatccagcgccc

SEQ ID NO: 3488 - DNA, 20 bp, Artificial Sequence
  sgRNA
ctttaatcttgtcgtcgcac

SEQ ID NO: 3489 - DNA, 20 bp, Artificial Sequence
  sgRNA
atatagtaacctttgactgt

SEQ ID NO: 3490 - DNA, 20 bp, Artificial Sequence
  sgRNA
agagggagaagctcgtcacc

SEQ ID NO: 3491 - DNA, 20 bp, Artificial Sequence
  sgRNA
cgaggacagtccactagagg

SEQ ID NO: 3492 - DNA, 20 bp, Artificial Sequence
  sgRNA
ggaccaccacttagttatga

SEQ ID NO: 3493 - DNA, 20 bp, Artificial Sequence
  sgRNA
agattctgaacgctgtgtaa

SEQ ID NO: 3494 - DNA, 20 bp, Artificial Sequence
  sgRNA
aagaggtgtgtcagcaaccc

SEQ ID NO: 3495 - DNA, 20 bp, Artificial Sequence
  sgRNA
tgcccagatcggcagagtag

SEQ ID NO: 3496 - DNA, 20 bp, Artificial Sequence
  sgRNA
cccttgtggtgagatcacag

SEQ ID NO: 3497 - DNA, 20 bp, Artificial Sequence
  sgRNA
cttggcgattggacgagagt

SEQ ID NO: 3498 - DNA, 20 bp, Artificial Sequence
  sgRNA
gaggaggagccacagggaag

SEQ ID NO: 3499 - DNA, 20 bp, Artificial Sequence
  sgRNA
acaaaggtagagtactcttc

SEQ ID NO: 3500 - DNA, 20 bp, Artificial Sequence
  sgRNA
gtcagttggatcagggtgga

SEQ ID NO: 3501 - DNA, 20 bp, Artificial Sequence
  sgRNA
gctgcgtgcgcacgtcatca

SEQ ID NO: 3502 - DNA, 20 bp, Artificial Sequence
  sgRNA
agttgtgagtcagtggagta

SEQ ID NO: 3503 - DNA, 20 bp, Artificial Sequence
  sgRNA
gctgggctatgacggcagag

SEQ ID NO: 3504 - DNA, 20 bp, Artificial Sequence
  sgRNA
cgacagcgatctgacagcga

SEQ ID NO: 3505 - DNA, 20 bp, Artificial Sequence
  sgRNA
aaattaaggtgtgacgaaac

SEQ ID NO: 3506 - DNA, 20 bp, Artificial Sequence
  sgRNA
cagggcgaagtccacgtcgc

SEQ ID NO: 3507 - DNA, 20 bp, Artificial Sequence
  sgRNA
aggtctcaggctcacgtggg

SEQ ID NO: 3508 - DNA, 20 bp, Artificial Sequence
  sgRNA
caagaattacccagttccag

SEQ ID NO: 3509 - DNA, 20 bp, Artificial Sequence
  sgRNA
acacgcctacttctcccaca

SEQ ID NO: 3510 - DNA, 20 bp, Artificial Sequence
  sgRNA
cgcattaaagagacaagcta

SEQ ID NO: 3511 - DNA, 20 bp, Artificial Sequence
  sgRNA
tacacgactgggtgcagccg

SEQ ID NO: 3512 - DNA, 20 bp, Artificial Sequence
  sgRNA
gcgtgtgcgagatgaggtgt

SEQ ID NO: 3513 - DNA, 20 bp, Artificial Sequence
  sgRNA
cgaggtccgagtttgccttc

SEQ ID NO: 3514 - DNA, 20 bp, Artificial Sequence
  sgRNA
cgcccaactctcgcgatacc

SEQ ID NO: 3515 - DNA, 20 bp, Artificial Sequence
  sgRNA
ttgcctagagttgctaagtt

SEQ ID NO: 3516 - DNA, 20 bp, Artificial Sequence
  sgRNA
gggccggaagagccacgcca

SEQ ID NO: 3517 - DNA, 20 bp, Artificial Sequence
  sgRNA
tctccctgagtcctaacgtg

SEQ ID NO: 3518 - DNA, 20 bp, Artificial Sequence
  sgRNA
gtcgcgagggaacggctgcc

SEQ ID NO: 3519 - DNA, 20 bp, Artificial Sequence
  sgRNA
gccgatatgcaggcggcgcg

SEQ ID NO: 3520 - DNA, 20 bp, Artificial Sequence
  sgRNA
gagctaatgctgggctccat

SEQ ID NO: 3521 - DNA, 20 bp, Artificial Sequence
  sgRNA
tgcactcagggaggcaaggg

SEQ ID NO: 3522 - DNA, 20 bp, Artificial Sequence
  sgRNA
ggccaatgaagtcagcattc

SEQ ID NO: 3523 - DNA, 20 bp, Artificial Sequence
  sgRNA
ccgctgctgttactagctcc

SEQ ID NO: 3524 - DNA, 20 bp, Artificial Sequence
  sgRNA
tggccgcggcccatgtgacc

SEQ ID NO: 3525 - DNA, 20 bp, Artificial Sequence
  sgRNA
gctgccgtaggtagtgctct

SEQ ID NO: 3526 - DNA, 20 bp, Artificial Sequence
  sgRNA
ggatccgcaggcaagactta

SEQ ID NO: 3527 - DNA, 20 bp, Artificial Sequence
  sgRNA
gaagactggccgtcacggga

SEQ ID NO: 3528 - DNA, 20 bp, Artificial Sequence
  sgRNA
tccttcctaagggagctcag

SEQ ID NO: 3529 - DNA, 20 bp, Artificial Sequence
  sgRNA
atgaataatgtgagcgttgg

SEQ ID NO: 3530 - DNA, 20 bp, Artificial Sequence
  sgRNA
agtcaggagtggccaacttg

SEQ ID NO: 3531 - DNA, 20 bp, Artificial Sequence
  sgRNA
aggcggccgacctgtggact

SEQ ID NO: 3532 - DNA, 20 bp, Artificial Sequence
  sgRNA
ggagcgcagccctggtcacg

SEQ ID NO: 3533 - DNA, 20 bp, Artificial Sequence
  sgRNA
cttgagtgggttgggagtgg

SEQ ID NO: 3534 - DNA, 20 bp, Artificial Sequence
  sgRNA
atgcagctttgcgcatcctt

SEQ ID NO: 3535 - DNA, 20 bp, Artificial Sequence
  sgRNA
cccagcaaagaagagcatgc

SEQ ID NO: 3536 - DNA, 20 bp, Artificial Sequence
  sgRNA
tctctgggttagagtggtgc

SEQ ID NO: 3537 - DNA, 20 bp, Artificial Sequence
  sgRNA
ggacattgccttcccttccc

SEQ ID NO: 3538 - DNA, 20 bp, Artificial Sequence
  sgRNA
tccgctgggtccaggagcag

SEQ ID NO: 3539 - DNA, 20 bp, Artificial Sequence
  sgRNA
gtgtcatctcctaaccaccc

SEQ ID NO: 3540 - DNA, 20 bp, Artificial Sequence
  sgRNA
gcacacctccttgcgccgcg

SEQ ID NO: 3541 - DNA, 20 bp, Artificial Sequence
  sgRNA
cagcgcctctgtgtgagctc

SEQ ID NO: 3542 - DNA, 20 bp, Artificial Sequence
  sgRNA
agtcccgggcaggactgcat

SEQ ID NO: 3543 - DNA, 20 bp, Artificial Sequence
  sgRNA
tagcccagcctgaccctgct

SEQ ID NO: 3544 - DNA, 20 bp, Artificial Sequence
  sgRNA
ggcagcggccgcgtccacgt

SEQ ID NO: 3545 - DNA, 20 bp, Artificial Sequence
  sgRNA
ctaccagcccgcctactggg

SEQ ID NO: 3546 - DNA, 20 bp, Artificial Sequence
  sgRNA
gagaccggagggaaacgaac

SEQ ID NO: 3547 - DNA, 20 bp, Artificial Sequence
  sgRNA
acgaaactcctgacagttat

SEQ ID NO: 3548 - DNA, 20 bp, Artificial Sequence
  sgRNA
ttcagatgaagcaaattctg

SEQ ID NO: 3549 - DNA, 20 bp, Artificial Sequence
  sgRNA
agtcagagaattgtatatcc

SEQ ID NO: 3550 - DNA, 20 bp, Artificial Sequence
  sgRNA
tgttctagagtgtaggcctg

SEQ ID NO: 3551 - DNA, 20 bp, Artificial Sequence
  sgRNA
gtccatttccctcccttcaa

SEQ ID NO: 3552 - DNA, 20 bp, Artificial Sequence
  sgRNA
tatgcctcccgtctgtacta

SEQ ID NO: 3553 - DNA, 20 bp, Artificial Sequence
  sgRNA
cgaggttctgtccgcttgtc

SEQ ID NO: 3554 - DNA, 20 bp, Artificial Sequence
  sgRNA
tctcgccatgtctctcctct

SEQ ID NO: 3555 - DNA, 20 bp, Artificial Sequence
  sgRNA
actcccagagagctcccttc

SEQ ID NO: 3556 - DNA, 20 bp, Artificial Sequence
  sgRNA
ctcctggctgacttcacatg

SEQ ID NO: 3557 - DNA, 20 bp, Artificial Sequence
  sgRNA
gtaaggttattaaatggctt

SEQ ID NO: 3558 - DNA, 20 bp, Artificial Sequence
  sgRNA
gcttatcggaggacggaggg

SEQ ID NO: 3559 - DNA, 20 bp, Artificial Sequence
  sgRNA
tccgatttaaacgtgatagt

SEQ ID NO: 3560 - DNA, 20 bp, Artificial Sequence
  sgRNA
gcgggacatcctgaaataat

SEQ ID NO: 3561 - DNA, 20 bp, Artificial Sequence
  sgRNA
ccggacagaggtagatgaac

SEQ ID NO: 3562 - DNA, 20 bp, Artificial Sequence
  sgRNA
aatcatggagtgggcatgat

SEQ ID NO: 3563 - DNA, 20 bp, Artificial Sequence
  sgRNA
cgaggcaatgggcacccgtc

SEQ ID NO: 3564 - DNA, 20 bp, Artificial Sequence
  sgRNA
gcacccactggacttctgtg

SEQ ID NO: 3565 - DNA, 20 bp, Artificial Sequence
  sgRNA
cgtggtgtgtgtgggtcttc

SEQ ID NO: 3566 - DNA, 20 bp, Artificial Sequence
  sgRNA
aaagaggtgggcccaccacg

SEQ ID NO: 3567 - DNA, 20 bp, Artificial Sequence
  sgRNA
catagaaggtccttcagagc

SEQ ID NO: 3568 - DNA, 20 bp, Artificial Sequence
  sgRNA
actctgtccgcccaggatcg

SEQ ID NO: 3569 - DNA, 20 bp, Artificial Sequence
  sgRNA
gggagctgagtgtgccacgg

SEQ ID NO: 3570 - DNA, 20 bp, Artificial Sequence
  sgRNA
tgacgcggattggctaggct

SEQ ID NO: 3571 - DNA, 20 bp, Artificial Sequence
  sgRNA
aggacttctgggttggaccg

SEQ ID NO: 3572 - DNA, 20 bp, Artificial Sequence
  sgRNA
gaaggctggtatataagcgg

SEQ ID NO: 3573 - DNA, 20 bp, Artificial Sequence
  sgRNA
gcagctgttagcaacttcct

SEQ ID NO: 3574 - DNA, 20 bp, Artificial Sequence
  sgRNA
aaagcctctcacaggagttt

SEQ ID NO: 3575 - DNA, 20 bp, Artificial Sequence
  sgRNA
cctgcgcaactgcgagcagc

SEQ ID NO: 3576 - DNA, 20 bp, Artificial Sequence
  sgRNA
gaactgttgctgaagcggaa

SEQ ID NO: 3577 - DNA, 20 bp, Artificial Sequence
  sgRNA
gctgatatggaagatgatta

SEQ ID NO: 3578 - DNA, 20 bp, Artificial Sequence
  sgRNA
cgggagaggaagcctgagcg

SEQ ID NO: 3579 - DNA, 20 bp, Artificial Sequence
  sgRNA
cggtcaaccttggagcccag

SEQ ID NO: 3580 - DNA, 20 bp, Artificial Sequence
  sgRNA
gtgctggttcttggtcccgt

SEQ ID NO: 3581 - DNA, 20 bp, Artificial Sequence
  sgRNA
gttgttcgtttgaacctcgg

SEQ ID NO: 3582 - DNA, 20 bp, Artificial Sequence
  sgRNA
cgcatgccggcacgtggtgc

SEQ ID NO: 3583 - DNA, 20 bp, Artificial Sequence
  sgRNA
ctgggtgggcccttagagga

SEQ ID NO: 3584 - DNA, 20 bp, Artificial Sequence
  sgRNA
gaccattgcaaccagaagcc

SEQ ID NO: 3585 - DNA, 20 bp, Artificial Sequence
  sgRNA
gtctccaacatttcctcctg

SEQ ID NO: 3586 - DNA, 20 bp, Artificial Sequence
  sgRNA
agcctgagagcttaggcctt

SEQ ID NO: 3587 - DNA, 20 bp, Artificial Sequence
  sgRNA
acgggcgggaccggccggag

SEQ ID NO: 3588 - DNA, 20 bp, Artificial Sequence
  sgRNA
gaggaggatctctacacccg

SEQ ID NO: 3589 - DNA, 20 bp, Artificial Sequence
  sgRNA
ggacgattacccgcgggagg

SEQ ID NO: 3590 - DNA, 20 bp, Artificial Sequence
  sgRNA
gaagacagagcgcactaagc

SEQ ID NO: 3591 - DNA, 20 bp, Artificial Sequence
  sgRNA
tgatactgtcagctagtcct

SEQ ID NO: 3592 - DNA, 20 bp, Artificial Sequence
  sgRNA
gaaccttcgctgttcgtcct

SEQ ID NO: 3593 - DNA, 20 bp, Artificial Sequence
  sgRNA
gacaaagtttcaggagactt

SEQ ID NO: 3594 - DNA, 20 bp, Artificial Sequence
  sgRNA
ttcccaataagaacgaacaa

SEQ ID NO: 3595 - DNA, 20 bp, Artificial Sequence
  sgRNA
cgctccgattggccaacagt

SEQ ID NO: 3596 - DNA, 20 bp, Artificial Sequence
  sgRNA
ggtcacaggccacgggtccc

SEQ ID NO: 3597 - DNA, 20 bp, Artificial Sequence
  sgRNA
tatttgggattcacggaggc

SEQ ID NO: 3598 - DNA, 20 bp, Artificial Sequence
  sgRNA
aaacgaacccgcctgtaaat

SEQ ID NO: 3599 - DNA, 20 bp, Artificial Sequence
  sgRNA
gctggatccataagggagtc

SEQ ID NO: 3600 - DNA, 20 bp, Artificial Sequence
  sgRNA
gttagagactccctctgccc

SEQ ID NO: 3601 - DNA, 20 bp, Artificial Sequence
  sgRNA
attaggttaatatgttcagc

SEQ ID NO: 3602 - DNA, 20 bp, Artificial Sequence
  sgRNA
aattggacttcagtgtttcg

SEQ ID NO: 3603 - DNA, 20 bp, Artificial Sequence
  sgRNA
gaaggagcgcgcgaaagggt

SEQ ID NO: 3604 - DNA, 20 bp, Artificial Sequence
  sgRNA
agccgattcctggtcatgac

SEQ ID NO: 3605 - DNA, 20 bp, Artificial Sequence
  sgRNA
ttggctgtgcatcttcaaac

SEQ ID NO: 3606 - DNA, 20 bp, Artificial Sequence
  sgRNA
gtaatgagaagtgacgggct

SEQ ID NO: 3607 - DNA, 20 bp, Artificial Sequence
  sgRNA
ggtagcaacgtcggacaccc

SEQ ID NO: 3608 - DNA, 20 bp, Artificial Sequence
  sgRNA
cactgatctcactgttgcta

SEQ ID NO: 3609 - DNA, 20 bp, Artificial Sequence
  sgRNA
agtaagccagctcgacccgc

SEQ ID NO: 3610 - DNA, 20 bp, Artificial Sequence
  sgRNA
gcgccgtcggcgtagagcgc

SEQ ID NO: 3611 - DNA, 20 bp, Artificial Sequence
  sgRNA
aggcgggcccttcagccagc

SEQ ID NO: 3612 - DNA, 20 bp, Artificial Sequence
  sgRNA
ggacgtcctccttactccgc

SEQ ID NO: 3613 - DNA, 20 bp, Artificial Sequence
  sgRNA
aactaagggctagatctgca

SEQ ID NO: 3614 - DNA, 20 bp, Artificial Sequence
  sgRNA
cactgggtcaaggatgtgcc

SEQ ID NO: 3615 - DNA, 20 bp, Artificial Sequence
  sgRNA
ggtggtgcaacttccgtccc

SEQ ID NO: 3616 - DNA, 20 bp, Artificial Sequence
  sgRNA
gtgctaggcaagccagcgtg

SEQ ID NO: 3617 - DNA, 20 bp, Artificial Sequence
  sgRNA
atcagtttcatgttgaaagt

SEQ ID NO: 3618 - DNA, 20 bp, Artificial Sequence
  sgRNA
cttgggtctccagccacgtt

SEQ ID NO: 3619 - DNA, 20 bp, Artificial Sequence
  sgRNA
ctcagaggcagaatctgctg

SEQ ID NO: 3620 - DNA, 20 bp, Artificial Sequence
  sgRNA
gaagctgttgaaagtaagaa

SEQ ID NO: 3621 - DNA, 20 bp, Artificial Sequence
  sgRNA
ggagcgcagcgcgtgctgcg

SEQ ID NO: 3622 - DNA, 20 bp, Artificial Sequence
  sgRNA
ccgttagctggcggcgcgcc

SEQ ID NO: 3623 - DNA, 20 bp, Artificial Sequence
  sgRNA
cttatttgacgctgcccact

SEQ ID NO: 3624 - DNA, 20 bp, Artificial Sequence
  sgRNA
aaggactgagagcaggcagg

SEQ ID NO: 3625 - DNA, 20 bp, Artificial Sequence
  sgRNA
cacgctcaaatttccgcagt

SEQ ID NO: 3626 - DNA, 20 bp, Artificial Sequence
  sgRNA
agagggcacctcccttggct

SEQ ID NO: 3627 - DNA, 20 bp, Artificial Sequence
  sgRNA
ttctgcgttgcgcgacttac

SEQ ID NO: 3628 - DNA, 20 bp, Artificial Sequence
  sgRNA
gggtattgattacatcctgg

SEQ ID NO: 3629 - DNA, 20 bp, Artificial Sequence
  sgRNA
gatcacgtgacggagctctc

SEQ ID NO: 3630 - DNA, 20 bp, Artificial Sequence
  sgRNA
gttcagcacgttactgtgat

SEQ ID NO: 3631 - DNA, 20 bp, Artificial Sequence
  sgRNA
ctcctgtatcaggagagcaa

SEQ ID NO: 3632 - DNA, 20 bp, Artificial Sequence
  sgRNA
ggcggtggctggcgtctcat

SEQ ID NO: 3633 - DNA, 20 bp, Artificial Sequence
  sgRNA
aatggaacaccttcctaaca

SEQ ID NO: 3634 - DNA, 20 bp, Artificial Sequence
  sgRNA
gattggcccggtgacgacaa

SEQ ID NO: 3635 - DNA, 20 bp, Artificial Sequence
  sgRNA
acgcgcccgccttctggcac

SEQ ID NO: 3636 - DNA, 20 bp, Artificial Sequence
  sgRNA
gcagacgcccgcgcgtcctc

SEQ ID NO: 3637 - DNA, 20 bp, Artificial Sequence
  sgRNA
tgaggagccaatggagcagc

SEQ ID NO: 3638 - DNA, 20 bp, Artificial Sequence
  sgRNA
tgtagcagccaatcgaggcg

SEQ ID NO: 3639 - DNA, 20 bp, Artificial Sequence
  sgRNA
cccagaagccagggcgaacc

SEQ ID NO: 3640 - DNA, 20 bp, Artificial Sequence
  sgRNA
cccgaaagtgctaccaagtt

SEQ ID NO: 3641 - DNA, 20 bp, Artificial Sequence
  sgRNA
gatggcgcagcaccaactga

SEQ ID NO: 3642 - DNA, 20 bp, Artificial Sequence
  sgRNA
gacgcgtgtgtgtttctccc

SEQ ID NO: 3643 - DNA, 20 bp, Artificial Sequence
  sgRNA
agatgctcctcaacgtcaca

SEQ ID NO: 3644 - DNA, 20 bp, Artificial Sequence
  sgRNA
agcgctgcagaggttagtcg

SEQ ID NO: 3645 - DNA, 20 bp, Artificial Sequence
  sgRNA
gggcgacgccctgggacgct

SEQ ID NO: 3646 - DNA, 20 bp, Artificial Sequence
  sgRNA
gggcggcccgagctcaacgg

SEQ ID NO: 3647 - DNA, 20 bp, Artificial Sequence
  sgRNA
catagagtctggcctaggtt

SEQ ID NO: 3648 - DNA, 20 bp, Artificial Sequence
  sgRNA
ctcgcggttggaggaggcac

SEQ ID NO: 3649 - DNA, 20 bp, Artificial Sequence
  sgRNA
atttactgctggatggtttg

SEQ ID NO: 3650 - DNA, 20 bp, Artificial Sequence
  sgRNA
agagagctcccgtgtgcgct

SEQ ID NO: 3651 - DNA, 20 bp, Artificial Sequence
  sgRNA
cgtgaccacagcctatgccg

SEQ ID NO: 3652 - DNA, 20 bp, Artificial Sequence
  sgRNA
cgcacgcccagagatctcgc

SEQ ID NO: 3653 - DNA, 20 bp, Artificial Sequence
  sgRNA
agcagtcccttcttgcctcc

SEQ ID NO: 3654 - DNA, 20 bp, Artificial Sequence
  sgRNA
tgtgtgctccaacagtgagt

SEQ ID NO: 3655 - DNA, 20 bp, Artificial Sequence
  sgRNA
atgtcataggacagacacta

SEQ ID NO: 3656 - DNA, 20 bp, Artificial Sequence
  sgRNA
tctattcccgatatgcactc

SEQ ID NO: 3657 - DNA, 20 bp, Artificial Sequence
  sgRNA
ggcagtgatgcaagcgtttc

SEQ ID NO: 3658 - DNA, 20 bp, Artificial Sequence
  sgRNA
cgtgttaggtcggcgtccac

SEQ ID NO: 3659 - DNA, 20 bp, Artificial Sequence
  sgRNA
aggtgtgcggcttctaggaa

SEQ ID NO: 3660 - DNA, 20 bp, Artificial Sequence
  sgRNA
aacaaactagataccggaac

SEQ ID NO: 3661 - DNA, 20 bp, Artificial Sequence
  sgRNA
ggctactcctttgagaccct

SEQ ID NO: 3662 - DNA, 20 bp, Artificial Sequence
  sgRNA
tctaatcatagtgagcatgc

SEQ ID NO: 3663 - DNA, 20 bp, Artificial Sequence
  sgRNA
tggtcttaataggtgtgggc

SEQ ID NO: 3664 - DNA, 20 bp, Artificial Sequence
  sgRNA
gaccatcctataaggaagca

SEQ ID NO: 3665 - DNA, 20 bp, Artificial Sequence
  sgRNA
cggtgcccgctgaggcaaca

SEQ ID NO: 3666 - DNA, 20 bp, Artificial Sequence
  sgRNA
ttggttctggccagcgcgtc

SEQ ID NO: 3667 - DNA, 20 bp, Artificial Sequence
  sgRNA
cccggagtcagctccagggc

SEQ ID NO: 3668 - DNA, 20 bp, Artificial Sequence
  sgRNA
gttgaatcccatgccagttc

SEQ ID NO: 3669 - DNA, 20 bp, Artificial Sequence
  sgRNA
tccgcgctgagattgcggag

SEQ ID NO: 3670 - DNA, 20 bp, Artificial Sequence
  sgRNA
gtggagcaagaacgaaaggc

SEQ ID NO: 3671 - DNA, 20 bp, Artificial Sequence
  sgRNA
cgatggcggcgacggtttct

SEQ ID NO: 3672 - DNA, 20 bp, Artificial Sequence
  sgRNA
ccaacattgtctctcataga

SEQ ID NO: 3673 - DNA, 20 bp, Artificial Sequence
  sgRNA
gctgtgagctgcagatggta

SEQ ID NO: 3674 - DNA, 20 bp, Artificial Sequence
  sgRNA
gcgcggcgtcaagtgcagct

SEQ ID NO: 3675 - DNA, 20 bp, Artificial Sequence
  sgRNA
ggatagtctgattgtataaa

SEQ ID NO: 3676 - DNA, 20 bp, Artificial Sequence
  sgRNA
aacgggaagtgtgcgctgat

SEQ ID NO: 3677 - DNA, 20 bp, Artificial Sequence
  sgRNA
aaagtgcccgtcaagttcgg

SEQ ID NO: 3678 - DNA, 20 bp, Artificial Sequence
  sgRNA
actggtctgggcgctgtccg

SEQ ID NO: 3679 - DNA, 20 bp, Artificial Sequence
  sgRNA
aggtttagatttctttccta

SEQ ID NO: 3680 - DNA, 20 bp, Artificial Sequence
  sgRNA
ctgctgacgcgtcgctgctt

SEQ ID NO: 3681 - DNA, 20 bp, Artificial Sequence
  sgRNA
aatcaggctcctgaatataa

SEQ ID NO: 3682 - DNA, 20 bp, Artificial Sequence
  sgRNA
acagctatagggcacagtag

SEQ ID NO: 3683 - DNA, 20 bp, Artificial Sequence
  sgRNA
agaatccactcttctgttag

SEQ ID NO: 3684 - DNA, 20 bp, Artificial Sequence
  sgRNA
actctagggcatcccagtcc

SEQ ID NO: 3685 - DNA, 20 bp, Artificial Sequence
  sgRNA
cccgacggtccggctctgcg

SEQ ID NO: 3686 - DNA, 20 bp, Artificial Sequence
  sgRNA
ctaggcgtcccagagcacta

SEQ ID NO: 3687 - DNA, 20 bp, Artificial Sequence
  sgRNA
gagtcaatgaatgagtttat

SEQ ID NO: 3688 - DNA, 20 bp, Artificial Sequence
  sgRNA
cacatcgctcttgcacacac

SEQ ID NO: 3689 - DNA, 20 bp, Artificial Sequence
  sgRNA
ggcgacgttggcgtcgcggt

SEQ ID NO: 3690 - DNA, 20 bp, Artificial Sequence
  sgRNA
cttctgctaatacagaacag

SEQ ID NO: 3691 - DNA, 20 bp, Artificial Sequence
  sgRNA
gcgcgctctgaaatcaaact

SEQ ID NO: 3692 - DNA, 20 bp, Artificial Sequence
  sgRNA
agtgcagtaagcgtccttgg

SEQ ID NO: 3693 - DNA, 20 bp, Artificial Sequence
  sgRNA
ggaggacccaagctattgtg

SEQ ID NO: 3694 - DNA, 20 bp, Artificial Sequence
  sgRNA
tgtcagtagtaacctccaag

SEQ ID NO: 3695 - DNA, 20 bp, Artificial Sequence
  sgRNA
actgcttgtaaataaactgc

SEQ ID NO: 3696 - DNA, 20 bp, Artificial Sequence
  sgRNA
tatttgtctccgatgggcca

SEQ ID NO: 3697 - DNA, 20 bp, Artificial Sequence
  sgRNA
accagctgtccagcgcaccg

SEQ ID NO: 3698 - DNA, 20 bp, Artificial Sequence
  sgRNA
cccgagtttaggaagaggag

SEQ ID NO: 3699 - DNA, 20 bp, Artificial Sequence
  sgRNA
ccgcctctcagagtaacgat

SEQ ID NO: 3700 - DNA, 20 bp, Artificial Sequence
  sgRNA
acctgccctggtccaactgt

SEQ ID NO: 3701 - DNA, 20 bp, Artificial Sequence
  sgRNA
gcagccttccctgctcagaa

SEQ ID NO: 3702 - DNA, 20 bp, Artificial Sequence
  sgRNA
aggagggagggacgaagaga

SEQ ID NO: 3703 - DNA, 20 bp, Artificial Sequence
  sgRNA
ccagggctgatctagtttga

SEQ ID NO: 3704 - DNA, 20 bp, Artificial Sequence
  sgRNA
cccaccctagcctcggcggg

SEQ ID NO: 3705 - DNA, 20 bp, Artificial Sequence
  sgRNA
aaatggattataggactaac

SEQ ID NO: 3706 - DNA, 20 bp, Artificial Sequence
  sgRNA
aatgtagttgcttaggacag

SEQ ID NO: 3707 - DNA, 20 bp, Artificial Sequence
  sgRNA
aaagacagggcagagctcat

SEQ ID NO: 3708 - DNA, 20 bp, Artificial Sequence
  sgRNA
cccagcgtggttagcattat

SEQ ID NO: 3709 - DNA, 20 bp, Artificial Sequence
  sgRNA
ctgcggccctgctgctgctc

SEQ ID NO: 3710 - DNA, 20 bp, Artificial Sequence
  sgRNA
tggcgggcgggagtagacgc

SEQ ID NO: 3711 - DNA, 20 bp, Artificial Sequence
  sgRNA
gcgctcactcgctggcctcc

SEQ ID NO: 3712 - DNA, 20 bp, Artificial Sequence
  sgRNA
gccttgcagtccgtgttctc

SEQ ID NO: 3713 - DNA, 20 bp, Artificial Sequence
  sgRNA
tggcattccacccaaacact

SEQ ID NO: 3714 - DNA, 20 bp, Artificial Sequence
  sgRNA
ccacactcccgagcatccaa

SEQ ID NO: 3715 - DNA, 20 bp, Artificial Sequence
  sgRNA
ccggagcgaagcacgcacag

SEQ ID NO: 3716 - DNA, 20 bp, Artificial Sequence
  sgRNA
ggcgctgcggagcgagccgg

SEQ ID NO: 3717 - DNA, 20 bp, Artificial Sequence
  sgRNA
gtggatcgggacacctcctt

SEQ ID NO: 3718 - DNA, 20 bp, Artificial Sequence
  sgRNA
caggtgtcaccacgccggga

SEQ ID NO: 3719 - DNA, 20 bp, Artificial Sequence
  sgRNA
cacctgtctcttctctagac

SEQ ID NO: 3720 - DNA, 20 bp, Artificial Sequence
  sgRNA
gcttgtaggagggctgtcca

SEQ ID NO: 3721 - DNA, 20 bp, Artificial Sequence
  sgRNA
cgcgtctgcaaccgggtggg

SEQ ID NO: 3722 - DNA, 20 bp, Artificial Sequence
  sgRNA
tgctcaggtgcggtcgcgtc

SEQ ID NO: 3723 - DNA, 20 bp, Artificial Sequence
  sgRNA
ttataatgtccatctgaggg

SEQ ID NO: 3724 - DNA, 20 bp, Artificial Sequence
  sgRNA
cggcgttctcgagcctcgcg

SEQ ID NO: 3725 - DNA, 20 bp, Artificial Sequence
  sgRNA
tgactccgacagggagcagg

SEQ ID NO: 3726 - DNA, 20 bp, Artificial Sequence
  sgRNA
ctcactgatataaacattac

SEQ ID NO: 3727 - DNA, 20 bp, Artificial Sequence
  sgRNA
gttgtgattgatccaggtcc

SEQ ID NO: 3728 - DNA, 20 bp, Artificial Sequence
  sgRNA
cttctcattctgaactgctt

SEQ ID NO: 3729 - DNA, 20 bp, Artificial Sequence
  sgRNA
gagcttgcccaaaggcctcc

SEQ ID NO: 3730 - DNA, 20 bp, Artificial Sequence
  sgRNA
tagcctttgggatctggctc

SEQ ID NO: 3731 - DNA, 20 bp, Artificial Sequence
  sgRNA
tactgtccttgagaatggag

SEQ ID NO: 3732 - DNA, 20 bp, Artificial Sequence
  sgRNA
atcagagggcggcgttcgtc

SEQ ID NO: 3733 - DNA, 20 bp, Artificial Sequence
  sgRNA
ggtaaggaggaggatttgac

SEQ ID NO: 3734 - DNA, 20 bp, Artificial Sequence
  sgRNA
ggtcgtgggttgtccgatgc

SEQ ID NO: 3735 - DNA, 20 bp, Artificial Sequence
  sgRNA
cctttgtgcagccggaacta

SEQ ID NO: 3736 - DNA, 20 bp, Artificial Sequence
  sgRNA
tttggaggtgaatttagagc

SEQ ID NO: 3737 - DNA, 20 bp, Artificial Sequence
  sgRNA
tcgccctcctcgacctctcc

SEQ ID NO: 3738 - DNA, 20 bp, Artificial Sequence
  sgRNA
ggacgcagaattctctactt

SEQ ID NO: 3739 - DNA, 20 bp, Artificial Sequence
  sgRNA
ctagcctgtagcttatgccc

SEQ ID NO: 3740 - DNA, 20 bp, Artificial Sequence
  sgRNA
tcactagtgggagctggaga

SEQ ID NO: 3741 - DNA, 20 bp, Artificial Sequence
  sgRNA
acattctctccctctttacc

SEQ ID NO: 3742 - DNA, 20 bp, Artificial Sequence
  sgRNA
cggttgagcgcagtctttct

SEQ ID NO: 3743 - DNA, 20 bp, Artificial Sequence
  sgRNA
agggatagataattatctag

SEQ ID NO: 3744 - DNA, 20 bp, Artificial Sequence
  sgRNA
gcaggacggagcaaaggtcc

SEQ ID NO: 3745 - DNA, 20 bp, Artificial Sequence
  sgRNA
tgcaaagttattaagatcca

SEQ ID NO: 3746 - DNA, 20 bp, Artificial Sequence
  sgRNA
ctgaggtccctactctggtg

SEQ ID NO: 3747 - DNA, 20 bp, Artificial Sequence
  sgRNA
agtgcgcgccagaaagggac

SEQ ID NO: 3748 - DNA, 20 bp, Artificial Sequence
  sgRNA
taaacaattccaagaatgtc

SEQ ID NO: 3749 - DNA, 20 bp, Artificial Sequence
  sgRNA
cgccagagccttcgcgccag

SEQ ID NO: 3750 - DNA, 20 bp, Artificial Sequence
  sgRNA
accaaataagaattcatgag

SEQ ID NO: 3751 - DNA, 20 bp, Artificial Sequence
  sgRNA
gggatagtagtagaggtccc

SEQ ID NO: 3752 - DNA, 20 bp, Artificial Sequence
  sgRNA
acaaagccctgggagggccc

SEQ ID NO: 3753 - DNA, 20 bp, Artificial Sequence
  sgRNA
cggcagcaactaaacttggg

SEQ ID NO: 3754 - DNA, 20 bp, Artificial Sequence
  sgRNA
cttgccctaacattaccaaa

SEQ ID NO: 3755 - DNA, 20 bp, Artificial Sequence
  sgRNA
ccacagccactccagtaatg

SEQ ID NO: 3756 - DNA, 20 bp, Artificial Sequence
  sgRNA
ctgagaggatcgtaccatcc

SEQ ID NO: 3757 - DNA, 20 bp, Artificial Sequence
  sgRNA
aggatgcaagatataaggct

SEQ ID NO: 3758 - DNA, 20 bp, Artificial Sequence
  sgRNA
gcacgaagcacggccggttc

SEQ ID NO: 3759 - DNA, 20 bp, Artificial Sequence
  sgRNA
agaaggacagattggtggat

SEQ ID NO: 3760 - DNA, 20 bp, Artificial Sequence
  sgRNA
ccctcctttgcagagggcat

SEQ ID NO: 3761 - DNA, 20 bp, Artificial Sequence
  sgRNA
gtgaagtttaccatatttca

SEQ ID NO: 3762 - DNA, 20 bp, Artificial Sequence
  sgRNA
cgtgctctctctgcgctccg

SEQ ID NO: 3763 - DNA, 20 bp, Artificial Sequence
  sgRNA
cctgggagggacagactccc

SEQ ID NO: 3764 - DNA, 20 bp, Artificial Sequence
  sgRNA
ttacctccagctagagatgc

SEQ ID NO: 3765 - DNA, 20 bp, Artificial Sequence
  sgRNA
tatgattattgctgctcact

SEQ ID NO: 3766 - DNA, 20 bp, Artificial Sequence
  sgRNA
caatgtttcctggtatggtt

SEQ ID NO: 3767 - DNA, 20 bp, Artificial Sequence
  sgRNA
aacccgttctattccaggac

SEQ ID NO: 3768 - DNA, 20 bp, Artificial Sequence
  sgRNA
atattgcgccaacaggtcat

SEQ ID NO: 3769 - DNA, 20 bp, Artificial Sequence
  sgRNA
ggacattcggcgattcccac

SEQ ID NO: 3770 - DNA, 20 bp, Artificial Sequence
  sgRNA
agtgcaggccgctccaggat

SEQ ID NO: 3771 - DNA, 20 bp, Artificial Sequence
  sgRNA
ccctaagggacccgcccgca

SEQ ID NO: 3772 - DNA, 20 bp, Artificial Sequence
  sgRNA
agaacgccagtcccgtagca

SEQ ID NO: 3773 - DNA, 20 bp, Artificial Sequence
  sgRNA
cgcaccctttacacaaaccg

SEQ ID NO: 3774 - DNA, 20 bp, Artificial Sequence
  sgRNA
catcgggaccatctgcctag

SEQ ID NO: 3775 - DNA, 20 bp, Artificial Sequence
  sgRNA
gtctatcctgagggcaagca

SEQ ID NO: 3776 - DNA, 20 bp, Artificial Sequence
  sgRNA
gcttctgcttgaatacttct

SEQ ID NO: 3777 - DNA, 20 bp, Artificial Sequence
  sgRNA
gagcacttgcgtggttgccc

SEQ ID NO: 3778 - DNA, 20 bp, Artificial Sequence
  sgRNA
aaggactagtctccaccttt

SEQ ID NO: 3779 - DNA, 20 bp, Artificial Sequence
  sgRNA
gagtgtgaataggatctatg

SEQ ID NO: 3780 - DNA, 20 bp, Artificial Sequence
  sgRNA
ccgcgagatttctgattgcg

SEQ ID NO: 3781 - DNA, 20 bp, Artificial Sequence
  sgRNA
aaaggttctgcgaaagaggc

SEQ ID NO: 3782 - DNA, 20 bp, Artificial Sequence
  sgRNA
aaggtaggcttgatgacctg

SEQ ID NO: 3783 - DNA, 20 bp, Artificial Sequence
  sgRNA
gagcccaggaaattaattta

SEQ ID NO: 3784 - DNA, 20 bp, Artificial Sequence
  sgRNA
cagagtgtctggagcctaag

SEQ ID NO: 3785 - DNA, 20 bp, Artificial Sequence
  sgRNA
ggtctaggtctgaaagaatg

SEQ ID NO: 3786 - DNA, 20 bp, Artificial Sequence
  sgRNA
acactcctaggcagtgaagt

SEQ ID NO: 3787 - DNA, 20 bp, Artificial Sequence
  sgRNA
gacttgccttggtgtgactc

SEQ ID NO: 3788 - DNA, 20 bp, Artificial Sequence
  sgRNA
gcaagcaagcagtgattggc

SEQ ID NO: 3789 - DNA, 20 bp, Artificial Sequence
  sgRNA
tttgctgtgaggatgtgaac

SEQ ID NO: 3790 - DNA, 20 bp, Artificial Sequence
  sgRNA
caccggaagcagccgagcgc

SEQ ID NO: 3791 - DNA, 20 bp, Artificial Sequence
  sgRNA
gtggagccatagaaagaagg

SEQ ID NO: 3792 - DNA, 20 bp, Artificial Sequence
  sgRNA
gaagcagctgagacacagtc

SEQ ID NO: 3793 - DNA, 20 bp, Artificial Sequence
  sgRNA
gatctgctaagctcgcgaca

SEQ ID NO: 3794 - DNA, 20 bp, Artificial Sequence
  sgRNA
cctgagtgctcgagctaagg

SEQ ID NO: 3795 - DNA, 20 bp, Artificial Sequence
  sgRNA
gcgggcacagaggttccgtg

SEQ ID NO: 3796 - DNA, 20 bp, Artificial Sequence
  sgRNA
aggtgatctttatcgctctc

SEQ ID NO: 3797 - DNA, 20 bp, Artificial Sequence
  sgRNA
tgaactcctcttataattct

SEQ ID NO: 3798 - DNA, 20 bp, Artificial Sequence
  sgRNA
ctcacaaactgtaaccctgt

SEQ ID NO: 3799 - DNA, 20 bp, Artificial Sequence
  sgRNA
ggagatgcttccgttctcgc

SEQ ID NO: 3800 - DNA, 20 bp, Artificial Sequence
  sgRNA
taatcagatctttgacgaag

SEQ ID NO: 3801 - DNA, 20 bp, Artificial Sequence
  sgRNA
cgactcgctcattcgccgcc

SEQ ID NO: 3802 - DNA, 20 bp, Artificial Sequence
  sgRNA
tgaggtgtggctctaggcct

SEQ ID NO: 3803 - DNA, 20 bp, Artificial Sequence
  sgRNA
cggcttcaccgcgcgtgcct

SEQ ID NO: 3804 - DNA, 20 bp, Artificial Sequence
  sgRNA
cacacaagcagggcctctcg

SEQ ID NO: 3805 - DNA, 20 bp, Artificial Sequence
  sgRNA
ccgcggcgctcggacgggcc

SEQ ID NO: 3806 - DNA, 20 bp, Artificial Sequence
  sgRNA
ggaccggcacatcgacatcc

SEQ ID NO: 3807 - DNA, 20 bp, Artificial Sequence
  sgRNA
ggccagtccgtctctataaa

SEQ ID NO: 3808 - DNA, 20 bp, Artificial Sequence
  sgRNA
gggtgtctgaccgctctgac

SEQ ID NO: 3809 - DNA, 20 bp, Artificial Sequence
  sgRNA
ggcgcttgacgtggagtcgg

SEQ ID NO: 3810 - DNA, 20 bp, Artificial Sequence
  sgRNA
ggagcccggcacgaccagga

SEQ ID NO: 3811 - DNA, 20 bp, Artificial Sequence
  sgRNA
ctcccacgtgagaacgggca

SEQ ID NO: 3812 - DNA, 20 bp, Artificial Sequence
  sgRNA
ccacacgcagggccaaggag

SEQ ID NO: 3813 - DNA, 20 bp, Artificial Sequence
  sgRNA
cgaggctcggccctgccgtc

SEQ ID NO: 3814 - DNA, 20 bp, Artificial Sequence
  sgRNA
gctatgacgatgagactggc

SEQ ID NO: 3815 - DNA, 20 bp, Artificial Sequence
  sgRNA
tccacctcggtggcgacaac

SEQ ID NO: 3816 - DNA, 20 bp, Artificial Sequence
  sgRNA
ctctgctggcctcctaatcc

SEQ ID NO: 3817 - DNA, 20 bp, Artificial Sequence
  sgRNA
ggagtagccagtgatgtcac

SEQ ID NO: 3818 - DNA, 20 bp, Artificial Sequence
  sgRNA
tctacactgacttaaatcca

SEQ ID NO: 3819 - DNA, 20 bp, Artificial Sequence
  sgRNA
tcaagtactgtacttgctat

SEQ ID NO: 3820 - DNA, 20 bp, Artificial Sequence
  sgRNA
agctaaccatggaggagact

SEQ ID NO: 3821 - DNA, 20 bp, Artificial Sequence
  sgRNA
catcgggaaggcttgagtct

SEQ ID NO: 3822 - DNA, 20 bp, Artificial Sequence
  sgRNA
ataccacagcaaccttgacg

SEQ ID NO: 3823 - DNA, 20 bp, Artificial Sequence
  sgRNA
ctaggccaccttcagagccc

SEQ ID NO: 3824 - DNA, 20 bp, Artificial Sequence
  sgRNA
cgagcttagcacttgaaggg

SEQ ID NO: 3825 - DNA, 20 bp, Artificial Sequence
  sgRNA
ccaaatcctgctgctgagtc

SEQ ID NO: 3826 - DNA, 20 bp, Artificial Sequence
  sgRNA
gccggaaggcatcaagtcgc

SEQ ID NO: 3827 - DNA, 20 bp, Artificial Sequence
  sgRNA
tgggagggcgggtcaaacct

SEQ ID NO: 3828 - DNA, 20 bp, Artificial Sequence
  sgRNA
gattggaagtttcttccgcc

SEQ ID NO: 3829 - DNA, 20 bp, Artificial Sequence
  sgRNA
agctactagctccgtctccc

SEQ ID NO: 3830 - DNA, 20 bp, Artificial Sequence
  sgRNA
gaaaccgggagtagcgtccc

SEQ ID NO: 3831 - DNA, 20 bp, Artificial Sequence
  sgRNA
acagtttcacaacttgtgca

SEQ ID NO: 3832 - DNA, 20 bp, Artificial Sequence
  sgRNA
atgaagacgcccagagagaa

SEQ ID NO: 3833 - DNA, 20 bp, Artificial Sequence
  sgRNA
cacctgaatttctttgggaa

SEQ ID NO: 3834 - DNA, 20 bp, Artificial Sequence
  sgRNA
ggagtcgccgagtggtgggc

SEQ ID NO: 3835 - DNA, 20 bp, Artificial Sequence
  sgRNA
tttcacgttattccgcccag

SEQ ID NO: 3836 - DNA, 20 bp, Artificial Sequence
  sgRNA
gaggctgggctaggcagcgc

SEQ ID NO: 3837 - DNA, 20 bp, Artificial Sequence
  sgRNA
ggaaacgtgagattagatga

SEQ ID NO: 3838 - DNA, 20 bp, Artificial Sequence
  sgRNA
gtccgtacggcgaagtgatg

SEQ ID NO: 3839 - DNA, 20 bp, Artificial Sequence
  sgRNA
gaggaactacatttcccaga

SEQ ID NO: 3840 - DNA, 20 bp, Artificial Sequence
  sgRNA
cacccggtttccggaccttg

SEQ ID NO: 3841 - DNA, 20 bp, Artificial Sequence
  sgRNA
ctcgtctgcagtccctgacc

SEQ ID NO: 3842 - DNA, 20 bp, Artificial Sequence
  sgRNA
caaattcctgcgcctccagg

SEQ ID NO: 3843 - DNA, 20 bp, Artificial Sequence
  sgRNA
tgggcttcataggacagaag

SEQ ID NO: 3844 - DNA, 20 bp, Artificial Sequence
  sgRNA
taattctcacgctgttccga

SEQ ID NO: 3845 - DNA, 20 bp, Artificial Sequence
  sgRNA
ggaagggcagatatatgaac

SEQ ID NO: 3846 - DNA, 20 bp, Artificial Sequence
  sgRNA
agtgtggccggcaaagcttt

SEQ ID NO: 3847 - DNA, 20 bp, Artificial Sequence
  sgRNA
ggaaagtacaattatcagac

SEQ ID NO: 3848 - DNA, 20 bp, Artificial Sequence
  sgRNA
ccttgagcggaccctggact

SEQ ID NO: 3849 - DNA, 20 bp, Artificial Sequence
  sgRNA
ccacagcaggcctgcaagaa

SEQ ID NO: 3850 - DNA, 20 bp, Artificial Sequence
  sgRNA
cgcccaggaccctcaccaaa

SEQ ID NO: 3851 - DNA, 20 bp, Artificial Sequence
  sgRNA
cccaattctgggatgcttga

SEQ ID NO: 3852 - DNA, 20 bp, Artificial Sequence
  sgRNA
aacagttacgtcagatgtgg

SEQ ID NO: 3853 - DNA, 20 bp, Artificial Sequence
  sgRNA
acagtagtgtcagatagaag

SEQ ID NO: 3854 - DNA, 20 bp, Artificial Sequence
  sgRNA
gtgacaggagactagccagt

SEQ ID NO: 3855 - DNA, 20 bp, Artificial Sequence
  sgRNA
ggaaacacgagaggaccgcg

SEQ ID NO: 3856 - DNA, 20 bp, Artificial Sequence
  sgRNA
ggaccacgagctgagatggt

SEQ ID NO: 3857 - DNA, 20 bp, Artificial Sequence
  sgRNA
tcacttacctccttctcact

SEQ ID NO: 3858 - DNA, 20 bp, Artificial Sequence
  sgRNA
gctaatctatgctttgattc

SEQ ID NO: 3859 - DNA, 20 bp, Artificial Sequence
  sgRNA
cttgctcccagcagaactgg

SEQ ID NO: 3860 - DNA, 20 bp, Artificial Sequence
  sgRNA
tcccggccgcttcaaaccgc

SEQ ID NO: 3861 - DNA, 20 bp, Artificial Sequence
  sgRNA
tcagcttggtgatacgctct

SEQ ID NO: 3862 - DNA, 20 bp, Artificial Sequence
  sgRNA
ccagcctctaggaactagcg

SEQ ID NO: 3863 - DNA, 20 bp, Artificial Sequence
  sgRNA
cttcgagtctgaacccgccc

SEQ ID NO: 3864 - DNA, 20 bp, Artificial Sequence
  sgRNA
gtaaagtaaacacactctgt

SEQ ID NO: 3865 - DNA, 20 bp, Artificial Sequence
  sgRNA
ggctggctgcttagtgacat

SEQ ID NO: 3866 - DNA, 20 bp, Artificial Sequence
  sgRNA
gcatttaataaactgccttt

SEQ ID NO: 3867 - DNA, 20 bp, Artificial Sequence
  sgRNA
ggcaataacagcttcagcag

SEQ ID NO: 3868 - DNA, 20 bp, Artificial Sequence
  sgRNA
gctctcgggagcgatcagca

SEQ ID NO: 3869 - DNA, 20 bp, Artificial Sequence
  sgRNA
agattgaatctccgagttta

SEQ ID NO: 3870 - DNA, 20 bp, Artificial Sequence
  sgRNA
tcgcttgcacaggacccttc

SEQ ID NO: 3871 - DNA, 20 bp, Artificial Sequence
  sgRNA
cccgcgtcgcctgccgtggg

SEQ ID NO: 3872 - DNA, 20 bp, Artificial Sequence
  sgRNA
taggctgggcatccttgcag

SEQ ID NO: 3873 - DNA, 20 bp, Artificial Sequence
  sgRNA
ttctgagaaggcccgcccta

SEQ ID NO: 3874 - DNA, 20 bp, Artificial Sequence
  sgRNA
aaggacacaagtagcccgag

SEQ ID NO: 3875 - DNA, 20 bp, Artificial Sequence
  sgRNA
gagatttcccaggtggtatc

SEQ ID NO: 3876 - DNA, 20 bp, Artificial Sequence
  sgRNA
ggccctctcagatcacatgc

SEQ ID NO: 3877 - DNA, 20 bp, Artificial Sequence
  sgRNA
ttccaccggaagtgctccct

SEQ ID NO: 3878 - DNA, 20 bp, Artificial Sequence
  sgRNA
tttctcgaacagtatatcaa

SEQ ID NO: 3879 - DNA, 20 bp, Artificial Sequence
  sgRNA
aaagaagcaccgcccgctac

SEQ ID NO: 3880 - DNA, 20 bp, Artificial Sequence
  sgRNA
tggttaaagttggcttgcaa

SEQ ID NO: 3881 - DNA, 20 bp, Artificial Sequence
  sgRNA
tccacctgctgttcatcagc

SEQ ID NO: 3882 - DNA, 20 bp, Artificial Sequence
  sgRNA
agtcgccgcggcgccgacga

SEQ ID NO: 3883 - DNA, 20 bp, Artificial Sequence
  sgRNA
tctgaaaggaatcccaagag

SEQ ID NO: 3884 - DNA, 20 bp, Artificial Sequence
  sgRNA
ctgaggactgcgtggaggag

SEQ ID NO: 3885 - DNA, 20 bp, Artificial Sequence
  sgRNA
tatgtggagatattggttca

SEQ ID NO: 3886 - DNA, 20 bp, Artificial Sequence
  sgRNA
atggtttcatttacatgttg

SEQ ID NO: 3887 - DNA, 20 bp, Artificial Sequence
  sgRNA
tgctaatgcctgccagaggg

SEQ ID NO: 3888 - DNA, 20 bp, Artificial Sequence
  sgRNA
gcgcagggaaggatccgttt

SEQ ID NO: 3889 - DNA, 20 bp, Artificial Sequence
  sgRNA
ggctgttctctctcggtcaa

SEQ ID NO: 3890 - DNA, 20 bp, Artificial Sequence
  sgRNA
gcacttgttggagcagactg

SEQ ID NO: 3891 - DNA, 20 bp, Artificial Sequence
  sgRNA
tttgttcctcacttaccagc

SEQ ID NO: 3892 - DNA, 20 bp, Artificial Sequence
  sgRNA
gcgggactggttcttgaagt

SEQ ID NO: 3893 - DNA, 20 bp, Artificial Sequence
  sgRNA
ggtcgtacacctcggtgccc

SEQ ID NO: 3894 - DNA, 20 bp, Artificial Sequence
  sgRNA
aacatggccgccgaggaggg

SEQ ID NO: 3895 - DNA, 20 bp, Artificial Sequence
  sgRNA
tccttggctgggtccagtga

SEQ ID NO: 3896 - DNA, 20 bp, Artificial Sequence
  sgRNA
ggctcggcggacggccaggt

SEQ ID NO: 3897 - DNA, 20 bp, Artificial Sequence
  sgRNA
cccagttatccaaggaaacc

SEQ ID NO: 3898 - DNA, 20 bp, Artificial Sequence
  sgRNA
cagtatatgccagaatacat

SEQ ID NO: 3899 - DNA, 20 bp, Artificial Sequence
  sgRNA
tccgcagactgactcctcac

SEQ ID NO: 3900 - DNA, 20 bp, Artificial Sequence
  sgRNA
cagagacttggaatcttact

SEQ ID NO: 3901 - DNA, 20 bp, Artificial Sequence
  sgRNA
ttcagccttatgactcagtg

SEQ ID NO: 3902 - DNA, 20 bp, Artificial Sequence
  sgRNA
tggaagcgatcgctcactga

SEQ ID NO: 3903 - DNA, 20 bp, Artificial Sequence
  sgRNA
tgttatgaactcgcgctggg

SEQ ID NO: 3904 - DNA, 20 bp, Artificial Sequence
  sgRNA
ggtaaagggtcggagtcaca

SEQ ID NO: 3905 - DNA, 20 bp, Artificial Sequence
  sgRNA
ccctaattgggcggcccgga

SEQ ID NO: 3906 - DNA, 20 bp, Artificial Sequence
  sgRNA
ctatactctccaagtttctc

SEQ ID NO: 3907 - DNA, 20 bp, Artificial Sequence
  sgRNA
tgtatatctcagggacagtg

SEQ ID NO: 3908 - DNA, 20 bp, Artificial Sequence
  sgRNA
acatgaaactaatacggaaa

SEQ ID NO: 3909 - DNA, 20 bp, Artificial Sequence
  sgRNA
agaagctgtattcagctccc

SEQ ID NO: 3910 - DNA, 20 bp, Artificial Sequence
  sgRNA
ttggactccgctccgctgtt

SEQ ID NO: 3911 - DNA, 20 bp, Artificial Sequence
  sgRNA
gttgttctctgaaatggacc

SEQ ID NO: 3912 - DNA, 20 bp, Artificial Sequence
  sgRNA
gggagtcaggagaactctcc

SEQ ID NO: 3913 - DNA, 20 bp, Artificial Sequence
  sgRNA
gagataggtgcggttgtctc

SEQ ID NO: 3914 - DNA, 20 bp, Artificial Sequence
  sgRNA
actgaaagtaaagtaaacca

SEQ ID NO: 3915 - DNA, 20 bp, Artificial Sequence
  sgRNA
gaggctgctcacagtgtgta

SEQ ID NO: 3916 - DNA, 20 bp, Artificial Sequence
  sgRNA
actaacttccttccctgccc

SEQ ID NO: 3917 - DNA, 20 bp, Artificial Sequence
  sgRNA
atttgagaacagaccctaag

SEQ ID NO: 3918 - DNA, 20 bp, Artificial Sequence
  sgRNA
tgacactacccaaagtaatg

SEQ ID NO: 3919 - DNA, 20 bp, Artificial Sequence
  sgRNA
gagtgctgtcactcaagccc

SEQ ID NO: 3920 - DNA, 20 bp, Artificial Sequence
  sgRNA
aggctctcgcgggagcccgt

SEQ ID NO: 3921 - DNA, 20 bp, Artificial Sequence
  sgRNA
gtttgtgtcaccacagggtc

SEQ ID NO: 3922 - DNA, 20 bp, Artificial Sequence
  sgRNA
tctgtccctcccactggccc

SEQ ID NO: 3923 - DNA, 20 bp, Artificial Sequence
  sgRNA
actctggctttggagaagac

SEQ ID NO: 3924 - DNA, 20 bp, Artificial Sequence
  sgRNA
gtggcacagactgcaccatg

SEQ ID NO: 3925 - DNA, 20 bp, Artificial Sequence
  sgRNA
cggaaggatatacccgcttg

SEQ ID NO: 3926 - DNA, 20 bp, Artificial Sequence
  sgRNA
acaaatgacaaatatcaccc

SEQ ID NO: 3927 - DNA, 20 bp, Artificial Sequence
  sgRNA
ggaagtgttgttgaccgtag

SEQ ID NO: 3928 - DNA, 20 bp, Artificial Sequence
  sgRNA
gccattgtgcggtgcattgt

SEQ ID NO: 3929 - DNA, 20 bp, Artificial Sequence
  sgRNA
aatggaatgagaaagcggag

SEQ ID NO: 3930 - DNA, 20 bp, Artificial Sequence
  sgRNA
gcgccgggagtcggtgggac

SEQ ID NO: 3931 - DNA, 20 bp, Artificial Sequence
  sgRNA
aatcttaaccgcgttgccat

SEQ ID NO: 3932 - DNA, 20 bp, Artificial Sequence
  sgRNA
gtccgacggactgtacttta

SEQ ID NO: 3933 - DNA, 20 bp, Artificial Sequence
  sgRNA
tgtgaccctagtggttggcg

SEQ ID NO: 3934 - DNA, 20 bp, Artificial Sequence
  sgRNA
gcagggagcgcgcgatcccg

SEQ ID NO: 3935 - DNA, 20 bp, Artificial Sequence
  sgRNA
gtgcctctaggcggaagtgc

SEQ ID NO: 3936 - DNA, 20 bp, Artificial Sequence
  sgRNA
gttgagcaattataggagct

SEQ ID NO: 3937 - DNA, 20 bp, Artificial Sequence
  sgRNA
ggaaggcgctccggatgcgg

SEQ ID NO: 3938 - DNA, 20 bp, Artificial Sequence
  sgRNA
agaactgacaactcatctac

SEQ ID NO: 3939 - DNA, 20 bp, Artificial Sequence
  sgRNA
actgagatactgaatgagac

SEQ ID NO: 3940 - DNA, 20 bp, Artificial Sequence
  sgRNA
tttaaatcgagttcctgaga

SEQ ID NO: 3941 - DNA, 20 bp, Artificial Sequence
  sgRNA
tcagggtaggtgaagggtgt

SEQ ID NO: 3942 - DNA, 20 bp, Artificial Sequence
  sgRNA
tctaaatgacctgtaaccac

SEQ ID NO: 3943 - DNA, 20 bp, Artificial Sequence
  sgRNA
ccggctcggcgtctcgcgag

SEQ ID NO: 3944 - DNA, 20 bp, Artificial Sequence
  sgRNA
gcggtccctcaatgacgcac

SEQ ID NO: 3945 - DNA, 20 bp, Artificial Sequence
  sgRNA
tgactcgtcctttgggtgct

SEQ ID NO: 3946 - DNA, 20 bp, Artificial Sequence
  sgRNA
ctacccagggagaaagacac

SEQ ID NO: 3947 - DNA, 20 bp, Artificial Sequence
  sgRNA
atagggttccacaatggccg

SEQ ID NO: 3948 - DNA, 20 bp, Artificial Sequence
  sgRNA
cggaacacaacccgcttctc

SEQ ID NO: 3949 - DNA, 20 bp, Artificial Sequence
  sgRNA
gcacgccgctgctgctcagc

SEQ ID NO: 3950 - DNA, 20 bp, Artificial Sequence
  sgRNA
aggactgctgatcctcctca

SEQ ID NO: 3951 - DNA, 20 bp, Artificial Sequence
  sgRNA
cgtgtgcgagctgtcaacca

SEQ ID NO: 3952 - DNA, 20 bp, Artificial Sequence
  sgRNA
ggtcctcccttagactcgag

SEQ ID NO: 3953 - DNA, 20 bp, Artificial Sequence
  sgRNA
aggtctcacacttgtgtcat

SEQ ID NO: 3954 - DNA, 20 bp, Artificial Sequence
  sgRNA
gggcgaggcgcctcacgcgc

SEQ ID NO: 3955 - DNA, 20 bp, Artificial Sequence
  sgRNA
gggcagccgacgtgtcaggg

SEQ ID NO: 3956 - DNA, 20 bp, Artificial Sequence
  sgRNA
tgctgcatagagttaaagcc

SEQ ID NO: 3957 - DNA, 20 bp, Artificial Sequence
  sgRNA
gggcttgtaaccgaatccac

SEQ ID NO: 3958 - DNA, 20 bp, Artificial Sequence
  sgRNA
ctttaacaaggcgacccgcc

SEQ ID NO: 3959 - DNA, 20 bp, Artificial Sequence
  sgRNA
actgctgacttcctgatcac

SEQ ID NO: 3960 - DNA, 20 bp, Artificial Sequence
  sgRNA
gagttccggccaggacctgg

SEQ ID NO: 3961 - DNA, 20 bp, Artificial Sequence
  sgRNA
gtggatttatgatgacacaa

SEQ ID NO: 3962 - DNA, 20 bp, Artificial Sequence
  sgRNA
tctccaatcagctgtattcc

SEQ ID NO: 3963 - DNA, 20 bp, Artificial Sequence
  sgRNA
aggctgtgttgcaatcgctg

SEQ ID NO: 3964 - DNA, 20 bp, Artificial Sequence
  sgRNA
gtgcaaatccgagcagtgga

SEQ ID NO: 3965 - DNA, 20 bp, Artificial Sequence
  sgRNA
agccgtccagcgctcaccgc

SEQ ID NO: 3966 - DNA, 20 bp, Artificial Sequence
  sgRNA
aaatctagggtgggcagatg

SEQ ID NO: 3967 - DNA, 20 bp, Artificial Sequence
  sgRNA
ctcggacagtaagcaaagcc

SEQ ID NO: 3968 - DNA, 20 bp, Artificial Sequence
  sgRNA
gctcagggctcccgcgtacc

SEQ ID NO: 3969 - DNA, 20 bp, Artificial Sequence
  sgRNA
ggaacagggattctcccttg

SEQ ID NO: 3970 - DNA, 20 bp, Artificial Sequence
  sgRNA
aaataggtcagagttccaat

SEQ ID NO: 3971 - DNA, 20 bp, Artificial Sequence
  sgRNA
tgtgttggtacggtagcctt

SEQ ID NO: 3972 - DNA, 20 bp, Artificial Sequence
  sgRNA
gccttgccctcagacggtag

SEQ ID NO: 3973 - DNA, 20 bp, Artificial Sequence
  sgRNA
gaatagctaggcttacagtt

SEQ ID NO: 3974 - DNA, 20 bp, Artificial Sequence
  sgRNA
agtgcaagtgcgaggtacct

SEQ ID NO: 3975 - DNA, 20 bp, Artificial Sequence
  sgRNA
ccagttgtgcagtgttcacg

SEQ ID NO: 3976 - DNA, 20 bp, Artificial Sequence
  sgRNA
tgttcccggccttgaggatc

SEQ ID NO: 3977 - DNA, 20 bp, Artificial Sequence
  sgRNA
gtgggtacccggaccattga

SEQ ID NO: 3978 - DNA, 20 bp, Artificial Sequence
  sgRNA
acaatttaaaggcagtctag

SEQ ID NO: 3979 - DNA, 20 bp, Artificial Sequence
  sgRNA
tagggattgatagggttgtg

SEQ ID NO: 3980 - DNA, 20 bp, Artificial Sequence
  sgRNA
aaatgaggacaaagcccgcc

SEQ ID NO: 3981 - DNA, 20 bp, Artificial Sequence
  sgRNA
ggtctggcttgggatagctt

SEQ ID NO: 3982 - DNA, 20 bp, Artificial Sequence
  sgRNA
acatgggtgtgtctgaccag

SEQ ID NO: 3983 - DNA, 20 bp, Artificial Sequence
  sgRNA
gctgcttcgggagtgcgctt

SEQ ID NO: 3984 - DNA, 20 bp, Artificial Sequence
  sgRNA
gtagtttacaggccatcgcc

SEQ ID NO: 3985 - DNA, 20 bp, Artificial Sequence
  sgRNA
gacagatgcaccaagaggtg

SEQ ID NO: 3986 - DNA, 20 bp, Artificial Sequence
  sgRNA
cctgacggtgccagggttgg

SEQ ID NO: 3987 - DNA, 20 bp, Artificial Sequence
  sgRNA
tgcgaggtcctagacatcct

SEQ ID NO: 3988 - DNA, 20 bp, Artificial Sequence
  sgRNA
aaacttaaagcacgactcct

SEQ ID NO: 3989 - DNA, 20 bp, Artificial Sequence
  sgRNA
ctcaagtccggttgtcggcc

SEQ ID NO: 3990 - DNA, 20 bp, Artificial Sequence
  sgRNA
ctgctggagataaacgcttg

SEQ ID NO: 3991 - DNA, 20 bp, Artificial Sequence
  sgRNA
gaccaatcggtgtgcgcgcg

SEQ ID NO: 3992 - DNA, 20 bp, Artificial Sequence
  sgRNA
agcatgtggcaacgtcacag

SEQ ID NO: 3993 - DNA, 20 bp, Artificial Sequence
  sgRNA
gctgcagtaatagcaaactg

SEQ ID NO: 3994 - DNA, 20 bp, Artificial Sequence
  sgRNA
aggccgagagaagggcttcg

SEQ ID NO: 3995 - DNA, 20 bp, Artificial Sequence
  sgRNA
ctttgctctcgccgctgcca

SEQ ID NO: 3996 - DNA, 20 bp, Artificial Sequence
  sgRNA
aaccaattacagtctccctc

SEQ ID NO: 3997 - DNA, 20 bp, Artificial Sequence
  sgRNA
ctggaatgagccaccagagt

SEQ ID NO: 3998 - DNA, 20 bp, Artificial Sequence
  sgRNA
gggcgacttctgcaatcaag

SEQ ID NO: 3999 - DNA, 20 bp, Artificial Sequence
  sgRNA
gcgtggccaccgaagaggcg

SEQ ID NO: 4000 - DNA, 20 bp, Artificial Sequence
  sgRNA
agctttcacagcagattatg

SEQ ID NO: 4001 - DNA, 20 bp, Artificial Sequence
  sgRNA
gggagtggcgcccacggatc

SEQ ID NO: 4002 - DNA, 20 bp, Artificial Sequence
  sgRNA
gagcagagtccgcaccacct

SEQ ID NO: 4003 - DNA, 20 bp, Artificial Sequence
  sgRNA
gatgaggataagaagggcat

SEQ ID NO: 4004 - DNA, 20 bp, Artificial Sequence
  sgRNA
cacccactgtgccctataat

SEQ ID NO: 4005 - DNA, 20 bp, Artificial Sequence
  sgRNA
caccatgtgtttacactgat

SEQ ID NO: 4006 - DNA, 20 bp, Artificial Sequence
  sgRNA
gtagaggcggccacttcgta

SEQ ID NO: 4007 - DNA, 20 bp, Artificial Sequence
  sgRNA
agagaaatattaatccaggc

SEQ ID NO: 4008 - DNA, 20 bp, Artificial Sequence
  sgRNA
ggcggccggcggcgatatgc

SEQ ID NO: 4009 - DNA, 20 bp, Artificial Sequence
  sgRNA
gttacgtcataccaccaccg

SEQ ID NO: 4010 - DNA, 20 bp, Artificial Sequence
  sgRNA
gttgtataatttgatatccc

SEQ ID NO: 4011 - DNA, 20 bp, Artificial Sequence
  sgRNA
cgctttgctgagctaggcta

SEQ ID NO: 4012 - DNA, 20 bp, Artificial Sequence
  sgRNA
gcttattgttgggcagtgta

SEQ ID NO: 4013 - DNA, 20 bp, Artificial Sequence
  sgRNA
ccctgcgagccaggcacgcg

SEQ ID NO: 4014 - DNA, 20 bp, Artificial Sequence
  sgRNA
ggagcggtgcttccaccgcc

SEQ ID NO: 4015 - DNA, 20 bp, Artificial Sequence
  sgRNA
ccctcctgtcgcacaggtcg

SEQ ID NO: 4016 - DNA, 20 bp, Artificial Sequence
  sgRNA
agggcgcagttgggcgctcc

SEQ ID NO: 4017 - DNA, 20 bp, Artificial Sequence
  sgRNA
ccatgaacgttaacagtctg

SEQ ID NO: 4018 - DNA, 20 bp, Artificial Sequence
  sgRNA
tggtttatggaatatctgat

SEQ ID NO: 4019 - DNA, 20 bp, Artificial Sequence
  sgRNA
cgtctgtgaatgtatcagtt

SEQ ID NO: 4020 - DNA, 20 bp, Artificial Sequence
  sgRNA
ttcctctcctcttgctttaa

SEQ ID NO: 4021 - DNA, 20 bp, Artificial Sequence
  sgRNA
aaggagctggatagatcaac

SEQ ID NO: 4022 - DNA, 20 bp, Artificial Sequence
  sgRNA
cagcaatcgtccctttaaat

SEQ ID NO: 4023 - DNA, 20 bp, Artificial Sequence
  sgRNA
taactgtccaattaggaacg

SEQ ID NO: 4024 - DNA, 20 bp, Artificial Sequence
  sgRNA
gtcgaaatcgaaattgaaat

SEQ ID NO: 4025 - DNA, 20 bp, Artificial Sequence
  sgRNA
ccaaattaacccattattgt

SEQ ID NO: 4026 - DNA, 20 bp, Artificial Sequence
  sgRNA
cgctggtcccgccactacgc

SEQ ID NO: 4027 - DNA, 20 bp, Artificial Sequence
  sgRNA
agtgtgtcattacacagaac

SEQ ID NO: 4028 - DNA, 20 bp, Artificial Sequence
  sgRNA
ggattctcagaagtgggtgg

SEQ ID NO: 4029 - DNA, 20 bp, Artificial Sequence
  sgRNA
gggtcttgagttcaagagat

SEQ ID NO: 4030 - DNA, 20 bp, Artificial Sequence
  sgRNA
catcagagatcattgggcta

SEQ ID NO: 4031 - DNA, 20 bp, Artificial Sequence
  sgRNA
ttacagcccggctctgtgat

SEQ ID NO: 4032 - DNA, 20 bp, Artificial Sequence
  sgRNA
tgcgcactggcgccggcgtg

SEQ ID NO: 4033 - DNA, 20 bp, Artificial Sequence
  sgRNA
gacagggcgggactcccttc

SEQ ID NO: 4034 - DNA, 20 bp, Artificial Sequence
  sgRNA
gtgaaccttagagagtccgc

SEQ ID NO: 4035 - DNA, 20 bp, Artificial Sequence
  sgRNA
gtcacttccgcccaccggag

SEQ ID NO: 4036 - DNA, 20 bp, Artificial Sequence
  sgRNA
gttgtcaacttgacatatct

SEQ ID NO: 4037 - DNA, 20 bp, Artificial Sequence
  sgRNA
ggaggagagcaatgtgtgta

SEQ ID NO: 4038 - DNA, 20 bp, Artificial Sequence
  sgRNA
aggccacgtcgacggtggcg

SEQ ID NO: 4039 - DNA, 20 bp, Artificial Sequence
  sgRNA
gtctacgtcagaagtccgcg

SEQ ID NO: 4040 - DNA, 20 bp, Artificial Sequence
  sgRNA
cccttccagaagctgggcgc

SEQ ID NO: 4041 - DNA, 20 bp, Artificial Sequence
  sgRNA
gacggaagtcgccaggcttc

SEQ ID NO: 4042 - DNA, 20 bp, Artificial Sequence
  sgRNA
gaactgaatgtcgctcattt

SEQ ID NO: 4043 - DNA, 20 bp, Artificial Sequence
  sgRNA
ttccagcagctgcgtttgcc

SEQ ID NO: 4044 - DNA, 20 bp, Artificial Sequence
  sgRNA
tggctgactgatgtccgcgg

SEQ ID NO: 4045 - DNA, 20 bp, Artificial Sequence
  sgRNA
gcagggcgcgttgaaacttt

SEQ ID NO: 4046 - DNA, 20 bp, Artificial Sequence
  sgRNA
cccgcaccgcctccgttgag

SEQ ID NO: 4047 - DNA, 20 bp, Artificial Sequence
  sgRNA
ggttgctctcgcggcgcgcc

SEQ ID NO: 4048 - DNA, 20 bp, Artificial Sequence
  sgRNA
acccgttaggagctgtacac

SEQ ID NO: 4049 - DNA, 20 bp, Artificial Sequence
  sgRNA
catatattactttagcggct

SEQ ID NO: 4050 - DNA, 20 bp, Artificial Sequence
  sgRNA
agtccaaatgagtgcttcta

SEQ ID NO: 4051 - DNA, 20 bp, Artificial Sequence
  sgRNA
ttactaaacaaactgaatcg

SEQ ID NO: 4052 - DNA, 20 bp, Artificial Sequence
  sgRNA
caggcacagcaggcgtggag

SEQ ID NO: 4053 - DNA, 20 bp, Artificial Sequence
  sgRNA
cgaatgctaatgagctgaaa

SEQ ID NO: 4054 - DNA, 20 bp, Artificial Sequence
  sgRNA
aaaggatgtaaactttacag

SEQ ID NO: 4055 - DNA, 20 bp, Artificial Sequence
  sgRNA
gctccggagcccaaacctgt

SEQ ID NO: 4056 - DNA, 20 bp, Artificial Sequence
  sgRNA
tgtcaggaagtggacagggt

SEQ ID NO: 4057 - DNA, 20 bp, Artificial Sequence
  sgRNA
ctttcatttactgcagagca

SEQ ID NO: 4058 - DNA, 20 bp, Artificial Sequence
  sgRNA
tagcattgcttataaattgc

SEQ ID NO: 4059 - DNA, 20 bp, Artificial Sequence
  sgRNA
gcagacgcgagtttgagccg

SEQ ID NO: 4060 - DNA, 20 bp, Artificial Sequence
  sgRNA
ctagggcgagttacggatgg

SEQ ID NO: 4061 - DNA, 20 bp, Artificial Sequence
  sgRNA
agtcagtgggtgtgtgtctg

SEQ ID NO: 4062 - DNA, 20 bp, Artificial Sequence
  sgRNA
gtcgggacgtgtgcttcact

SEQ ID NO: 4063 - DNA, 20 bp, Artificial Sequence
  sgRNA
ggcgggacttcctcgccgca

SEQ ID NO: 4064 - DNA, 20 bp, Artificial Sequence
  sgRNA
aagggttcctgagacagcca

SEQ ID NO: 4065 - DNA, 20 bp, Artificial Sequence
  sgRNA
acgagcccagcgagcgataa

SEQ ID NO: 4066 - DNA, 20 bp, Artificial Sequence
  sgRNA
ttaccctgaaagttagctac

SEQ ID NO: 4067 - DNA, 20 bp, Artificial Sequence
  sgRNA
ttgcactgaacgagggccgc

SEQ ID NO: 4068 - DNA, 20 bp, Artificial Sequence
  sgRNA
gctgtttgtcactttcaatg

SEQ ID NO: 4069 - DNA, 20 bp, Artificial Sequence
  sgRNA
ttcaaaccaagatccagata

SEQ ID NO: 4070 - DNA, 20 bp, Artificial Sequence
  sgRNA
taaagaccacgccgcggccg

SEQ ID NO: 4071 - DNA, 20 bp, Artificial Sequence
  sgRNA
ttcgcggatccacagtaggg

SEQ ID NO: 4072 - DNA, 20 bp, Artificial Sequence
  sgRNA
ccaacctggtgccacaatat

SEQ ID NO: 4073 - DNA, 20 bp, Artificial Sequence
  sgRNA
cagggaaagactccacgcaa

SEQ ID NO: 4074 - DNA, 20 bp, Artificial Sequence
  sgRNA
cgtgggtgtgcaagggtgca

SEQ ID NO: 4075 - DNA, 20 bp, Artificial Sequence
  sgRNA
gtctgtccggttgcgccgag

SEQ ID NO: 4076 - DNA, 20 bp, Artificial Sequence
  sgRNA
gtgccgctgtcgccgagcgt

SEQ ID NO: 4077 - DNA, 20 bp, Artificial Sequence
  sgRNA
tggcggtgtccgctgctgcc

SEQ ID NO: 4078 - DNA, 20 bp, Artificial Sequence
  sgRNA
gctttcactatgcacatttc

SEQ ID NO: 4079 - DNA, 20 bp, Artificial Sequence
  sgRNA
gcgcgggactagacacaaag

SEQ ID NO: 4080 - DNA, 20 bp, Artificial Sequence
  sgRNA
tgcagtatggtgtgtgtgtt

SEQ ID NO: 4081 - DNA, 20 bp, Artificial Sequence
  sgRNA
catctatcgatcatagtgca

SEQ ID NO: 4082 - DNA, 20 bp, Artificial Sequence
  sgRNA
cttcccacacgcgccctgcc

SEQ ID NO: 4083 - DNA, 20 bp, Artificial Sequence
  sgRNA
aatcttaaagactgggagcc

SEQ ID NO: 4084 - DNA, 20 bp, Artificial Sequence
  sgRNA
tcaaggaccaatcgtacccg

SEQ ID NO: 4085 - DNA, 20 bp, Artificial Sequence
  sgRNA
cccggcgccaactgtggagg

SEQ ID NO: 4086 - DNA, 20 bp, Artificial Sequence
  sgRNA
gggcagcgagcgaatccgat

SEQ ID NO: 4087 - DNA, 20 bp, Artificial Sequence
  sgRNA
gggcttgaagctcagaataa

SEQ ID NO: 4088 - DNA, 20 bp, Artificial Sequence
  sgRNA
aaagaggagggaggtacaca

SEQ ID NO: 4089 - DNA, 20 bp, Artificial Sequence
  sgRNA
gaagaggatgccgagagcac

SEQ ID NO: 4090 - DNA, 20 bp, Artificial Sequence
  sgRNA
ggcggagccctatggactcc

SEQ ID NO: 4091 - DNA, 20 bp, Artificial Sequence
  sgRNA
ttcctaggaagccgcgccga

SEQ ID NO: 4092 - DNA, 20 bp, Artificial Sequence
  sgRNA
cccatctcacgcccacggcg

SEQ ID NO: 4093 - DNA, 20 bp, Artificial Sequence
  sgRNA
aagcaactcggcgttccctg

SEQ ID NO: 4094 - DNA, 20 bp, Artificial Sequence
  sgRNA
agctcagggaagcgcagccc

SEQ ID NO: 4095 - DNA, 20 bp, Artificial Sequence
  sgRNA
agggcaccggaagctgcagc

SEQ ID NO: 4096 - DNA, 20 bp, Artificial Sequence
  sgRNA
ccagttcacagggctcccaa

SEQ ID NO: 4097 - DNA, 20 bp, Artificial Sequence
  sgRNA
gaagccacaaatgcttgcag

SEQ ID NO: 4098 - DNA, 20 bp, Artificial Sequence
  sgRNA
tcaaagtcgcggaagccaat

SEQ ID NO: 4099 - DNA, 20 bp, Artificial Sequence
  sgRNA
gtagttgagaacttcagccc

SEQ ID NO: 4100 - DNA, 20 bp, Artificial Sequence
  sgRNA
tatagctcgcgggcttaggc

SEQ ID NO: 4101 - DNA, 20 bp, Artificial Sequence
  sgRNA
cccgcggcactgaccgtcgg

SEQ ID NO: 4102 - DNA, 20 bp, Artificial Sequence
  sgRNA
gcaacatggcagcttctacc

SEQ ID NO: 4103 - DNA, 20 bp, Artificial Sequence
  sgRNA
ttggaagctcgctgattggc

SEQ ID NO: 4104 - DNA, 20 bp, Artificial Sequence
  sgRNA
ttatagtatcctgggaacca

SEQ ID NO: 4105 - DNA, 20 bp, Artificial Sequence
  sgRNA
tggactgatcgctcaggcaa

SEQ ID NO: 4106 - DNA, 20 bp, Artificial Sequence
  sgRNA
tacgcagttcactgggctgt

SEQ ID NO: 4107 - DNA, 20 bp, Artificial Sequence
  sgRNA
ctgcacgaaatgcttctctt

SEQ ID NO: 4108 - DNA, 20 bp, Artificial Sequence
  sgRNA
atcaaagttcaatctagctt

SEQ ID NO: 4109 - DNA, 20 bp, Artificial Sequence
  sgRNA
cacttcctccgcccacgagc

SEQ ID NO: 4110 - DNA, 20 bp, Artificial Sequence
  sgRNA
taaagtgggactttcagatc

SEQ ID NO: 4111 - DNA, 20 bp, Artificial Sequence
  sgRNA
gcagccttacctgagtactt

SEQ ID NO: 4112 - DNA, 20 bp, Artificial Sequence
  sgRNA
gtgcgtccgaaggcggaagg

SEQ ID NO: 4113 - DNA, 20 bp, Artificial Sequence
  sgRNA
acgctgccacctacagcgtc

SEQ ID NO: 4114 - DNA, 20 bp, Artificial Sequence
  sgRNA
aagcagtatactcaaatctg

SEQ ID NO: 4115 - DNA, 20 bp, Artificial Sequence
  sgRNA
ttcatcccgcctgggatctg

SEQ ID NO: 4116 - DNA, 20 bp, Artificial Sequence
  sgRNA
gctggcgcgggcaggaggag

SEQ ID NO: 4117 - DNA, 20 bp, Artificial Sequence
  sgRNA
atgctggagtttggtcaatg

SEQ ID NO: 4118 - DNA, 20 bp, Artificial Sequence
  sgRNA
gggaaagggagagtgagagg

SEQ ID NO: 4119 - DNA, 20 bp, Artificial Sequence
  sgRNA
aaactgtcaagccagcgcct

SEQ ID NO: 4120 - DNA, 20 bp, Artificial Sequence
  sgRNA
ctggagctccgcacccgttt

SEQ ID NO: 4121 - DNA, 20 bp, Artificial Sequence
  sgRNA
tcgctcggaacgcgttccgg

SEQ ID NO: 4122 - DNA, 20 bp, Artificial Sequence
  sgRNA
gtggctgtcttccacttctc

SEQ ID NO: 4123 - DNA, 20 bp, Artificial Sequence
  sgRNA
atcaagcctagagcaaagcc

SEQ ID NO: 4124 - DNA, 20 bp, Artificial Sequence
  sgRNA
cccagcaacaccaataagct

SEQ ID NO: 4125 - DNA, 20 bp, Artificial Sequence
  sgRNA
tctccgcggacgagacagcg

SEQ ID NO: 4126 - DNA, 20 bp, Artificial Sequence
  sgRNA
aaagagcagagtgaaccaat

SEQ ID NO: 4127 - DNA, 20 bp, Artificial Sequence
  sgRNA
gtgctgctctgggactgaac

SEQ ID NO: 4128 - DNA, 20 bp, Artificial Sequence
  sgRNA
gtactgggttctttagctcc

SEQ ID NO: 4129 - DNA, 20 bp, Artificial Sequence
  sgRNA
cgggcggcccgcgagcttga

SEQ ID NO: 4130 - DNA, 20 bp, Artificial Sequence
  sgRNA
ctctccgccggtgcgggtgt

SEQ ID NO: 4131 - DNA, 20 bp, Artificial Sequence
  sgRNA
gccttctattggcccagtga

SEQ ID NO: 4132 - DNA, 20 bp, Artificial Sequence
  sgRNA
ggtctttcagcatcacctcc

SEQ ID NO: 4133 - DNA, 20 bp, Artificial Sequence
  sgRNA
cccacggtaggaggacgcag

SEQ ID NO: 4134 - DNA, 20 bp, Artificial Sequence
  sgRNA
aaagcagccggtcagaggtg

SEQ ID NO: 4135 - DNA, 20 bp, Artificial Sequence
  sgRNA
gagttaatgaagtactaggc

SEQ ID NO: 4136 - DNA, 20 bp, Artificial Sequence
  sgRNA
aatgcaaacacaactgtcag

SEQ ID NO: 4137 - DNA, 20 bp, Artificial Sequence
  sgRNA
gagcaagcctgttgggcacg

SEQ ID NO: 4138 - DNA, 20 bp, Artificial Sequence
  sgRNA
gcttctaaaggctactccct

SEQ ID NO: 4139 - DNA, 20 bp, Artificial Sequence
  sgRNA
tgcgcgtgcgtcgcgccgga

SEQ ID NO: 4140 - DNA, 20 bp, Artificial Sequence
  sgRNA
ccaagtgcggtgagccgttg

SEQ ID NO: 4141 - DNA, 20 bp, Artificial Sequence
  sgRNA
gcaggccatgtcaactcacc

SEQ ID NO: 4142 - DNA, 20 bp, Artificial Sequence
  sgRNA
ccggtgcacagcaagtgtcc

SEQ ID NO: 4143 - DNA, 20 bp, Artificial Sequence
  sgRNA
atagggttacaccgctgctg

SEQ ID NO: 4144 - DNA, 20 bp, Artificial Sequence
  sgRNA
atctttgacttctagcttgg

SEQ ID NO: 4145 - DNA, 20 bp, Artificial Sequence
  sgRNA
gaatctggacacacctcctc

SEQ ID NO: 4146 - DNA, 20 bp, Artificial Sequence
  sgRNA
catccgggccagggatactc

SEQ ID NO: 4147 - DNA, 20 bp, Artificial Sequence
  sgRNA
gagaagacgaagacagggcc

SEQ ID NO: 4148 - DNA, 20 bp, Artificial Sequence
  sgRNA
tgattgagattatgttccaa

SEQ ID NO: 4149 - DNA, 20 bp, Artificial Sequence
  sgRNA
catgaaagtgtctgttcaag

SEQ ID NO: 4150 - DNA, 20 bp, Artificial Sequence
  sgRNA
gcaggcaagcaccttccaac

SEQ ID NO: 4151 - DNA, 20 bp, Artificial Sequence
  sgRNA
attactattgctttctggaa

SEQ ID NO: 4152 - DNA, 20 bp, Artificial Sequence
  sgRNA
ggcgagggagaggacgccct

SEQ ID NO: 4153 - DNA, 20 bp, Artificial Sequence
  sgRNA
tcacacttcttcaaagtgct

SEQ ID NO: 4154 - DNA, 20 bp, Artificial Sequence
  sgRNA
tccgtgcgcagcacacagag

SEQ ID NO: 4155 - DNA, 20 bp, Artificial Sequence
  sgRNA
tctacactgcgggctccgag

SEQ ID NO: 4156 - DNA, 20 bp, Artificial Sequence
  sgRNA
ctacatcgttcatggagtgc

SEQ ID NO: 4157 - DNA, 20 bp, Artificial Sequence
  sgRNA
cggaggctggaactcacctg

SEQ ID NO: 4158 - DNA, 20 bp, Artificial Sequence
  sgRNA
tcagcgtggaattcatgaag

SEQ ID NO: 4159 - DNA, 20 bp, Artificial Sequence
  sgRNA
aggaccgcatctggtgcgcc

SEQ ID NO: 4160 - DNA, 20 bp, Artificial Sequence
  sgRNA
cccgttgtttagatcttgac

SEQ ID NO: 4161 - DNA, 20 bp, Artificial Sequence
  sgRNA
gaggtgctaagcagacgtcc

SEQ ID NO: 4162 - DNA, 20 bp, Artificial Sequence
  sgRNA
cctaatgtacgctgtacagg

SEQ ID NO: 4163 - DNA, 20 bp, Artificial Sequence
  sgRNA
gtcctcccatctgaagaccc

SEQ ID NO: 4164 - DNA, 20 bp, Artificial Sequence
  sgRNA
ggagggagggacttggcaaa

SEQ ID NO: 4165 - DNA, 20 bp, Artificial Sequence
  sgRNA
cctaccttattaacttagtg

SEQ ID NO: 4166 - DNA, 20 bp, Artificial Sequence
  sgRNA
ccaggcacccgaccctgcgt

SEQ ID NO: 4167 - DNA, 20 bp, Artificial Sequence
  sgRNA
agagctagactgccacgttg

SEQ ID NO: 4168 - DNA, 20 bp, Artificial Sequence
  sgRNA
ctagctggtctaggagatcc

SEQ ID NO: 4169 - DNA, 20 bp, Artificial Sequence
  sgRNA
taagtgacacgtgactgccc

SEQ ID NO: 4170 - DNA, 20 bp, Artificial Sequence
  sgRNA
gtcgaggagcggctccttaa

SEQ ID NO: 4171 - DNA, 20 bp, Artificial Sequence
  sgRNA
cccttgcacgatctgtgggc

SEQ ID NO: 4172 - DNA, 20 bp, Artificial Sequence
  sgRNA
cgagttcacctatagtacat

SEQ ID NO: 4173 - DNA, 20 bp, Artificial Sequence
  sgRNA
gactgtagagattgacgtgg

SEQ ID NO: 4174 - DNA, 20 bp, Artificial Sequence
  sgRNA
tgacaagctagatccctttc

SEQ ID NO: 4175 - DNA, 20 bp, Artificial Sequence
  sgRNA
agctgaacatagcccggttt

SEQ ID NO: 4176 - DNA, 20 bp, Artificial Sequence
  sgRNA
tctctaggctctaacccgag

SEQ ID NO: 4177 - DNA, 20 bp, Artificial Sequence
  sgRNA
gtccttattgcgggccgcgc

SEQ ID NO: 4178 - DNA, 20 bp, Artificial Sequence
  sgRNA
gtcaccttcggagttccctc

SEQ ID NO: 4179 - DNA, 20 bp, Artificial Sequence
  sgRNA
gcgctctgctcgctccatta

SEQ ID NO: 4180 - DNA, 20 bp, Artificial Sequence
  sgRNA
tctggccctagatatagcag

SEQ ID NO: 4181 - DNA, 20 bp, Artificial Sequence
  sgRNA
gcacctcgactctggcgacc

SEQ ID NO: 4182 - DNA, 20 bp, Artificial Sequence
  sgRNA
agtcaaaggtcggtaaatag

SEQ ID NO: 4183 - DNA, 20 bp, Artificial Sequence
  sgRNA
gcagctccagcttctctttc

SEQ ID NO: 4184 - DNA, 20 bp, Artificial Sequence
  sgRNA
tgttgggcccgcctctcctc

SEQ ID NO: 4185 - DNA, 20 bp, Artificial Sequence
  sgRNA
ggagagagagagaggagagc

SEQ ID NO: 4186 - DNA, 20 bp, Artificial Sequence
  sgRNA
aggtagagcggtgacgcagc

SEQ ID NO: 4187 - DNA, 20 bp, Artificial Sequence
  sgRNA
ggcactgaggcattgtgtgc

SEQ ID NO: 4188 - DNA, 20 bp, Artificial Sequence
  sgRNA
tttcggttgtctttctgcag

SEQ ID NO: 4189 - DNA, 20 bp, Artificial Sequence
  sgRNA
acttgcgtcaggtcggcagc

SEQ ID NO: 4190 - DNA, 20 bp, Artificial Sequence
  sgRNA
gcggagagcgggtcgcccac

SEQ ID NO: 4191 - DNA, 20 bp, Artificial Sequence
  sgRNA
ccggtggcggcaccggccag

SEQ ID NO: 4192 - DNA, 20 bp, Artificial Sequence
  sgRNA
ctttaaattgtgttctactg

SEQ ID NO: 4193 - DNA, 20 bp, Artificial Sequence
  sgRNA
cggtcctctcttcctcccag

SEQ ID NO: 4194 - DNA, 20 bp, Artificial Sequence
  sgRNA
tgacctcataatgttaacat

SEQ ID NO: 4195 - DNA, 20 bp, Artificial Sequence
  sgRNA
gtgtgtgggcagaaggccac

SEQ ID NO: 4196 - DNA, 20 bp, Artificial Sequence
  sgRNA
cagttactctggccctaaat

SEQ ID NO: 4197 - DNA, 20 bp, Artificial Sequence
  sgRNA
gcagcaaagaattgaacgga

SEQ ID NO: 4198 - DNA, 20 bp, Artificial Sequence
  sgRNA
acgttgttaaccaaatcaaa

SEQ ID NO: 4199 - DNA, 20 bp, Artificial Sequence
  sgRNA
gacctctgggccaacgttcc

SEQ ID NO: 4200 - DNA, 20 bp, Artificial Sequence
  sgRNA
atgggagggtcgcaacgacc

SEQ ID NO: 4201 - DNA, 20 bp, Artificial Sequence
  sgRNA
ctagcataggactcactaaa

SEQ ID NO: 4202 - DNA, 20 bp, Artificial Sequence
  sgRNA
actaagaggagggagaaggg

SEQ ID NO: 4203 - DNA, 20 bp, Artificial Sequence
  sgRNA
ggagagagcctgtgtcagtg

SEQ ID NO: 4204 - DNA, 20 bp, Artificial Sequence
  sgRNA
ctccctgtggtggaggctcg

SEQ ID NO: 4205 - DNA, 20 bp, Artificial Sequence
  sgRNA
cggcatggcccgacagcccg

SEQ ID NO: 4206 - DNA, 20 bp, Artificial Sequence
  sgRNA
cagcacaaattcccttagaa

SEQ ID NO: 4207 - DNA, 20 bp, Artificial Sequence
  sgRNA
tgggaatggttcactccatt

SEQ ID NO: 4208 - DNA, 20 bp, Artificial Sequence
  sgRNA
acgtaccacgtgcccaaacg

SEQ ID NO: 4209 - DNA, 20 bp, Artificial Sequence
  sgRNA
gctgcgatatgaatttcttc

SEQ ID NO: 4210 - DNA, 20 bp, Artificial Sequence
  sgRNA
taggtctgaactccctctta

SEQ ID NO: 4211 - DNA, 20 bp, Artificial Sequence
  sgRNA
cagattcctcacagtcaata

SEQ ID NO: 4212 - DNA, 20 bp, Artificial Sequence
  sgRNA
cagacactttatcagataag

SEQ ID NO: 4213 - DNA, 20 bp, Artificial Sequence
  sgRNA
aggagcggagatctatagcc

SEQ ID NO: 4214 - DNA, 20 bp, Artificial Sequence
  sgRNA
actagcccttgcgccaaggc

SEQ ID NO: 4215 - DNA, 20 bp, Artificial Sequence
  sgRNA
aggcagcacatgccggcgtc

SEQ ID NO: 4216 - DNA, 20 bp, Artificial Sequence
  sgRNA
gggaaagggaggcggaggcc

SEQ ID NO: 4217 - DNA, 20 bp, Artificial Sequence
  sgRNA
tttcaggactcgcctttatt

SEQ ID NO: 4218 - DNA, 20 bp, Artificial Sequence
  sgRNA
agagataacttccgggagat

SEQ ID NO: 4219 - DNA, 20 bp, Artificial Sequence
  sgRNA
acttggcgtcacagcgcaaa

SEQ ID NO: 4220 - DNA, 20 bp, Artificial Sequence
  sgRNA
agctcttactatcttacttc

SEQ ID NO: 4221 - DNA, 20 bp, Artificial Sequence
  sgRNA
ggctgccaggcgtgttcttc

SEQ ID NO: 4222 - DNA, 20 bp, Artificial Sequence
  sgRNA
cgagggctgactacctattc

SEQ ID NO: 4223 - DNA, 20 bp, Artificial Sequence
  sgRNA
ggcgggatgttcccacgtgg

SEQ ID NO: 4224 - DNA, 20 bp, Artificial Sequence
  sgRNA
tgggaaatagcccgtgtgat

SEQ ID NO: 4225 - DNA, 20 bp, Artificial Sequence
  sgRNA
actgcagagaatggacttca

SEQ ID NO: 4226 - DNA, 20 bp, Artificial Sequence
  sgRNA
tatcattgtgatgcatacaa

SEQ ID NO: 4227 - DNA, 20 bp, Artificial Sequence
  sgRNA
aggaagtcaataccgtcagg

SEQ ID NO: 4228 - DNA, 20 bp, Artificial Sequence
  sgRNA
ctaacagtctgtctactcca

SEQ ID NO: 4229 - DNA, 20 bp, Artificial Sequence
  sgRNA
cccagggagcagccttggac

SEQ ID NO: 4230 - DNA, 20 bp, Artificial Sequence
  sgRNA
agtgtcaatgtttggtcgga

SEQ ID NO: 4231 - DNA, 20 bp, Artificial Sequence
  sgRNA
cttccttaactgagtggtgg

SEQ ID NO: 4232 - DNA, 20 bp, Artificial Sequence
  sgRNA
aagctgagcagaagcaatgg

SEQ ID NO: 4233 - DNA, 20 bp, Artificial Sequence
  sgRNA
caactctaagttgggagccc

SEQ ID NO: 4234 - DNA, 20 bp, Artificial Sequence
  sgRNA
gaaacctgccacctcttacc

SEQ ID NO: 4235 - DNA, 20 bp, Artificial Sequence
  sgRNA
gcttcctgctccaccctcat

SEQ ID NO: 4236 - DNA, 20 bp, Artificial Sequence
  sgRNA
tgcgcgtcatttgcagtctg

SEQ ID NO: 4237 - DNA, 20 bp, Artificial Sequence
  sgRNA
cgatagatgctctgcggccc

SEQ ID NO: 4238 - DNA, 20 bp, Artificial Sequence
  sgRNA
tcaaattctggctttctatt

SEQ ID NO: 4239 - DNA, 20 bp, Artificial Sequence
  sgRNA
taacttatcccatttcaaac

SEQ ID NO: 4240 - DNA, 20 bp, Artificial Sequence
  sgRNA
tgggaaggcgcttcgagcga

SEQ ID NO: 4241 - DNA, 20 bp, Artificial Sequence
  sgRNA
cattgtgggagccgcgcgag

SEQ ID NO: 4242 - DNA, 20 bp, Artificial Sequence
  sgRNA
cgctcgctcgctctcctcac

SEQ ID NO: 4243 - DNA, 20 bp, Artificial Sequence
  sgRNA
gaggaagccgagacctaaat

SEQ ID NO: 4244 - DNA, 20 bp, Artificial Sequence
  sgRNA
ggttgtcacctgccgtgggt

SEQ ID NO: 4245 - DNA, 20 bp, Artificial Sequence
  sgRNA
tggactgttacactgcgaac

SEQ ID NO: 4246 - DNA, 20 bp, Artificial Sequence
  sgRNA
tactggttgtttactttcaa

SEQ ID NO: 4247 - DNA, 20 bp, Artificial Sequence
  sgRNA
gctagagtcatctgaaagga

SEQ ID NO: 4248 - DNA, 20 bp, Artificial Sequence
  sgRNA
gactcctccttcaagaattg

SEQ ID NO: 4249 - DNA, 20 bp, Artificial Sequence
  sgRNA
cattggctagtacgttccat

SEQ ID NO: 4250 - DNA, 20 bp, Artificial Sequence
  sgRNA
gaattaggcgggaccctgga

SEQ ID NO: 4251 - DNA, 20 bp, Artificial Sequence
  sgRNA
taggatgctaagagctgtca

SEQ ID NO: 4252 - DNA, 20 bp, Artificial Sequence
  sgRNA
ggtcccgcatctacttccgg

SEQ ID NO: 4253 - DNA, 20 bp, Artificial Sequence
  sgRNA
tccaattggagcaacctacg

SEQ ID NO: 4254 - DNA, 20 bp, Artificial Sequence
  sgRNA
gcacgcgtgatggagctacc

SEQ ID NO: 4255 - DNA, 20 bp, Artificial Sequence
  sgRNA
gagacagatggcccatggaa

SEQ ID NO: 4256 - DNA, 20 bp, Artificial Sequence
  sgRNA
gagcgacgaggccaggtggg

SEQ ID NO: 4257 - DNA, 20 bp, Artificial Sequence
  sgRNA
tggctgaatgcactccacct

SEQ ID NO: 4258 - DNA, 20 bp, Artificial Sequence
  sgRNA
tttcccatcccgtcatgggc

SEQ ID NO: 4259 - DNA, 20 bp, Artificial Sequence
  sgRNA
ggtagttacaaaggcataga

SEQ ID NO: 4260 - DNA, 20 bp, Artificial Sequence
  sgRNA
agtgggcgtgggtagcccgc

SEQ ID NO: 4261 - DNA, 20 bp, Artificial Sequence
  sgRNA
gtagagtcctctgacccaga

SEQ ID NO: 4262 - DNA, 20 bp, Artificial Sequence
  sgRNA
ggaccaacagatggcaggcc

SEQ ID NO: 4263 - DNA, 20 bp, Artificial Sequence
  sgRNA
cttaggatgtgcatgtgaca

SEQ ID NO: 4264 - DNA, 20 bp, Artificial Sequence
  sgRNA
caagcgccacagacaataac

SEQ ID NO: 4265 - DNA, 20 bp, Artificial Sequence
  sgRNA
acaacatacccgtcacccaa

SEQ ID NO: 4266 - DNA, 20 bp, Artificial Sequence
  sgRNA
cagttgctaaggaaacgacg

SEQ ID NO: 4267 - DNA, 20 bp, Artificial Sequence
  sgRNA
ggatcctagtgtttcacgtg

SEQ ID NO: 4268 - DNA, 20 bp, Artificial Sequence
  sgRNA
taggaacgcttgcaacagtg

SEQ ID NO: 4269 - DNA, 20 bp, Artificial Sequence
  sgRNA
agggcgtgtccttgtagtgg

SEQ ID NO: 4270 - DNA, 20 bp, Artificial Sequence
  sgRNA
gccagctgtagggagcaaag

SEQ ID NO: 4271 - DNA, 20 bp, Artificial Sequence
  sgRNA
cgcggcagccgacctggtgc

SEQ ID NO: 4272 - DNA, 20 bp, Artificial Sequence
  sgRNA
actcacccagaagcctctag

SEQ ID NO: 4273 - DNA, 20 bp, Artificial Sequence
  sgRNA
catgtggttggctagaagca

SEQ ID NO: 4274 - DNA, 20 bp, Artificial Sequence
  sgRNA
gagcgcgcgcgaggcctctc

SEQ ID NO: 4275 - DNA, 20 bp, Artificial Sequence
  sgRNA
agtagagtggattataagac

SEQ ID NO: 4276 - DNA, 20 bp, Artificial Sequence
  sgRNA
ggcttgatttcgataactca

SEQ ID NO: 4277 - DNA, 20 bp, Artificial Sequence
  sgRNA
acgcaacactgacggacgag

SEQ ID NO: 4278 - DNA, 20 bp, Artificial Sequence
  sgRNA
gctgcttagtctgtcttctc

SEQ ID NO: 4279 - DNA, 20 bp, Artificial Sequence
  sgRNA
tggaagagatgtgagtctgc

SEQ ID NO: 4280 - DNA, 20 bp, Artificial Sequence
  sgRNA
aaagtagtgggttcatgggt

SEQ ID NO: 4281 - DNA, 20 bp, Artificial Sequence
  sgRNA
gtcatcctgcttatgcaaga

SEQ ID NO: 4282 - DNA, 20 bp, Artificial Sequence
  sgRNA
agagcgccttcagagaaatg

SEQ ID NO: 4283 - DNA, 20 bp, Artificial Sequence
  sgRNA
cttctagaacgacaagggaa

SEQ ID NO: 4284 - DNA, 20 bp, Artificial Sequence
  sgRNA
gaggatcagcgcaaacgtgg

SEQ ID NO: 4285 - DNA, 20 bp, Artificial Sequence
  sgRNA
acacaccgcggacgagctgg

SEQ ID NO: 4286 - DNA, 20 bp, Artificial Sequence
  sgRNA
gggtggcagttcagatcatc

SEQ ID NO: 4287 - DNA, 20 bp, Artificial Sequence
  sgRNA
ccgatggcgagcattggttg

SEQ ID NO: 4288 - DNA, 20 bp, Artificial Sequence
  sgRNA
gatggtatcagcctgtcttc

SEQ ID NO: 4289 - DNA, 20 bp, Artificial Sequence
  sgRNA
attggagtcgcgtctgcagg

SEQ ID NO: 4290 - DNA, 20 bp, Artificial Sequence
  sgRNA
gtgtaggtgaatactgataa

SEQ ID NO: 4291 - DNA, 20 bp, Artificial Sequence
  sgRNA
agtaaatctgagccacgcca

SEQ ID NO: 4292 - DNA, 20 bp, Artificial Sequence
  sgRNA
tcaggcttgcagaatcatag

SEQ ID NO: 4293 - DNA, 20 bp, Artificial Sequence
  sgRNA
gcgctgaaagagctgatttg

SEQ ID NO: 4294 - DNA, 20 bp, Artificial Sequence
  sgRNA
tggagggcgggcgttgcaga

SEQ ID NO: 4295 - DNA, 20 bp, Artificial Sequence
  sgRNA
acttgtgataccgcacacct

SEQ ID NO: 4296 - DNA, 20 bp, Artificial Sequence
  sgRNA
aatcagataccatattgcta

SEQ ID NO: 4297 - DNA, 20 bp, Artificial Sequence
  sgRNA
gaaatactcggagagcaagg

SEQ ID NO: 4298 - DNA, 20 bp, Artificial Sequence
  sgRNA
agtgccgccctctggcggct

SEQ ID NO: 4299 - DNA, 20 bp, Artificial Sequence
  sgRNA
gtcgcgtgccggtgtcgccg

SEQ ID NO: 4300 - DNA, 20 bp, Artificial Sequence
  sgRNA
tttgaaacgtctccaacgat

SEQ ID NO: 4301 - DNA, 20 bp, Artificial Sequence
  sgRNA
taattagctcttatccctat

SEQ ID NO: 4302 - DNA, 20 bp, Artificial Sequence
  sgRNA
tccttgcaatgacaaacctg

SEQ ID NO: 4303 - DNA, 20 bp, Artificial Sequence
  sgRNA
agaagctgaaatctagaact

SEQ ID NO: 4304 - DNA, 20 bp, Artificial Sequence
  sgRNA
accgggaagaggtgggagac

SEQ ID NO: 4305 - DNA, 20 bp, Artificial Sequence
  sgRNA
cacttctaaactacagaaat

SEQ ID NO: 4306 - DNA, 20 bp, Artificial Sequence
  sgRNA
gccggactcggcctcacacg

SEQ ID NO: 4307 - DNA, 20 bp, Artificial Sequence
  sgRNA
cccttcgctagccgggaccc

SEQ ID NO: 4308 - DNA, 20 bp, Artificial Sequence
  sgRNA
ttctgccttgtaaggccggg

SEQ ID NO: 4309 - DNA, 20 bp, Artificial Sequence
  sgRNA
aatctttaggtctcagttcc

SEQ ID NO: 4310 - DNA, 20 bp, Artificial Sequence
  sgRNA
cgcctgaacttcctcctgcg

SEQ ID NO: 4311 - DNA, 20 bp, Artificial Sequence
  sgRNA
tctctggcctttacagcagc

SEQ ID NO: 4312 - DNA, 20 bp, Artificial Sequence
  sgRNA
gcccttctctcctacgcccg

SEQ ID NO: 4313 - DNA, 20 bp, Artificial Sequence
  sgRNA
acacatgggctttcttgaaa

SEQ ID NO: 4314 - DNA, 20 bp, Artificial Sequence
  sgRNA
gttgttgattcatatgcaaa

SEQ ID NO: 4315 - DNA, 20 bp, Artificial Sequence
  sgRNA
caagcaagtcatgatgaaac

SEQ ID NO: 4316 - DNA, 20 bp, Artificial Sequence
  sgRNA
tctggcttctctaccgtcag

SEQ ID NO: 4317 - DNA, 20 bp, Artificial Sequence
  sgRNA
cgctctatctccttaagaac

SEQ ID NO: 4318 - DNA, 20 bp, Artificial Sequence
  sgRNA
gttccttcccacccatcggc

SEQ ID NO: 4319 - DNA, 20 bp, Artificial Sequence
  sgRNA
cggcggcggcaactccgcat

SEQ ID NO: 4320 - DNA, 20 bp, Artificial Sequence
  sgRNA
cactttcttcgaggtttgtg

SEQ ID NO: 4321 - DNA, 20 bp, Artificial Sequence
  sgRNA
acaagtatcctacaccaaag

SEQ ID NO: 4322 - DNA, 20 bp, Artificial Sequence
  sgRNA
gggagactaggaaactggag

SEQ ID NO: 4323 - DNA, 20 bp, Artificial Sequence
  sgRNA
gttgggtatatgctgttatt

SEQ ID NO: 4324 - DNA, 20 bp, Artificial Sequence
  sgRNA
atgtcacttcagtgtgggcg

SEQ ID NO: 4325 - DNA, 20 bp, Artificial Sequence
  sgRNA
actgacgcagcgcgggcgcg

SEQ ID NO: 4326 - DNA, 20 bp, Artificial Sequence
  sgRNA
gagggtgtacaggaagctag

SEQ ID NO: 4327 - DNA, 20 bp, Artificial Sequence
  sgRNA
ggccttgacgaagctagccc

SEQ ID NO: 4328 - DNA, 20 bp, Artificial Sequence
  sgRNA
cgagagacaatatggccgcg

SEQ ID NO: 4329 - DNA, 20 bp, Artificial Sequence
  sgRNA
agataagggtagtagggatg

SEQ ID NO: 4330 - DNA, 20 bp, Artificial Sequence
  sgRNA
gatatgcaagattctacttt

SEQ ID NO: 4331 - DNA, 20 bp, Artificial Sequence
  sgRNA
gcgggatctcaagtggtccc

SEQ ID NO: 4332 - DNA, 20 bp, Artificial Sequence
  sgRNA
tttgagtatctacacggtga

SEQ ID NO: 4333 - DNA, 20 bp, Artificial Sequence
  sgRNA
atgctgcagtaataatcgca

SEQ ID NO: 4334 - DNA, 20 bp, Artificial Sequence
  sgRNA
attatctagggtggctgctg

SEQ ID NO: 4335 - DNA, 20 bp, Artificial Sequence
  sgRNA
tttacccgcggtgcatgttg

SEQ ID NO: 4336 - DNA, 20 bp, Artificial Sequence
  sgRNA
aaggcctatgtacccttggg

SEQ ID NO: 4337 - DNA, 20 bp, Artificial Sequence
  sgRNA
gccgcgggctcgctccaccc

SEQ ID NO: 4338 - DNA, 20 bp, Artificial Sequence
  sgRNA
tgagcacagagtcccgctag

SEQ ID NO: 4339 - DNA, 20 bp, Artificial Sequence
  sgRNA
aggcacgccaggtctaaatg

SEQ ID NO: 4340 - DNA, 20 bp, Artificial Sequence
  sgRNA
gagccagaggaaagaaagcc

SEQ ID NO: 4341 - DNA, 20 bp, Artificial Sequence
  sgRNA
agtcaagagcaggtgccgcc

SEQ ID NO: 4342 - DNA, 20 bp, Artificial Sequence
  sgRNA
tattgctggaagacagagag

SEQ ID NO: 4343 - DNA, 20 bp, Artificial Sequence
  sgRNA
aatctgccgctgtactctgt

SEQ ID NO: 4344 - DNA, 20 bp, Artificial Sequence
  sgRNA
cccagtaggctgtggcccag

SEQ ID NO: 4345 - DNA, 20 bp, Artificial Sequence
  sgRNA
accagctccggtttggccac

SEQ ID NO: 4346 - DNA, 20 bp, Artificial Sequence
  sgRNA
tggactaacctgagcgccga

SEQ ID NO: 4347 - DNA, 20 bp, Artificial Sequence
  sgRNA
cgctgtgcgctagattgcaa

SEQ ID NO: 4348 - DNA, 20 bp, Artificial Sequence
  sgRNA
aacggacttctcctacttat

SEQ ID NO: 4349 - DNA, 20 bp, Artificial Sequence
  sgRNA
agagctcggaggtgtgggta

SEQ ID NO: 4350 - DNA, 20 bp, Artificial Sequence
  sgRNA
ggaagggactgtttgagcga

SEQ ID NO: 4351 - DNA, 20 bp, Artificial Sequence
  sgRNA
gaggtagacaagtggtctgg

SEQ ID NO: 4352 - DNA, 20 bp, Artificial Sequence
  sgRNA
tgggtttgaaataaatgtcc

SEQ ID NO: 4353 - DNA, 20 bp, Artificial Sequence
  sgRNA
aatcctacccgtttgcggtt

SEQ ID NO: 4354 - DNA, 20 bp, Artificial Sequence
  sgRNA
gtacttaagagtgttctagg

SEQ ID NO: 4355 - DNA, 20 bp, Artificial Sequence
  sgRNA
taccagtaacagactcatgg

SEQ ID NO: 4356 - DNA, 20 bp, Artificial Sequence
  sgRNA
ggtttggtatcttccatgca

SEQ ID NO: 4357 - DNA, 20 bp, Artificial Sequence
  sgRNA
cgctgagcagggcgagtgac

SEQ ID NO: 4358 - DNA, 20 bp, Artificial Sequence
  sgRNA
tgaaagagtgggactgtttg

SEQ ID NO: 4359 - DNA, 20 bp, Artificial Sequence
  sgRNA
agccagaagtagagattgtt

SEQ ID NO: 4360 - DNA, 20 bp, Artificial Sequence
  sgRNA
gtctgcctggcgaccttgat

SEQ ID NO: 4361 - DNA, 20 bp, Artificial Sequence
  sgRNA
gggtacaaaggtgcctagtc

SEQ ID NO: 4362 - DNA, 20 bp, Artificial Sequence
  sgRNA
gcgccagagttgcaggcggg

SEQ ID NO: 4363 - DNA, 20 bp, Artificial Sequence
  sgRNA
gaccagtagatggctcataa

SEQ ID NO: 4364 - DNA, 20 bp, Artificial Sequence
  sgRNA
ggcagtgggaggtgctgagc

SEQ ID NO: 4365 - DNA, 20 bp, Artificial Sequence
  sgRNA
tggcaagacttgacttatcc

SEQ ID NO: 4366 - DNA, 20 bp, Artificial Sequence
  sgRNA
tcttcgtaagcgtgaagcgc

SEQ ID NO: 4367 - DNA, 20 bp, Artificial Sequence
  sgRNA
tgtactgatctgggatctca

SEQ ID NO: 4368 - DNA, 20 bp, Artificial Sequence
  sgRNA
aacatggagagagtgttaga

SEQ ID NO: 4369 - DNA, 20 bp, Artificial Sequence
  sgRNA
taagatctgcaaatgagaaa

SEQ ID NO: 4370 - DNA, 20 bp, Artificial Sequence
  sgRNA
acaacctcaagaagttaaat

SEQ ID NO: 4371 - DNA, 20 bp, Artificial Sequence
  sgRNA
ttctctgattaactttccac

SEQ ID NO: 4372 - DNA, 20 bp, Artificial Sequence
  sgRNA
ttaaataggacagttcggcc

SEQ ID NO: 4373 - DNA, 20 bp, Artificial Sequence
  sgRNA
acgcgaacgctatggacacg

SEQ ID NO: 4374 - DNA, 20 bp, Artificial Sequence
  sgRNA
attcaccacaagcacagcaa

SEQ ID NO: 4375 - DNA, 20 bp, Artificial Sequence
  sgRNA
gggcgtggttgtgggcggtg

SEQ ID NO: 4376 - DNA, 20 bp, Artificial Sequence
  sgRNA
ggacgaacagacacgtgctg

SEQ ID NO: 4377 - DNA, 20 bp, Artificial Sequence
  sgRNA
tgtcatggtttgaaatcctg

SEQ ID NO: 4378 - DNA, 20 bp, Artificial Sequence
  sgRNA
agagtccgtttgtaaacctt

SEQ ID NO: 4379 - DNA, 20 bp, Artificial Sequence
  sgRNA
gaatttggttgtaaataacg

SEQ ID NO: 4380 - DNA, 20 bp, Artificial Sequence
  sgRNA
ttctatagtgacggcgcgtc

SEQ ID NO: 4381 - DNA, 20 bp, Artificial Sequence
  sgRNA
cggaccggaagtagttacag

SEQ ID NO: 4382 - DNA, 20 bp, Artificial Sequence
  sgRNA
tcaaggtgacattgtttccc

SEQ ID NO: 4383 - DNA, 20 bp, Artificial Sequence
  sgRNA
gggcagacctcaacacttcc

SEQ ID NO: 4384 - DNA, 20 bp, Artificial Sequence
  sgRNA
ttacttgagaccatctgagg

SEQ ID NO: 4385 - DNA, 20 bp, Artificial Sequence
  sgRNA
tgcattctgcctatagaccc

SEQ ID NO: 4386 - DNA, 20 bp, Artificial Sequence
  sgRNA
cagtgaccacatgaaccttg

SEQ ID NO: 4387 - DNA, 20 bp, Artificial Sequence
  sgRNA
atctgatcagtttgctgagc

SEQ ID NO: 4388 - DNA, 20 bp, Artificial Sequence
  sgRNA
tttgtgaaggctttctgcac

SEQ ID NO: 4389 - DNA, 20 bp, Artificial Sequence
  sgRNA
agagcaagtttgagtacgtg

SEQ ID NO: 4390 - DNA, 20 bp, Artificial Sequence
  sgRNA
gctgttgagagtcacatgaa

SEQ ID NO: 4391 - DNA, 20 bp, Artificial Sequence
  sgRNA
tctggctgcgaaggtgcgtg

SEQ ID NO: 4392 - DNA, 20 bp, Artificial Sequence
  sgRNA
gcatgggaaccgcttggtgg

SEQ ID NO: 4393 - DNA, 20 bp, Artificial Sequence
  sgRNA
gcagctctgttcttgaatga

SEQ ID NO: 4394 - DNA, 20 bp, Artificial Sequence
  sgRNA
aacgccgcccgcccgttgca

SEQ ID NO: 4395 - DNA, 20 bp, Artificial Sequence
  sgRNA
gctcacctgggagcttccta

SEQ ID NO: 4396 - DNA, 20 bp, Artificial Sequence
  sgRNA
ttcccttccgggctgtcgcg

SEQ ID NO: 4397 - DNA, 20 bp, Artificial Sequence
  sgRNA
tggaacggaagttccggcgg

SEQ ID NO: 4398 - DNA, 20 bp, Artificial Sequence
  sgRNA
gcaaccgcagtgacagccgg

SEQ ID NO: 4399 - DNA, 20 bp, Artificial Sequence
  sgRNA
ggtgtgtccgcgcaccacgg

SEQ ID NO: 4400 - DNA, 20 bp, Artificial Sequence
  sgRNA
gacccagaaaggcgaagtga

SEQ ID NO: 4401 - DNA, 20 bp, Artificial Sequence
  sgRNA
agctcgaaagagccaatcag

SEQ ID NO: 4402 - DNA, 20 bp, Artificial Sequence
  sgRNA
gagagggatgtctgcagcgc

SEQ ID NO: 4403 - DNA, 20 bp, Artificial Sequence
  sgRNA
ggaagaaattcaaaccgaga

SEQ ID NO: 4404 - DNA, 20 bp, Artificial Sequence
  sgRNA
taaagcgaggactagccaat

SEQ ID NO: 4405 - DNA, 20 bp, Artificial Sequence
  sgRNA
ccacgcctcttcgcgctaac

SEQ ID NO: 4406 - DNA, 20 bp, Artificial Sequence
  sgRNA
ggctgtctgccaagagttcg

SEQ ID NO: 4407 - DNA, 20 bp, Artificial Sequence
  sgRNA
ccctgtttcctgcccaagtc

SEQ ID NO: 4408 - DNA, 20 bp, Artificial Sequence
  sgRNA
tttgataggcggagttacgg

SEQ ID NO: 4409 - DNA, 20 bp, Artificial Sequence
  sgRNA
gttgtcatctaatcagctac

SEQ ID NO: 4410 - DNA, 20 bp, Artificial Sequence
  sgRNA
gggtcgctgagccggtgcgc

SEQ ID NO: 4411 - DNA, 20 bp, Artificial Sequence
  sgRNA
cccgcgatggctaaggaatg

SEQ ID NO: 4412 - DNA, 20 bp, Artificial Sequence
  sgRNA
gggacaaagagcgtggccta

SEQ ID NO: 4413 - DNA, 20 bp, Artificial Sequence
  sgRNA
gggcctatactgagagatgg

SEQ ID NO: 4414 - DNA, 20 bp, Artificial Sequence
  sgRNA
ggtgaactccttgggtagcg

SEQ ID NO: 4415 - DNA, 20 bp, Artificial Sequence
  sgRNA
ttgacaaggcgatgtttgca

SEQ ID NO: 4416 - DNA, 20 bp, Artificial Sequence
  sgRNA
ggtgatgctggatgtgtttg

SEQ ID NO: 4417 - DNA, 20 bp, Artificial Sequence
  sgRNA
actcacttggttgcgcgacg

SEQ ID NO: 4418 - DNA, 20 bp, Artificial Sequence
  sgRNA
tcactggtccttagtcacca

SEQ ID NO: 4419 - DNA, 20 bp, Artificial Sequence
  sgRNA
tggctaaagtagagctcttg

SEQ ID NO: 4420 - DNA, 20 bp, Artificial Sequence
  sgRNA
tctcggagcctcagacgctc

SEQ ID NO: 4421 - DNA, 20 bp, Artificial Sequence
  sgRNA
gggcagtccggagtccgtcc

SEQ ID NO: 4422 - DNA, 20 bp, Artificial Sequence
  sgRNA
taaagaggctcatttgctct

SEQ ID NO: 4423 - DNA, 20 bp, Artificial Sequence
  sgRNA
aatgaagtcacggacgctaa

SEQ ID NO: 4424 - DNA, 20 bp, Artificial Sequence
  sgRNA
aatactctgggaacaccgat

SEQ ID NO: 4425 - DNA, 20 bp, Artificial Sequence
  sgRNA
ggctgtcattagcagttaca

SEQ ID NO: 4426 - DNA, 20 bp, Artificial Sequence
  sgRNA
tggatccgtggcgcctcgcc

SEQ ID NO: 4427 - DNA, 20 bp, Artificial Sequence
  sgRNA
tgcgctcaggcttccggtac

SEQ ID NO: 4428 - DNA, 20 bp, Artificial Sequence
  sgRNA
gggtcaaactgcgattccgt

SEQ ID NO: 4429 - DNA, 20 bp, Artificial Sequence
  sgRNA
ccctcctacctgcctactct

SEQ ID NO: 4430 - DNA, 20 bp, Artificial Sequence
  sgRNA
cgttacttcactgaggcaga

SEQ ID NO: 4431 - DNA, 20 bp, Artificial Sequence
  sgRNA
gggaacgggtgcttagatct

SEQ ID NO: 4432 - DNA, 20 bp, Artificial Sequence
  sgRNA
tgctacatagtttaagagcc

SEQ ID NO: 4433 - DNA, 20 bp, Artificial Sequence
  sgRNA
gggcccaagagatgagccac

SEQ ID NO: 4434 - DNA, 20 bp, Artificial Sequence
  sgRNA
ctctcacgtcccggcggctg

SEQ ID NO: 4435 - DNA, 20 bp, Artificial Sequence
  sgRNA
gagacctgtcagcgcccgcg

SEQ ID NO: 4436 - DNA, 20 bp, Artificial Sequence
  sgRNA
gcacccacttcccatattga

SEQ ID NO: 4437 - DNA, 20 bp, Artificial Sequence
  sgRNA
gttaacagccgagaacaagt

SEQ ID NO: 4438 - DNA, 20 bp, Artificial Sequence
  sgRNA
taatctcattaacgcgcgcg

SEQ ID NO: 4439 - DNA, 20 bp, Artificial Sequence
  sgRNA
ggctgaggagctccgcgcac

SEQ ID NO: 4440 - DNA, 20 bp, Artificial Sequence
  sgRNA
cgcatttagtaatacgcgcg

SEQ ID NO: 4441 - DNA, 20 bp, Artificial Sequence
  sgRNA
cagagagccggctccggagg

SEQ ID NO: 4442 - DNA, 20 bp, Artificial Sequence
  sgRNA
ttaatgattgtcggactcgg

SEQ ID NO: 4443 - DNA, 20 bp, Artificial Sequence
  sgRNA
gcagtaagagctcactgaag

SEQ ID NO: 4444 - DNA, 20 bp, Artificial Sequence
  sgRNA
tctcctgcatcccggccggg

SEQ ID NO: 4445 - DNA, 20 bp, Artificial Sequence
  sgRNA
agggctcttgcgcaggctct

SEQ ID NO: 4446 - DNA, 20 bp, Artificial Sequence
  sgRNA
agtcgaggaccgggaggtat

SEQ ID NO: 4447 - DNA, 20 bp, Artificial Sequence
  sgRNA
ttctttggaccggaagcagg

SEQ ID NO: 4448 - DNA, 20 bp, Artificial Sequence
  sgRNA
agctgtttgcggcgacgatc

SEQ ID NO: 4449 - DNA, 20 bp, Artificial Sequence
  sgRNA
tggcggagcccacctggccc

SEQ ID NO: 4450 - DNA, 20 bp, Artificial Sequence
  sgRNA
gtgtgtgtgtgacttactga

SEQ ID NO: 4451 - DNA, 20 bp, Artificial Sequence
  sgRNA
gtaggtactgtgctctgcca

SEQ ID NO: 4452 - DNA, 20 bp, Artificial Sequence
  sgRNA
cctccgacgtcgcgtcgcgg

SEQ ID NO: 4453 - DNA, 20 bp, Artificial Sequence
  sgRNA
aaccgaacccagggtcgagg

SEQ ID NO: 4454 - DNA, 20 bp, Artificial Sequence
  sgRNA
tccactagggtgacgatact

SEQ ID NO: 4455 - DNA, 20 bp, Artificial Sequence
  sgRNA
gggcggctcaggcctttccc

SEQ ID NO: 4456 - DNA, 20 bp, Artificial Sequence
  sgRNA
gacagcctatagtcacttgg

SEQ ID NO: 4457 - DNA, 20 bp, Artificial Sequence
  sgRNA
atgctcgcacagtgtcctca

SEQ ID NO: 4458 - DNA, 20 bp, Artificial Sequence
  sgRNA
gccgccgtctggacgcttaa

SEQ ID NO: 4459 - DNA, 20 bp, Artificial Sequence
  sgRNA
caatcaatacctaactagct

SEQ ID NO: 4460 - DNA, 20 bp, Artificial Sequence
  sgRNA
gattacccttcttaccctcg

SEQ ID NO: 4461 - DNA, 20 bp, Artificial Sequence
  sgRNA
gctgcttccaggaagggctt

SEQ ID NO: 4462 - DNA, 20 bp, Artificial Sequence
  sgRNA
gccctctcctctcgggtact

SEQ ID NO: 4463 - DNA, 20 bp, Artificial Sequence
  sgRNA
gggactcgccgcccggaact

SEQ ID NO: 4464 - DNA, 20 bp, Artificial Sequence
  sgRNA
cgcgaaggctgccggcagcc

SEQ ID NO: 4465 - DNA, 20 bp, Artificial Sequence
  sgRNA
aaagaacctcacataagctc

SEQ ID NO: 4466 - DNA, 20 bp, Artificial Sequence
  sgRNA
gatatagggctctggcggcg

SEQ ID NO: 4467 - DNA, 20 bp, Artificial Sequence
  sgRNA
gatgacgcgcaggcgcggtg

SEQ ID NO: 4468 - DNA, 20 bp, Artificial Sequence
  sgRNA
cccagtgaggagctgcctgc

SEQ ID NO: 4469 - DNA, 20 bp, Artificial Sequence
  sgRNA
gcagagcctttggtacgcat

SEQ ID NO: 4470 - DNA, 20 bp, Artificial Sequence
  sgRNA
catgcgcatttgcaagcgct

SEQ ID NO: 4471 - DNA, 20 bp, Artificial Sequence
  sgRNA
cagcttcacgcgcgcatccc

SEQ ID NO: 4472 - DNA, 20 bp, Artificial Sequence
  sgRNA
tagagctcatttgtctgcaa

SEQ ID NO: 4473 - DNA, 20 bp, Artificial Sequence
  sgRNA
atgtctttagaaatactgca

SEQ ID NO: 4474 - DNA, 20 bp, Artificial Sequence
  sgRNA
tttctttcccaccgaataca

SEQ ID NO: 4475 - DNA, 20 bp, Artificial Sequence
  sgRNA
gtgcagtgcagcgaggatgg

SEQ ID NO: 4476 - DNA, 20 bp, Artificial Sequence
  sgRNA
ggtctgccaggtgagatact

SEQ ID NO: 4477 - DNA, 20 bp, Artificial Sequence
  sgRNA
gtcagaatcgcgagggccag

SEQ ID NO: 4478 - DNA, 20 bp, Artificial Sequence
  sgRNA
aagtcaaggctgcctcatcc

SEQ ID NO: 4479 - DNA, 20 bp, Artificial Sequence
  sgRNA
cacgggtgatgtatgctcct

SEQ ID NO: 4480 - DNA, 20 bp, Artificial Sequence
  sgRNA
gcggccaggccacaaccgag

SEQ ID NO: 4481 - DNA, 20 bp, Artificial Sequence
  sgRNA
agtccagatgtcgctctccc

SEQ ID NO: 4482 - DNA, 20 bp, Artificial Sequence
  sgRNA
cagcagcgaatgggagctca

SEQ ID NO: 4483 - DNA, 20 bp, Artificial Sequence
  sgRNA
cccaggacttctcccggatc

SEQ ID NO: 4484 - DNA, 20 bp, Artificial Sequence
  sgRNA
gctggcggaacccagaagca

SEQ ID NO: 4485 - DNA, 20 bp, Artificial Sequence
  sgRNA
gtggtctaagatcctctgaa

SEQ ID NO: 4486 - DNA, 20 bp, Artificial Sequence
  sgRNA
catgcgcaccgcggtccgcc

SEQ ID NO: 4487 - DNA, 20 bp, Artificial Sequence
  sgRNA
gcgggagctacggcggcgct

SEQ ID NO: 4488 - DNA, 20 bp, Artificial Sequence
  sgRNA
gtcagaggttctagccggag

SEQ ID NO: 4489 - DNA, 20 bp, Artificial Sequence
  sgRNA
ctggattagagccagtcgcc

SEQ ID NO: 4490 - DNA, 20 bp, Artificial Sequence
  sgRNA
catgactacctgggaggaga

SEQ ID NO: 4491 - DNA, 20 bp, Artificial Sequence
  sgRNA
cccgcccaggaaagctgtca

SEQ ID NO: 4492 - DNA, 20 bp, Artificial Sequence
  sgRNA
tgcatcctgtgatgtgagat

SEQ ID NO: 4493 - DNA, 20 bp, Artificial Sequence
  sgRNA
atggagtgcatggccggcgg

SEQ ID NO: 4494 - DNA, 20 bp, Artificial Sequence
  sgRNA
gcatgagggcgagtgtgcga

SEQ ID NO: 4495 - DNA, 20 bp, Artificial Sequence
  sgRNA
gggcgcggtgcactaggcgc

SEQ ID NO: 4496 - DNA, 20 bp, Artificial Sequence
  sgRNA
ggtcggtcgcctagcatctt

SEQ ID NO: 4497 - DNA, 20 bp, Artificial Sequence
  sgRNA
aaatgctccgctacaaacac

SEQ ID NO: 4498 - DNA, 20 bp, Artificial Sequence
  sgRNA
tttgctttccgtcggagcct

SEQ ID NO: 4499 - DNA, 20 bp, Artificial Sequence
  sgRNA
atcagagttatatggaaatc

SEQ ID NO: 4500 - DNA, 20 bp, Artificial Sequence
  sgRNA
gggctggaactgagaggtct

SEQ ID NO: 4501 - DNA, 20 bp, Artificial Sequence
  sgRNA
ggcggcgcgcttcatagaag

SEQ ID NO: 4502 - DNA, 20 bp, Artificial Sequence
  sgRNA
agccacacagactagagcta

SEQ ID NO: 4503 - DNA, 20 bp, Artificial Sequence
  sgRNA
gcaagagtacgcagattaag

SEQ ID NO: 4504 - DNA, 20 bp, Artificial Sequence
  sgRNA
tcaccacactgtgtctgaga

SEQ ID NO: 4505 - DNA, 20 bp, Artificial Sequence
  sgRNA
ggcttcaataagcgggtggg

SEQ ID NO: 4506 - DNA, 20 bp, Artificial Sequence
  sgRNA
gcactaactttcggctggca

SEQ ID NO: 4507 - DNA, 20 bp, Artificial Sequence
  sgRNA
aggagaaggacctccttact

SEQ ID NO: 4508 - DNA, 20 bp, Artificial Sequence
  sgRNA
gcgcctttgaatgtcgagag

SEQ ID NO: 4509 - DNA, 20 bp, Artificial Sequence
  sgRNA
tggcgtccctctctgggcac

SEQ ID NO: 4510 - DNA, 20 bp, Artificial Sequence
  sgRNA
aataaatgacacgcctacgc

SEQ ID NO: 4511 - DNA, 20 bp, Artificial Sequence
  sgRNA
gggagtgcagtctgggatac

SEQ ID NO: 4512 - DNA, 20 bp, Artificial Sequence
  sgRNA
ctcactggaataaacattac

SEQ ID NO: 4513 - DNA, 20 bp, Artificial Sequence
  sgRNA
gagtctctttagcgcgctca

SEQ ID NO: 4514 - DNA, 20 bp, Artificial Sequence
  sgRNA
gggctggaagaaatgcatag

SEQ ID NO: 4515 - DNA, 20 bp, Artificial Sequence
  sgRNA
agagcagcatcgggaagtag

SEQ ID NO: 4516 - DNA, 20 bp, Artificial Sequence
  sgRNA
tcgactggaaacttacacca

SEQ ID NO: 4517 - DNA, 20 bp, Artificial Sequence
  sgRNA
aagtaggcagagtagtaaca

SEQ ID NO: 4518 - DNA, 20 bp, Artificial Sequence
  sgRNA
tgcttccggaggcgggtcag

SEQ ID NO: 4519 - DNA, 20 bp, Artificial Sequence
  sgRNA
tcgtcctgctcgtgttgctt

SEQ ID NO: 4520 - DNA, 20 bp, Artificial Sequence
  sgRNA
agcttgaaacccgcgcgagg

SEQ ID NO: 4521 - DNA, 20 bp, Artificial Sequence
  sgRNA
gttaattgagacggagctct

SEQ ID NO: 4522 - DNA, 20 bp, Artificial Sequence
  sgRNA
ctgtcggtgtctgccatccc

SEQ ID NO: 4523 - DNA, 20 bp, Artificial Sequence
  sgRNA
cctgcaggcactgggtctga

SEQ ID NO: 4524 - DNA, 20 bp, Artificial Sequence
  sgRNA
gcttgcattcaggctcaagg

SEQ ID NO: 4525 - DNA, 20 bp, Artificial Sequence
  sgRNA
gcttgtcacgtgcaattctg

SEQ ID NO: 4526 - DNA, 20 bp, Artificial Sequence
  sgRNA
cgtacatgttcccgcctctc

SEQ ID NO: 4527 - DNA, 20 bp, Artificial Sequence
  sgRNA
gcgtcttccggcgcccgtgg

SEQ ID NO: 4528 - DNA, 20 bp, Artificial Sequence
  sgRNA
gggagggtggccgccggaaa

SEQ ID NO: 4529 - DNA, 20 bp, Artificial Sequence
  sgRNA
tgcttagctgcgcagctttg

SEQ ID NO: 4530 - DNA, 20 bp, Artificial Sequence
  sgRNA
caggagggctcctgatgctc

SEQ ID NO: 4531 - DNA, 20 bp, Artificial Sequence
  sgRNA
tttgggacagtcccactaaa

SEQ ID NO: 4532 - DNA, 20 bp, Artificial Sequence
  sgRNA
cgctggccaatagaaagtct

SEQ ID NO: 4533 - DNA, 20 bp, Artificial Sequence
  sgRNA
taaatggtgattctctacca

SEQ ID NO: 4534 - DNA, 20 bp, Artificial Sequence
  sgRNA
gacggctgctgagttgtggt

SEQ ID NO: 4535 - DNA, 20 bp, Artificial Sequence
  sgRNA
cgggaggctgggctgctggg

SEQ ID NO: 4536 - DNA, 20 bp, Artificial Sequence
  sgRNA
aggctaaagatcggcgcctg

SEQ ID NO: 4537 - DNA, 20 bp, Artificial Sequence
  sgRNA
agggtgcaggttcaaacatc

SEQ ID NO: 4538 - DNA, 20 bp, Artificial Sequence
  sgRNA
aattaatcataggaggttgg

SEQ ID NO: 4539 - DNA, 20 bp, Artificial Sequence
  sgRNA
agactcgggttgtagcagct

SEQ ID NO: 4540 - DNA, 20 bp, Artificial Sequence
  sgRNA
tatctccaagatccctatgc

SEQ ID NO: 4541 - DNA, 20 bp, Artificial Sequence
  sgRNA
cgcgagggctcggtgccgag

SEQ ID NO: 4542 - DNA, 20 bp, Artificial Sequence
  sgRNA
gaagacaggcggtggaccaa

SEQ ID NO: 4543 - DNA, 20 bp, Artificial Sequence
  sgRNA
gagacgcctaatacatggac

SEQ ID NO: 4544 - DNA, 20 bp, Artificial Sequence
  sgRNA
gtggaatcggtgggaggaac

SEQ ID NO: 4545 - DNA, 20 bp, Artificial Sequence
  sgRNA
caggcactacaggaatgacc

SEQ ID NO: 4546 - DNA, 20 bp, Artificial Sequence
  sgRNA
cgccgccagggcgttgggcg

SEQ ID NO: 4547 - DNA, 20 bp, Artificial Sequence
  sgRNA
acacgtcacctctacgtgat

SEQ ID NO: 4548 - DNA, 20 bp, Artificial Sequence
  sgRNA
ctgtattgtccagttgctag

SEQ ID NO: 4549 - DNA, 20 bp, Artificial Sequence
  sgRNA
ataaagcattcagccctgcg

SEQ ID NO: 4550 - DNA, 20 bp, Artificial Sequence
  sgRNA
atcgcgtgtgcggcctaaac

SEQ ID NO: 4551 - DNA, 20 bp, Artificial Sequence
  sgRNA
aagttatgagtgcaaatcat

SEQ ID NO: 4552 - DNA, 20 bp, Artificial Sequence
  sgRNA
ccacagcgccactcaacggc

SEQ ID NO: 4553 - DNA, 20 bp, Artificial Sequence
  sgRNA
agcgcggcggtgcaggccaa

SEQ ID NO: 4554 - DNA, 20 bp, Artificial Sequence
  sgRNA
ctgtggagggcgaaaggacg

SEQ ID NO: 4555 - DNA, 20 bp, Artificial Sequence
  sgRNA
agaccagtggttcaatctcc

SEQ ID NO: 4556 - DNA, 20 bp, Artificial Sequence
  sgRNA
gtcagagcacagtggagaac

SEQ ID NO: 4557 - DNA, 20 bp, Artificial Sequence
  sgRNA
acagcctcacgcccacgagc

SEQ ID NO: 4558 - DNA, 20 bp, Artificial Sequence
  sgRNA
aggagagtctgtgcagatcc

SEQ ID NO: 4559 - DNA, 20 bp, Artificial Sequence
  sgRNA
ctgactattggtctccgctg

SEQ ID NO: 4560 - DNA, 20 bp, Artificial Sequence
  sgRNA
aagtttgttgtgtgattaac

SEQ ID NO: 4561 - DNA, 20 bp, Artificial Sequence
  sgRNA
tggaactctacaaatctcca

SEQ ID NO: 4562 - DNA, 20 bp, Artificial Sequence
  sgRNA
aatgatcctttactgtacgt

SEQ ID NO: 4563 - DNA, 20 bp, Artificial Sequence
  sgRNA
tttcaaatatttgggagagg

SEQ ID NO: 4564 - DNA, 20 bp, Artificial Sequence
  sgRNA
gcttggaggcagaactccca

SEQ ID NO: 4565 - DNA, 20 bp, Artificial Sequence
  sgRNA
gcaggtccgagcggctggcg

SEQ ID NO: 4566 - DNA, 20 bp, Artificial Sequence
  sgRNA
aaatagggcagccgcggcag

SEQ ID NO: 4567 - DNA, 20 bp, Artificial Sequence
  sgRNA
ggagtgcaggcgcctcgcga

SEQ ID NO: 4568 - DNA, 20 bp, Artificial Sequence
  sgRNA
agcgagttctgacaaccgga

SEQ ID NO: 4569 - DNA, 20 bp, Artificial Sequence
  sgRNA
ccatgcaggattggccagat

SEQ ID NO: 4570 - DNA, 20 bp, Artificial Sequence
  sgRNA
aacgggcacacgttggtaac

SEQ ID NO: 4571 - DNA, 20 bp, Artificial Sequence
  sgRNA
atttattgacttcggatgca

SEQ ID NO: 4572 - DNA, 20 bp, Artificial Sequence
  sgRNA
tttccactaccgcagatcct

SEQ ID NO: 4573 - DNA, 20 bp, Artificial Sequence
  sgRNA
gaaagacaagaatgagccaa

SEQ ID NO: 4574 - DNA, 20 bp, Artificial Sequence
  sgRNA
ctcaccaagttgtctgtcag

SEQ ID NO: 4575 - DNA, 20 bp, Artificial Sequence
  sgRNA
tgagcaaatatgcccagtca

SEQ ID NO: 4576 - DNA, 20 bp, Artificial Sequence
  sgRNA
gctaagagccagccatgcta

SEQ ID NO: 4577 - DNA, 20 bp, Artificial Sequence
  sgRNA
aggtttcaggaacagtggta

SEQ ID NO: 4578 - DNA, 20 bp, Artificial Sequence
  sgRNA
caataaccactcatctccct

SEQ ID NO: 4579 - DNA, 20 bp, Artificial Sequence
  sgRNA
tgacttgactcatctgtgat

SEQ ID NO: 4580 - DNA, 20 bp, Artificial Sequence
  sgRNA
ggctggcttctccatcatgg

SEQ ID NO: 4581 - DNA, 20 bp, Artificial Sequence
  sgRNA
gcaacgcgcctgcttacgct

SEQ ID NO: 4582 - DNA, 20 bp, Artificial Sequence
  sgRNA
gggacgccaggctcggtgac

SEQ ID NO: 4583 - DNA, 20 bp, Artificial Sequence
  sgRNA
ttaatgcagcttgtttgata

SEQ ID NO: 4584 - DNA, 20 bp, Artificial Sequence
  sgRNA
caactaggcagttggactcc

SEQ ID NO: 4585 - DNA, 20 bp, Artificial Sequence
  sgRNA
ttccgcaggtgtcctgcagg

SEQ ID NO: 4586 - DNA, 20 bp, Artificial Sequence
  sgRNA
atgtaacctaggtaggaaga

SEQ ID NO: 4587 - DNA, 20 bp, Artificial Sequence
  sgRNA
agggaatctttgacagcgcc

SEQ ID NO: 4588 - DNA, 20 bp, Artificial Sequence
  sgRNA
ggcgtgcctgcgtccctagg

SEQ ID NO: 4589 - DNA, 20 bp, Artificial Sequence
  sgRNA
gctgaccctggcaggactga

SEQ ID NO: 4590 - DNA, 20 bp, Artificial Sequence
  sgRNA
ctctagaagctagataagcg

SEQ ID NO: 4591 - DNA, 20 bp, Artificial Sequence
  sgRNA
gagggaagaagaggcgcgag

SEQ ID NO: 4592 - DNA, 20 bp, Artificial Sequence
  sgRNA
gggcagagccagcggaggaa

SEQ ID NO: 4593 - DNA, 20 bp, Artificial Sequence
  sgRNA
tttactctttcctacctgaa

SEQ ID NO: 4594 - DNA, 20 bp, Artificial Sequence
  sgRNA
tagggagctcaaagtccgac

SEQ ID NO: 4595 - DNA, 20 bp, Artificial Sequence
  sgRNA
ctcagctctttctcatcaga

SEQ ID NO: 4596 - DNA, 20 bp, Artificial Sequence
  sgRNA
taaagggcatgcatgcctcc

SEQ ID NO: 4597 - DNA, 20 bp, Artificial Sequence
  sgRNA
caaggttctagacaacaccc

SEQ ID NO: 4598 - DNA, 20 bp, Artificial Sequence
  sgRNA
acaacagcggatgccagccc

SEQ ID NO: 4599 - DNA, 20 bp, Artificial Sequence
  sgRNA
ctactgactctagtggccac

SEQ ID NO: 4600 - DNA, 20 bp, Artificial Sequence
  sgRNA
tgaagcattattagaaacac

SEQ ID NO: 4601 - DNA, 20 bp, Artificial Sequence
  sgRNA
ggcgtggcacgggcgccaag

SEQ ID NO: 4602 - DNA, 20 bp, Artificial Sequence
  sgRNA
cgggagggacgacaaggatg

SEQ ID NO: 4603 - DNA, 20 bp, Artificial Sequence
  sgRNA
cagaataatcctgaaccgtc

SEQ ID NO: 4604 - DNA, 20 bp, Artificial Sequence
  sgRNA
ggcaggtccgagacccagcg

SEQ ID NO: 4605 - DNA, 20 bp, Artificial Sequence
  sgRNA
cgagcgccagcggtgatccc

SEQ ID NO: 4606 - DNA, 20 bp, Artificial Sequence
  sgRNA
gcgctgggaatcggaaccgc

SEQ ID NO: 4607 - DNA, 20 bp, Artificial Sequence
  sgRNA
gtcctcgttgggctacgcgg

SEQ ID NO: 4608 - DNA, 20 bp, Artificial Sequence
  sgRNA
ctctctttgccctagctgat

SEQ ID NO: 4609 - DNA, 20 bp, Artificial Sequence
  sgRNA
tcccaatgggaccagagcag

SEQ ID NO: 4610 - DNA, 20 bp, Artificial Sequence
  sgRNA
ttgggctgtcagcagatctg

SEQ ID NO: 4611 - DNA, 20 bp, Artificial Sequence
  sgRNA
ttggaatcaccctctggacc

SEQ ID NO: 4612 - DNA, 20 bp, Artificial Sequence
  sgRNA
gccggtggtaatggatgtgg

SEQ ID NO: 4613 - DNA, 20 bp, Artificial Sequence
  sgRNA
tagcaagcaaagttcatagt

SEQ ID NO: 4614 - DNA, 20 bp, Artificial Sequence
  sgRNA
tgcgcgctgattgacagctg

SEQ ID NO: 4615 - DNA, 20 bp, Artificial Sequence
  sgRNA
ggtagcttgagggcaaagtt

SEQ ID NO: 4616 - DNA, 20 bp, Artificial Sequence
  sgRNA
acatagtagctatgttgaca

SEQ ID NO: 4617 - DNA, 20 bp, Artificial Sequence
  sgRNA
aacttatgagaaggcccacc

SEQ ID NO: 4618 - DNA, 20 bp, Artificial Sequence
  sgRNA
agtgctatttatatccttga

SEQ ID NO: 4619 - DNA, 20 bp, Artificial Sequence
  sgRNA
gcccgacggccgcgcagccc

SEQ ID NO: 4620 - DNA, 20 bp, Artificial Sequence
  sgRNA
cgtttcacaattaaggtccc

SEQ ID NO: 4621 - DNA, 20 bp, Artificial Sequence
  sgRNA
tcggtcgcgatgcgccagcc

SEQ ID NO: 4622 - DNA, 20 bp, Artificial Sequence
  sgRNA
gctcggcgtgttactacgtc

SEQ ID NO: 4623 - DNA, 20 bp, Artificial Sequence
  sgRNA
ccacaggagatcaatggaaa

SEQ ID NO: 4624 - DNA, 20 bp, Artificial Sequence
  sgRNA
aggcgcctagcggcctgaag

SEQ ID NO: 4625 - DNA, 20 bp, Artificial Sequence
  sgRNA
atcttgagcaatcaagcgtt

SEQ ID NO: 4626 - DNA, 20 bp, Artificial Sequence
  sgRNA
ttgctgcgcgcagtgaccaa

SEQ ID NO: 4627 - DNA, 20 bp, Artificial Sequence
  sgRNA
tgactcaggctaaggattcc

SEQ ID NO: 4628 - DNA, 20 bp, Artificial Sequence
  sgRNA
gcgcattcgcctgctcctct

SEQ ID NO: 4629 - DNA, 20 bp, Artificial Sequence
  sgRNA
acgtcacgggaggcgcgcgc

SEQ ID NO: 4630 - DNA, 20 bp, Artificial Sequence
  sgRNA
gggtcacgcctgcgcactgg

SEQ ID NO: 4631 - DNA, 20 bp, Artificial Sequence
  sgRNA
gccgttgccgtagctgtcgc

SEQ ID NO: 4632 - DNA, 20 bp, Artificial Sequence
  sgRNA
tctatggtcgccgtttccca

SEQ ID NO: 4633 - DNA, 20 bp, Artificial Sequence
  sgRNA
ggaagctctcacatccaagc

SEQ ID NO: 4634 - DNA, 20 bp, Artificial Sequence
  sgRNA
agctgacagaccaatcgccc

SEQ ID NO: 4635 - DNA, 20 bp, Artificial Sequence
  sgRNA
actggaacctgggcgccctt

SEQ ID NO: 4636 - DNA, 20 bp, Artificial Sequence
  sgRNA
tttgtgcaagaccacttgaa

SEQ ID NO: 4637 - DNA, 20 bp, Artificial Sequence
  sgRNA
ctgtcatcgaggtcgcaaag

SEQ ID NO: 4638 - DNA, 20 bp, Artificial Sequence
  sgRNA
gggctcagatggtccaggtt

SEQ ID NO: 4639 - DNA, 20 bp, Artificial Sequence
  sgRNA
atcattgacattcttcagga

SEQ ID NO: 4640 - DNA, 20 bp, Artificial Sequence
  sgRNA
acttgtgctaagaactttcc

SEQ ID NO: 4641 - DNA, 20 bp, Artificial Sequence
  sgRNA
cagtggtccagtgatggcta

SEQ ID NO: 4642 - DNA, 20 bp, Artificial Sequence
  sgRNA
actattcatccttaaatgct

SEQ ID NO: 4643 - DNA, 20 bp, Artificial Sequence
  sgRNA
ggagcggcgcgcaaaccttc

SEQ ID NO: 4644 - DNA, 20 bp, Artificial Sequence
  sgRNA
gccagtggcagccgagtaag

SEQ ID NO: 4645 - DNA, 20 bp, Artificial Sequence
  sgRNA
tgggcacagagcgagggcga

SEQ ID NO: 4646 - DNA, 20 bp, Artificial Sequence
  sgRNA
cccagttattcacaaccgcc

SEQ ID NO: 4647 - DNA, 20 bp, Artificial Sequence
  sgRNA
gttaatgtcactgtgttcag

SEQ ID NO: 4648 - DNA, 20 bp, Artificial Sequence
  sgRNA
attaaatcttcccagaggtt

SEQ ID NO: 4649 - DNA, 20 bp, Artificial Sequence
  sgRNA
cggctggacagagctgacac

SEQ ID NO: 4650 - DNA, 20 bp, Artificial Sequence
  sgRNA
ccgggatggcgccagcctat

SEQ ID NO: 4651 - DNA, 20 bp, Artificial Sequence
  sgRNA
gggattggttctcaagtacc

SEQ ID NO: 4652 - DNA, 20 bp, Artificial Sequence
  sgRNA
tgtgtgaccctcagacaaca

SEQ ID NO: 4653 - DNA, 20 bp, Artificial Sequence
  sgRNA
aggctgaggctggtctcttg

SEQ ID NO: 4654 - DNA, 20 bp, Artificial Sequence
  sgRNA
tgcaggaagcatgccctgtg

SEQ ID NO: 4655 - DNA, 20 bp, Artificial Sequence
  sgRNA
gagacgttgcgtgacgaccg

SEQ ID NO: 4656 - DNA, 20 bp, Artificial Sequence
  sgRNA
aaattcataggcaccagcct

SEQ ID NO: 4657 - DNA, 20 bp, Artificial Sequence
  sgRNA
gggtctccggccggacagcg

SEQ ID NO: 4658 - DNA, 20 bp, Artificial Sequence
  sgRNA
taactttggcctgagaggtg

SEQ ID NO: 4659 - DNA, 20 bp, Artificial Sequence
  sgRNA
ctaaaccatccgggcgggct

SEQ ID NO: 4660 - DNA, 20 bp, Artificial Sequence
  sgRNA
ttacgtcagtcaccgctagc

SEQ ID NO: 4661 - DNA, 20 bp, Artificial Sequence
  sgRNA
agaggcatccacaattcgga

SEQ ID NO: 4662 - DNA, 20 bp, Artificial Sequence
  sgRNA
catctctctacgtcacggcc

SEQ ID NO: 4663 - DNA, 20 bp, Artificial Sequence
  sgRNA
cgccgcagaggaccactgcc

SEQ ID NO: 4664 - DNA, 20 bp, Artificial Sequence
  sgRNA
gatctttaccggtgtttcca

SEQ ID NO: 4665 - DNA, 20 bp, Artificial Sequence
  sgRNA
cttgatagggaccaagagct

SEQ ID NO: 4666 - DNA, 20 bp, Artificial Sequence
  sgRNA
gcgccagacatttcctaaag

SEQ ID NO: 4667 - DNA, 20 bp, Artificial Sequence
  sgRNA
actgaaggccatatgtggga

SEQ ID NO: 4668 - DNA, 20 bp, Artificial Sequence
  sgRNA
cttaaagactgccctctgtc

SEQ ID NO: 4669 - DNA, 20 bp, Artificial Sequence
  sgRNA
cttcttgtccacccagcata

SEQ ID NO: 4670 - DNA, 20 bp, Artificial Sequence
  sgRNA
aagggaggcgttgcaacatc

SEQ ID NO: 4671 - DNA, 20 bp, Artificial Sequence
  sgRNA
cagagtttctgtgcaattct

SEQ ID NO: 4672 - DNA, 20 bp, Artificial Sequence
  sgRNA
acggctttcatgcggccgcg

SEQ ID NO: 4673 - DNA, 20 bp, Artificial Sequence
  sgRNA
aggtgacacggcagcagagg

SEQ ID NO: 4674 - DNA, 20 bp, Artificial Sequence
  sgRNA
tgatgacacgccagcgcgcg

SEQ ID NO: 4675 - DNA, 20 bp, Artificial Sequence
  sgRNA
gcgagtgaatttgcgtgccc

SEQ ID NO: 4676 - DNA, 20 bp, Artificial Sequence
  sgRNA
ttgacgggccaataagagag

SEQ ID NO: 4677 - DNA, 20 bp, Artificial Sequence
  sgRNA
gaacaggatgtgttcttcaa

SEQ ID NO: 4678 - DNA, 20 bp, Artificial Sequence
  sgRNA
gacgcgtgaatggaggtgga

SEQ ID NO: 4679 - DNA, 20 bp, Artificial Sequence
  sgRNA
cgtctcgatgcagctgccct

SEQ ID NO: 4680 - DNA, 20 bp, Artificial Sequence
  sgRNA
ccagacctgccttatttata

SEQ ID NO: 4681 - DNA, 20 bp, Artificial Sequence
  sgRNA
agcgagccgaggtttgtcga

SEQ ID NO: 4682 - DNA, 20 bp, Artificial Sequence
  sgRNA
cggtgatgatatctgagaca

SEQ ID NO: 4683 - DNA, 20 bp, Artificial Sequence
  sgRNA
tcaagggttctgtgttcttc

SEQ ID NO: 4684 - DNA, 20 bp, Artificial Sequence
  sgRNA
gcaggcctggagcttgtaag

SEQ ID NO: 4685 - DNA, 20 bp, Artificial Sequence
  sgRNA
gggacaaacctagagcgaca

SEQ ID NO: 4686 - DNA, 20 bp, Artificial Sequence
  sgRNA
tcccggactgttcacgcact

SEQ ID NO: 4687 - DNA, 20 bp, Artificial Sequence
  sgRNA
gcgggacgcgcccacttggc

SEQ ID NO: 4688 - DNA, 20 bp, Artificial Sequence
  sgRNA
tgccctcctgtcaagcgctt

SEQ ID NO: 4689 - DNA, 20 bp, Artificial Sequence
  sgRNA
acctgggcggcggaggcgtg

SEQ ID NO: 4690 - DNA, 20 bp, Artificial Sequence
  sgRNA
agcattacacctgatgttcc

SEQ ID NO: 4691 - DNA, 20 bp, Artificial Sequence
  sgRNA
actggagagacagaatcatg

SEQ ID NO: 4692 - DNA, 20 bp, Artificial Sequence
  sgRNA
ctcctccgatgtgacgcctg

SEQ ID NO: 4693 - DNA, 20 bp, Artificial Sequence
  sgRNA
tctcgcgcgttgccagggcg

SEQ ID NO: 4694 - DNA, 20 bp, Artificial Sequence
  sgRNA
tggtaggatccttgaatctc

SEQ ID NO: 4695 - DNA, 20 bp, Artificial Sequence
  sgRNA
agaccttgttgcctcggagg

SEQ ID NO: 4696 - DNA, 20 bp, Artificial Sequence
  sgRNA
gtaagcaaagatttcatatg

SEQ ID NO: 4697 - DNA, 20 bp, Artificial Sequence
  sgRNA
ttacgaggcaaccaagagga

SEQ ID NO: 4698 - DNA, 20 bp, Artificial Sequence
  sgRNA
aaggaaacccaggctgtgtc

SEQ ID NO: 4699 - DNA, 20 bp, Artificial Sequence
  sgRNA
aaacggagtgacggcgcgac

SEQ ID NO: 4700 - DNA, 20 bp, Artificial Sequence
  sgRNA
tggactggaatccaggagac

SEQ ID NO: 4701 - DNA, 20 bp, Artificial Sequence
  sgRNA
cttgctattatagcactgtg

SEQ ID NO: 4702 - DNA, 20 bp, Artificial Sequence
  sgRNA
ctccttatcaaatagggatc

SEQ ID NO: 4703 - DNA, 20 bp, Artificial Sequence
  sgRNA
actgcttgtctccactaatt

SEQ ID NO: 4704 - DNA, 20 bp, Artificial Sequence
  sgRNA
actgcaattattagattgag

SEQ ID NO: 4705 - DNA, 20 bp, Artificial Sequence
  sgRNA
aggcaactggctaactagcc

SEQ ID NO: 4706 - DNA, 20 bp, Artificial Sequence
  sgRNA
cctcatcatctgcgtggtcc

SEQ ID NO: 4707 - DNA, 20 bp, Artificial Sequence
  sgRNA
cgcacgctttggctcgggag

SEQ ID NO: 4708 - DNA, 20 bp, Artificial Sequence
  sgRNA
gattatctgctccacgcacg

SEQ ID NO: 4709 - DNA, 20 bp, Artificial Sequence
  sgRNA
aaacatagctcagggaagag

SEQ ID NO: 4710 - DNA, 20 bp, Artificial Sequence
  sgRNA
tggcggcgagttctgtcacg

SEQ ID NO: 4711 - DNA, 20 bp, Artificial Sequence
  sgRNA
ggctcctcaattgccctaaa

SEQ ID NO: 4712 - DNA, 20 bp, Artificial Sequence
  sgRNA
gcgcaaactcgctcacttcc

SEQ ID NO: 4713 - DNA, 20 bp, Artificial Sequence
  sgRNA
caaggagggcgataccaaga

SEQ ID NO: 4714 - DNA, 20 bp, Artificial Sequence
  sgRNA
tcaaagcaaacagtgatagg

SEQ ID NO: 4715 - DNA, 20 bp, Artificial Sequence
  sgRNA
ctgtgcacgtttgttgagct

SEQ ID NO: 4716 - DNA, 20 bp, Artificial Sequence
  sgRNA
cggcgccatcccttagcttg

SEQ ID NO: 4717 - DNA, 20 bp, Artificial Sequence
  sgRNA
cagacctttagaggctctct

SEQ ID NO: 4718 - DNA, 20 bp, Artificial Sequence
  sgRNA
cgctctatatatacagcgcc

SEQ ID NO: 4719 - DNA, 20 bp, Artificial Sequence
  sgRNA
gtcacgtgacgtccgcggcc

SEQ ID NO: 4720 - DNA, 20 bp, Artificial Sequence
  sgRNA
tgtcaggaagaggaagagcg

SEQ ID NO: 4721 - DNA, 20 bp, Artificial Sequence
  sgRNA
caaccttagacttaggcatg

SEQ ID NO: 4722 - DNA, 20 bp, Artificial Sequence
  sgRNA
ccaagcggaaacttacacac

SEQ ID NO: 4723 - DNA, 20 bp, Artificial Sequence
  sgRNA
gtcggagtggcggaggctct

SEQ ID NO: 4724 - DNA, 20 bp, Artificial Sequence
  sgRNA
gaatgaaccaagtgtccgcc

SEQ ID NO: 4725 - DNA, 20 bp, Artificial Sequence
  sgRNA
tgctgctgtgcattgaagcc

SEQ ID NO: 4726 - DNA, 20 bp, Artificial Sequence
  sgRNA
cccttccgccctgtgttgtc

SEQ ID NO: 4727 - DNA, 20 bp, Artificial Sequence
  sgRNA
cagcatcaccactctgggcg

SEQ ID NO: 4728 - DNA, 20 bp, Artificial Sequence
  sgRNA
aacgactggcgcgcgcaccc

SEQ ID NO: 4729 - DNA, 20 bp, Artificial Sequence
  sgRNA
gattacagggaccagggagg

SEQ ID NO: 4730 - DNA, 20 bp, Artificial Sequence
  sgRNA
tttggatatcatgacaaagt

SEQ ID NO: 4731 - DNA, 20 bp, Artificial Sequence
  sgRNA
cccttggcagcgggtctaaa

SEQ ID NO: 4732 - DNA, 20 bp, Artificial Sequence
  sgRNA
aattaaagcctctaattcac

SEQ ID NO: 4733 - DNA, 20 bp, Artificial Sequence
  sgRNA
cgcaggtaaatccatgcgcc

SEQ ID NO: 4734 - DNA, 20 bp, Artificial Sequence
  sgRNA
acattcagagctgacccggg

SEQ ID NO: 4735 - DNA, 20 bp, Artificial Sequence
  sgRNA
tcaacttatggtaatgagct

SEQ ID NO: 4736 - DNA, 20 bp, Artificial Sequence
  sgRNA
ctagcgaaaggctgccgccc

SEQ ID NO: 4737 - DNA, 20 bp, Artificial Sequence
  sgRNA
gcaacaggattctttcagcc

SEQ ID NO: 4738 - DNA, 20 bp, Artificial Sequence
  sgRNA
ctacgcaggcggtagggctg

SEQ ID NO: 4739 - DNA, 20 bp, Artificial Sequence
  sgRNA
ggctctggaagagctggttt

SEQ ID NO: 4740 - DNA, 20 bp, Artificial Sequence
  sgRNA
ttagtgcaacctgtggcacg

SEQ ID NO: 4741 - DNA, 20 bp, Artificial Sequence
  sgRNA
agtcctttgagggcgcgagg

SEQ ID NO: 4742 - DNA, 20 bp, Artificial Sequence
  sgRNA
actacaattcccataaagca

SEQ ID NO: 4743 - DNA, 20 bp, Artificial Sequence
  sgRNA
aaacgcgtgtatcgggagtc

SEQ ID NO: 4744 - DNA, 20 bp, Artificial Sequence
  sgRNA
gggcttcggccgcgggttct

SEQ ID NO: 4745 - DNA, 20 bp, Artificial Sequence
  sgRNA
gaaccggttcgcgagggact

SEQ ID NO: 4746 - DNA, 20 bp, Artificial Sequence
  sgRNA
tgagtagtatacatgtgagc

SEQ ID NO: 4747 - DNA, 20 bp, Artificial Sequence
  sgRNA
tgtgcggtgagcaatagctg

SEQ ID NO: 4748 - DNA, 20 bp, Artificial Sequence
  sgRNA
ttcttacgtaagccgggagc

SEQ ID NO: 4749 - DNA, 20 bp, Artificial Sequence
  sgRNA
tgactataggaggtgatgcg

SEQ ID NO: 4750 - DNA, 20 bp, Artificial Sequence
  sgRNA
cacgaggacaccaaggttag

SEQ ID NO: 4751 - DNA, 20 bp, Artificial Sequence
  sgRNA
gaaaccggcaagtgaggatg

SEQ ID NO: 4752 - DNA, 20 bp, Artificial Sequence
  sgRNA
gataaggtctgctggaatcg

SEQ ID NO: 4753 - DNA, 20 bp, Artificial Sequence
  sgRNA
gctgggcatgtcaactcaca

SEQ ID NO: 4754 - DNA, 20 bp, Artificial Sequence
  sgRNA
gagggcctgtcagctcacaa

SEQ ID NO: 4755 - DNA, 20 bp, Artificial Sequence
  sgRNA
aggctcagtctgcttaggct

SEQ ID NO: 4756 - DNA, 20 bp, Artificial Sequence
  sgRNA
gaagcttccggcggacgcca

SEQ ID NO: 4757 - DNA, 20 bp, Artificial Sequence
  sgRNA
gctctggcactagggcaagc

SEQ ID NO: 4758 - DNA, 20 bp, Artificial Sequence
  sgRNA
cgcggcgagcggcgatcccg

SEQ ID NO: 4759 - DNA, 20 bp, Artificial Sequence
  sgRNA
gggttgtattagctttcaac

SEQ ID NO: 4760 - DNA, 20 bp, Artificial Sequence
  sgRNA
tcaacaggaactagacagca

SEQ ID NO: 4761 - DNA, 20 bp, Artificial Sequence
  sgRNA
gattggctgggatgagcccg

SEQ ID NO: 4762 - DNA, 20 bp, Artificial Sequence
  sgRNA
ggaaggaggaaggcagccgt

SEQ ID NO: 4763 - DNA, 20 bp, Artificial Sequence
  sgRNA
gcagccagcccggccttatt

SEQ ID NO: 4764 - DNA, 20 bp, Artificial Sequence
  sgRNA
gggaccagcatcagtgagtg

SEQ ID NO: 4765 - DNA, 20 bp, Artificial Sequence
  sgRNA
tctggccctgtggctaagtc

SEQ ID NO: 4766 - DNA, 20 bp, Artificial Sequence
  sgRNA
tactttgcgcccactcctag

SEQ ID NO: 4767 - DNA, 20 bp, Artificial Sequence
  sgRNA
aggagctggtctccggcagg

SEQ ID NO: 4768 - DNA, 20 bp, Artificial Sequence
  sgRNA
aaagctgactctgacagcaa

SEQ ID NO: 4769 - DNA, 20 bp, Artificial Sequence
  sgRNA
ttacatcatccttgggcgtg

SEQ ID NO: 4770 - DNA, 20 bp, Artificial Sequence
  sgRNA
gagcccaagtccctgtgtgg

SEQ ID NO: 4771 - DNA, 20 bp, Artificial Sequence
  sgRNA
ggctcgcgaccatagagaag

SEQ ID NO: 4772 - DNA, 20 bp, Artificial Sequence
  sgRNA
ttgcttgcaggagcgagtga

SEQ ID NO: 4773 - DNA, 20 bp, Artificial Sequence
  sgRNA
tgtagaattggaactactag

SEQ ID NO: 4774 - DNA, 20 bp, Artificial Sequence
  sgRNA
tcctgtgaaatcagaccaat

SEQ ID NO: 4775 - DNA, 20 bp, Artificial Sequence
  sgRNA
tttcctgagtctctgatttg

SEQ ID NO: 4776 - DNA, 20 bp, Artificial Sequence
  sgRNA
tcacatgctctttaaacgtc

SEQ ID NO: 4777 - DNA, 20 bp, Artificial Sequence
  sgRNA
gggagggcccaggcgagcgg

SEQ ID NO: 4778 - DNA, 20 bp, Artificial Sequence
  sgRNA
ggcccgcctcctccgagacc

SEQ ID NO: 4779 - DNA, 20 bp, Artificial Sequence
  sgRNA
gcgcaagccgcaagctcgac

SEQ ID NO: 4780 - DNA, 20 bp, Artificial Sequence
  sgRNA
cgcaaggcgctcaagtacgg

SEQ ID NO: 4781 - DNA, 20 bp, Artificial Sequence
  sgRNA
ttcttcgtattgtgggagag

SEQ ID NO: 4782 - DNA, 20 bp, Artificial Sequence
  sgRNA
actaaggccacaggcagcta

SEQ ID NO: 4783 - DNA, 20 bp, Artificial Sequence
  sgRNA
aaattccgtagactcgccta

SEQ ID NO: 4784 - DNA, 20 bp, Artificial Sequence
  sgRNA
gtagactcaacaagttccag

SEQ ID NO: 4785 - DNA, 20 bp, Artificial Sequence
  sgRNA
gggtccttcctagaaataaa

SEQ ID NO: 4786 - DNA, 20 bp, Artificial Sequence
  sgRNA
tcccacttcccgctgtggat

SEQ ID NO: 4787 - DNA, 20 bp, Artificial Sequence
  sgRNA
tcgcccgccgccgaggagaa

SEQ ID NO: 4788 - DNA, 20 bp, Artificial Sequence
  sgRNA
gagggcggagctctggcgtg

SEQ ID NO: 4789 - DNA, 20 bp, Artificial Sequence
  sgRNA
ccaacatctcgtgaggtggg

SEQ ID NO: 4790 - DNA, 20 bp, Artificial Sequence
  sgRNA
agaggtgaccagatctcaag

SEQ ID NO: 4791 - DNA, 20 bp, Artificial Sequence
  sgRNA
ggacataaatagtgggttcc

SEQ ID NO: 4792 - DNA, 20 bp, Artificial Sequence
  sgRNA
ggtgggtagaagattgacag

SEQ ID NO: 4793 - DNA, 20 bp, Artificial Sequence
  sgRNA
tgggcggagcatccgcctcg

SEQ ID NO: 4794 - DNA, 20 bp, Artificial Sequence
  sgRNA
gtggttgattagcaaagtct

SEQ ID NO: 4795 - DNA, 20 bp, Artificial Sequence
  sgRNA
ctgttgcgccactgtgctcc

SEQ ID NO: 4796 - DNA, 20 bp, Artificial Sequence
  sgRNA
cttgtttacccgggagttcc

SEQ ID NO: 4797 - DNA, 20 bp, Artificial Sequence
  sgRNA
gaaaggtttcagaagcggac

SEQ ID NO: 4798 - DNA, 20 bp, Artificial Sequence
  sgRNA
tttgtcttactttgctaagt

SEQ ID NO: 4799 - DNA, 20 bp, Artificial Sequence
  sgRNA
tttatgagaattgagggcct

SEQ ID NO: 4800 - DNA, 20 bp, Artificial Sequence
  sgRNA
ctatggctctgcggagggag

SEQ ID NO: 4801 - DNA, 20 bp, Artificial Sequence
  sgRNA
gcgcttaccgcctcttatgc

SEQ ID NO: 4802 - DNA, 20 bp, Artificial Sequence
  sgRNA
ggtgatttcgcattgggtat

SEQ ID NO: 4803 - DNA, 20 bp, Artificial Sequence
  sgRNA
gaggttgctaagaattctgc

SEQ ID NO: 4804 - DNA, 20 bp, Artificial Sequence
  sgRNA
ctgccgctcgcccaggcttt

SEQ ID NO: 4805 - DNA, 20 bp, Artificial Sequence
  sgRNA
gagggtaggaagtgccgccg

SEQ ID NO: 4806 - DNA, 20 bp, Artificial Sequence
  sgRNA
cgaggagcaggctgactccg

SEQ ID NO: 4807 - DNA, 20 bp, Artificial Sequence
  sgRNA
gtccctcagacttgtttgct

SEQ ID NO: 4808 - DNA, 20 bp, Artificial Sequence
  sgRNA
gtagtccggtccataccata

SEQ ID NO: 4809 - DNA, 20 bp, Artificial Sequence
  sgRNA
acctcgcgcgcggactgccc

SEQ ID NO: 4810 - DNA, 20 bp, Artificial Sequence
  sgRNA
gcttggtctgtagatagaag

SEQ ID NO: 4811 - DNA, 20 bp, Artificial Sequence
  sgRNA
tcccagattggctgagaccc

SEQ ID NO: 4812 - DNA, 20 bp, Artificial Sequence
  sgRNA
agcaacgtgccctgggccac

SEQ ID NO: 4813 - DNA, 20 bp, Artificial Sequence
  sgRNA
aaggaaggcacgcgcaagac

SEQ ID NO: 4814 - DNA, 20 bp, Artificial Sequence
  sgRNA
gtcatggcctttgacatcag

SEQ ID NO: 4815 - DNA, 20 bp, Artificial Sequence
  sgRNA
cgcgctgggcctgggttcgc

SEQ ID NO: 4816 - DNA, 20 bp, Artificial Sequence
  sgRNA
atataagacttccagcacac

SEQ ID NO: 4817 - DNA, 20 bp, Artificial Sequence
  sgRNA
agatgcaacgtcatcacgcc

SEQ ID NO: 4818 - DNA, 20 bp, Artificial Sequence
  sgRNA
ccctttcgattacgctttgc

SEQ ID NO: 4819 - DNA, 20 bp, Artificial Sequence
  sgRNA
gtgtagtgagatcctggtcg

SEQ ID NO: 4820 - DNA, 20 bp, Artificial Sequence
  sgRNA
tctgattctcaatccacaag

SEQ ID NO: 4821 - DNA, 20 bp, Artificial Sequence
  sgRNA
gctcgacccttgcaccgaaa

SEQ ID NO: 4822 - DNA, 20 bp, Artificial Sequence
  sgRNA
agagatgcgcggcctcgcgc

SEQ ID NO: 4823 - DNA, 20 bp, Artificial Sequence
  sgRNA
cgcgcgtgcagcctcggagc

SEQ ID NO: 4824 - DNA, 20 bp, Artificial Sequence
  sgRNA
cttgcagctcagccagtctc

SEQ ID NO: 4825 - DNA, 20 bp, Artificial Sequence
  sgRNA
agtttcctgaatagtgagcg

SEQ ID NO: 4826 - DNA, 20 bp, Artificial Sequence
  sgRNA
ggaaacgtagctgtgggtga

SEQ ID NO: 4827 - DNA, 20 bp, Artificial Sequence
  sgRNA
ccgagcccagaggacgcgtc

SEQ ID NO: 4828 - DNA, 20 bp, Artificial Sequence
  sgRNA
cggatgtctgtgcgcatgct

SEQ ID NO: 4829 - DNA, 20 bp, Artificial Sequence
  sgRNA
tacctgcaaatgactgagtt

SEQ ID NO: 4830 - DNA, 20 bp, Artificial Sequence
  sgRNA
acccagacagctccctcgca

SEQ ID NO: 4831 - DNA, 20 bp, Artificial Sequence
  sgRNA
gctccttcagagcctgtagg

SEQ ID NO: 4832 - DNA, 20 bp, Artificial Sequence
  sgRNA
attgactaaggcagattaaa

SEQ ID NO: 4833 - DNA, 20 bp, Artificial Sequence
  sgRNA
agagcgcagcccggcgcgtg

SEQ ID NO: 4834 - DNA, 20 bp, Artificial Sequence
  sgRNA
tgccagcaagaaagaagccc

SEQ ID NO: 4835 - DNA, 20 bp, Artificial Sequence
  sgRNA
agttgcgcaggcgcaaccgc

SEQ ID NO: 4836 - DNA, 20 bp, Artificial Sequence
  sgRNA
ctcagcgggacaaagcaaac

SEQ ID NO: 4837 - DNA, 20 bp, Artificial Sequence
  sgRNA
ggcagcatctggactgcagc

SEQ ID NO: 4838 - DNA, 20 bp, Artificial Sequence
  sgRNA
agatctcccaaaccctctta

SEQ ID NO: 4839 - DNA, 20 bp, Artificial Sequence
  sgRNA
cggtgcgagttcttgcgagt

SEQ ID NO: 4840 - DNA, 20 bp, Artificial Sequence
  sgRNA
gccggagctggaatacgaac

SEQ ID NO: 4841 - DNA, 20 bp, Artificial Sequence
  sgRNA
gagcgattgtaaatgtgtga

SEQ ID NO: 4842 - DNA, 20 bp, Artificial Sequence
  sgRNA
ccagcaggttcggcgatgcc

SEQ ID NO: 4843 - DNA, 20 bp, Artificial Sequence
  sgRNA
attagcctactttgcaatcc

SEQ ID NO: 4844 - DNA, 20 bp, Artificial Sequence
  sgRNA
aggcgactgcatttatctgc

SEQ ID NO: 4845 - DNA, 20 bp, Artificial Sequence
  sgRNA
gtgctttgattggttgcctg

SEQ ID NO: 4846 - DNA, 20 bp, Artificial Sequence
  sgRNA
tttgagcagctcctcctgac

SEQ ID NO: 4847 - DNA, 20 bp, Artificial Sequence
  sgRNA
tcccagtactcctccaggca

SEQ ID NO: 4848 - DNA, 20 bp, Artificial Sequence
  sgRNA
atctagagcttatccatgta

SEQ ID NO: 4849 - DNA, 20 bp, Artificial Sequence
  sgRNA
cccacgcaggcccggcgccg

SEQ ID NO: 4850 - DNA, 20 bp, Artificial Sequence
  sgRNA
gtgtagtcttccgcaagcgc

SEQ ID NO: 4851 - DNA, 20 bp, Artificial Sequence
  sgRNA
actcttgcttagaaatctaa

SEQ ID NO: 4852 - DNA, 20 bp, Artificial Sequence
  sgRNA
gccgacctcactcattgctt

SEQ ID NO: 4853 - DNA, 20 bp, Artificial Sequence
  sgRNA
ctgcggctcactagcttggc

SEQ ID NO: 4854 - DNA, 20 bp, Artificial Sequence
  sgRNA
aaagcttactgtgccaggcc

SEQ ID NO: 4855 - DNA, 20 bp, Artificial Sequence
  sgRNA
cagggcctttgtgcgacgag

SEQ ID NO: 4856 - DNA, 20 bp, Artificial Sequence
  sgRNA
ccttggaaaggagcgcctgc

SEQ ID NO: 4857 - DNA, 20 bp, Artificial Sequence
  sgRNA
tacccagtgaaacatttact

SEQ ID NO: 4858 - DNA, 20 bp, Artificial Sequence
  sgRNA
ctcagacgcatgcgtgctga

SEQ ID NO: 4859 - DNA, 20 bp, Artificial Sequence
  sgRNA
tacgtagagacaatccatgg

SEQ ID NO: 4860 - DNA, 20 bp, Artificial Sequence
  sgRNA
ctgtgacctcatagagtact

SEQ ID NO: 4861 - DNA, 20 bp, Artificial Sequence
  sgRNA
cctttctaccctactcatta

SEQ ID NO: 4862 - DNA, 20 bp, Artificial Sequence
  sgRNA
gggaaacactgtctaggttc

SEQ ID NO: 4863 - DNA, 20 bp, Artificial Sequence
  sgRNA
gcgaggatccctagatgcag

SEQ ID NO: 4864 - DNA, 20 bp, Artificial Sequence
  sgRNA
ccaggcgagaagctgcagac

SEQ ID NO: 4865 - DNA, 20 bp, Artificial Sequence
  sgRNA
gtactaattaaggacaacag

SEQ ID NO: 4866 - DNA, 20 bp, Artificial Sequence
  sgRNA
caatgaaccagagacctgaa

SEQ ID NO: 4867 - DNA, 20 bp, Artificial Sequence
  sgRNA
actcaccagctaccaagccc

SEQ ID NO: 4868 - DNA, 20 bp, Artificial Sequence
  sgRNA
ggctaataatagactgatta

SEQ ID NO: 4869 - DNA, 20 bp, Artificial Sequence
  sgRNA
cgcagtgggcagcaggcctg

SEQ ID NO: 4870 - DNA, 20 bp, Artificial Sequence
  sgRNA
gagtcagcccgcctgccgct

SEQ ID NO: 4871 - DNA, 20 bp, Artificial Sequence
  sgRNA
ctgctgagctgagactgagg

SEQ ID NO: 4872 - DNA, 20 bp, Artificial Sequence
  sgRNA
cagcacagctgtcacacagc

SEQ ID NO: 4873 - DNA, 20 bp, Artificial Sequence
  sgRNA
cctgagcctaaacacgcgag

SEQ ID NO: 4874 - DNA, 20 bp, Artificial Sequence
  sgRNA
gggacaaactgaatcaggcg

SEQ ID NO: 4875 - DNA, 20 bp, Artificial Sequence
  sgRNA
gagcagctgcagtgcagtgt

SEQ ID NO: 4876 - DNA, 20 bp, Artificial Sequence
  sgRNA
aactttctctggatttgtac

SEQ ID NO: 4877 - DNA, 20 bp, Artificial Sequence
  sgRNA
cgagctcacacgtgacggca

SEQ ID NO: 4878 - DNA, 20 bp, Artificial Sequence
  sgRNA
cacatctgcgtcacttacag

SEQ ID NO: 4879 - DNA, 20 bp, Artificial Sequence
  sgRNA
gtgacagcgctaacgccttc

SEQ ID NO: 4880 - DNA, 20 bp, Artificial Sequence
  sgRNA
gggtgggtcacatgttcccg

SEQ ID NO: 4881 - DNA, 20 bp, Artificial Sequence
  sgRNA
gagccgtaacctgctcttgc

SEQ ID NO: 4882 - DNA, 20 bp, Artificial Sequence
  sgRNA
gaagagtgtctgtttaaggg

SEQ ID NO: 4883 - DNA, 20 bp, Artificial Sequence
  sgRNA
gcgctgccagtctcgggagg

SEQ ID NO: 4884 - DNA, 20 bp, Artificial Sequence
  sgRNA
catgcgtagtgtccattcca

SEQ ID NO: 4885 - DNA, 20 bp, Artificial Sequence
  sgRNA
ggcattccgtaaccttgttt

SEQ ID NO: 4886 - DNA, 20 bp, Artificial Sequence
  sgRNA
acatcgctcacgtccgccag

SEQ ID NO: 4887 - DNA, 20 bp, Artificial Sequence
  sgRNA
gaggaggagcctagaatgcc

SEQ ID NO: 4888 - DNA, 20 bp, Artificial Sequence
  sgRNA
cttcagagcgcatcctccag

SEQ ID NO: 4889 - DNA, 20 bp, Artificial Sequence
  sgRNA
atctctcggagagcagcgat

SEQ ID NO: 4890 - DNA, 20 bp, Artificial Sequence
  sgRNA
cgcgctgattggccgctacc

SEQ ID NO: 4891 - DNA, 20 bp, Artificial Sequence
  sgRNA
atctgctattaggaggctcc

SEQ ID NO: 4892 - DNA, 20 bp, Artificial Sequence
  sgRNA
aatcctggcctggagtcgtc

SEQ ID NO: 4893 - DNA, 20 bp, Artificial Sequence
  sgRNA
tgtctgctaaatgcttcacc

SEQ ID NO: 4894 - DNA, 20 bp, Artificial Sequence
  sgRNA
agacggagatctccgagttc

SEQ ID NO: 4895 - DNA, 20 bp, Artificial Sequence
  sgRNA
tctagggtcagagatctttc

SEQ ID NO: 4896 - DNA, 20 bp, Artificial Sequence
  sgRNA
ggtcctgcgggttagaggcg

SEQ ID NO: 4897 - DNA, 20 bp, Artificial Sequence
  sgRNA
gaagcaacatttattcagta

SEQ ID NO: 4898 - DNA, 20 bp, Artificial Sequence
  sgRNA
ggacaggaagtgccttgcgc

SEQ ID NO: 4899 - DNA, 20 bp, Artificial Sequence
  sgRNA
atgctggatggagtttaaac

SEQ ID NO: 4900 - DNA, 20 bp, Artificial Sequence
  sgRNA
aggtatgatgttatttgtca

SEQ ID NO: 4901 - DNA, 20 bp, Artificial Sequence
  sgRNA
agagctttctgagcaggtgc

SEQ ID NO: 4902 - DNA, 20 bp, Artificial Sequence
  sgRNA
ctggatagcattcttggttt

SEQ ID NO: 4903 - DNA, 20 bp, Artificial Sequence
  sgRNA
tgcaccaccgggctccgagc

SEQ ID NO: 4904 - DNA, 20 bp, Artificial Sequence
  sgRNA
tcagtatgtgtcaccaaagg

SEQ ID NO: 4905 - DNA, 20 bp, Artificial Sequence
  sgRNA
cacagtacgccagaatttgg

SEQ ID NO: 4906 - DNA, 20 bp, Artificial Sequence
  sgRNA
gacatggacaagttgtcttg

SEQ ID NO: 4907 - DNA, 20 bp, Artificial Sequence
  sgRNA
tctctctcaactcgttatca

SEQ ID NO: 4908 - DNA, 20 bp, Artificial Sequence
  sgRNA
aacgcctcgcttaaagtaac

SEQ ID NO: 4909 - DNA, 20 bp, Artificial Sequence
  sgRNA
agctgtttatcaactgcacc

SEQ ID NO: 4910 - DNA, 20 bp, Artificial Sequence
  sgRNA
gcggacgggtagctaagcgg

SEQ ID NO: 4911 - DNA, 20 bp, Artificial Sequence
  sgRNA
aaagcccgcgtagtaagcgc

SEQ ID NO: 4912 - DNA, 20 bp, Artificial Sequence
  sgRNA
gagccatagctacactgctg

SEQ ID NO: 4913 - DNA, 20 bp, Artificial Sequence
  sgRNA
aatggaaggagccaatgaag

SEQ ID NO: 4914 - DNA, 20 bp, Artificial Sequence
  sgRNA
ggaaggaggcactcggagac

SEQ ID NO: 4915 - DNA, 20 bp, Artificial Sequence
  sgRNA
gccaatttgaaggatgaaga

SEQ ID NO: 4916 - DNA, 20 bp, Artificial Sequence
  sgRNA
gggtgacaggagcccgacgt

SEQ ID NO: 4917 - DNA, 20 bp, Artificial Sequence
  sgRNA
cttaacctcgtgtttgcacg

SEQ ID NO: 4918 - DNA, 20 bp, Artificial Sequence
  sgRNA
agcaactctcggcttaaact

SEQ ID NO: 4919 - DNA, 20 bp, Artificial Sequence
  sgRNA
gctagggtgactcactgtct

SEQ ID NO: 4920 - DNA, 20 bp, Artificial Sequence
  sgRNA
gcatcaggtataaacttccc

SEQ ID NO: 4921 - DNA, 20 bp, Artificial Sequence
  sgRNA
caagagcctccctatcctcc

SEQ ID NO: 4922 - DNA, 20 bp, Artificial Sequence
  sgRNA
attaccatgtattagcatac

SEQ ID NO: 4923 - DNA, 20 bp, Artificial Sequence
  sgRNA
caggaggagagagcgacgtg

SEQ ID NO: 4924 - DNA, 20 bp, Artificial Sequence
  sgRNA
tgagagcctgcccaccgctc

SEQ ID NO: 4925 - DNA, 20 bp, Artificial Sequence
  sgRNA
cactaaccctgagccaagag

SEQ ID NO: 4926 - DNA, 20 bp, Artificial Sequence
  sgRNA
agggcttgtagagcttacta

SEQ ID NO: 4927 - DNA, 20 bp, Artificial Sequence
  sgRNA
cccgccctgcaaagcagacg

SEQ ID NO: 4928 - DNA, 20 bp, Artificial Sequence
  sgRNA
gcacaaaggagaaatcatac

SEQ ID NO: 4929 - DNA, 20 bp, Artificial Sequence
  sgRNA
cagacaccagctgtttatgt

SEQ ID NO: 4930 - DNA, 20 bp, Artificial Sequence
  sgRNA
ttctagaaacttggattcca

SEQ ID NO: 4931 - DNA, 20 bp, Artificial Sequence
  sgRNA
gccactgcactccaccgatc

SEQ ID NO: 4932 - DNA, 20 bp, Artificial Sequence
  sgRNA
atcggcatattgaggatgag

SEQ ID NO: 4933 - DNA, 20 bp, Artificial Sequence
  sgRNA
gatgttgcaggttagtggaa

SEQ ID NO: 4934 - DNA, 20 bp, Artificial Sequence
  sgRNA
gaagccgcggtgccaaatta

SEQ ID NO: 4935 - DNA, 20 bp, Artificial Sequence
  sgRNA
tttctggtgctaacttgcct

SEQ ID NO: 4936 - DNA, 20 bp, Artificial Sequence
  sgRNA
ggcctggctgcccgcgttgc

SEQ ID NO: 4937 - DNA, 20 bp, Artificial Sequence
  sgRNA
tacgtgagcagaagtagttc

SEQ ID NO: 4938 - DNA, 20 bp, Artificial Sequence
  sgRNA
ccaacttctttaaggagtta

SEQ ID NO: 4939 - DNA, 20 bp, Artificial Sequence
  sgRNA
atggtgctgcgccggttgcc

SEQ ID NO: 4940 - DNA, 20 bp, Artificial Sequence
  sgRNA
ttgagttacaggaaggaccg

SEQ ID NO: 4941 - DNA, 20 bp, Artificial Sequence
  sgRNA
cgggagttgcaagtaagcgc

SEQ ID NO: 4942 - DNA, 20 bp, Artificial Sequence
  sgRNA
acaacccagacttacagacc

SEQ ID NO: 4943 - DNA, 20 bp, Artificial Sequence
  sgRNA
aggacagtgccagccaattc

SEQ ID NO: 4944 - DNA, 20 bp, Artificial Sequence
  sgRNA
catgcgtacttcaagagccc

SEQ ID NO: 4945 - DNA, 20 bp, Artificial Sequence
  sgRNA
taagaaatctttattcgcgc

SEQ ID NO: 4946 - DNA, 20 bp, Artificial Sequence
  sgRNA
cttaaagctcttcccaagct

SEQ ID NO: 4947 - DNA, 20 bp, Artificial Sequence
  sgRNA
gggaaccgggtacggagagg

SEQ ID NO: 4948 - DNA, 20 bp, Artificial Sequence
  sgRNA
ctcaccaatggccgtccggg

SEQ ID NO: 4949 - DNA, 20 bp, Artificial Sequence
  sgRNA
aagagcaggcattaggagtc

SEQ ID NO: 4950 - DNA, 20 bp, Artificial Sequence
  sgRNA
agacatgctgaataacaaag

SEQ ID NO: 4951 - DNA, 20 bp, Artificial Sequence
  sgRNA
gcaggtaacccggcctaata

SEQ ID NO: 4952 - DNA, 20 bp, Artificial Sequence
  sgRNA
ggacgagagggagagagagg

SEQ ID NO: 4953 - DNA, 20 bp, Artificial Sequence
  sgRNA
tcagccaccgcacttctttg

SEQ ID NO: 4954 - DNA, 20 bp, Artificial Sequence
  sgRNA
ctgagacaaccttactgcgc

SEQ ID NO: 4955 - DNA, 20 bp, Artificial Sequence
  sgRNA
gaggcgcttctagcgacacg

SEQ ID NO: 4956 - DNA, 20 bp, Artificial Sequence
  sgRNA
cagagattcaaagctaacct

SEQ ID NO: 4957 - DNA, 20 bp, Artificial Sequence
  sgRNA
gccgccgctaaggaaagagg

SEQ ID NO: 4958 - DNA, 20 bp, Artificial Sequence
  sgRNA
cgagccttccggaggacgcg

SEQ ID NO: 4959 - DNA, 20 bp, Artificial Sequence
  sgRNA
gagagggccagcctcaccgc

SEQ ID NO: 4960 - DNA, 20 bp, Artificial Sequence
  sgRNA
attgtctgtcttgaagggag

SEQ ID NO: 4961 - DNA, 20 bp, Artificial Sequence
  sgRNA
gaactgatggacaccgagtg

SEQ ID NO: 4962 - DNA, 20 bp, Artificial Sequence
  sgRNA
gttctcgtggcgcactgagc

SEQ ID NO: 4963 - DNA, 20 bp, Artificial Sequence
  sgRNA
actgcaaactgacgccgacg

SEQ ID NO: 4964 - DNA, 20 bp, Artificial Sequence
  sgRNA
atcatcgggcaacagtgctt

SEQ ID NO: 4965 - DNA, 20 bp, Artificial Sequence
  sgRNA
gagacttgtttgtctgggcc

SEQ ID NO: 4966 - DNA, 20 bp, Artificial Sequence
  sgRNA
aagaaatccacggctagttt

SEQ ID NO: 4967 - DNA, 20 bp, Artificial Sequence
  sgRNA
gtcgctacaaacttcgccga

SEQ ID NO: 4968 - DNA, 20 bp, Artificial Sequence
  sgRNA
cgactctcgagcgtctccat

SEQ ID NO: 4969 - DNA, 20 bp, Artificial Sequence
  sgRNA
taatcactagggtatgtctt

SEQ ID NO: 4970 - DNA, 20 bp, Artificial Sequence
  sgRNA
ggcggtaagtaaagatggtg

SEQ ID NO: 4971 - DNA, 20 bp, Artificial Sequence
  sgRNA
gggtagtacacttccagcag

SEQ ID NO: 4972 - DNA, 20 bp, Artificial Sequence
  sgRNA
atggacacaacggcagggcg

SEQ ID NO: 4973 - DNA, 20 bp, Artificial Sequence
  sgRNA
cggaacttaatagacaccaa

SEQ ID NO: 4974 - DNA, 20 bp, Artificial Sequence
  sgRNA
tcatttctatgctagggctt

SEQ ID NO: 4975 - DNA, 20 bp, Artificial Sequence
  sgRNA
agattgaatctcagagttta

SEQ ID NO: 4976 - DNA, 20 bp, Artificial Sequence
  sgRNA
tcggagagcaagcattctgc

SEQ ID NO: 4977 - DNA, 20 bp, Artificial Sequence
  sgRNA
ggagctgcggctaagcgcgc

SEQ ID NO: 4978 - DNA, 20 bp, Artificial Sequence
  sgRNA
ggctgctgagcccacgtcag

SEQ ID NO: 4979 - DNA, 20 bp, Artificial Sequence
  sgRNA
tatcccagagtgctcgagtc

SEQ ID NO: 4980 - DNA, 20 bp, Artificial Sequence
  sgRNA
ataaattaatgctcctgcgc

SEQ ID NO: 4981 - DNA, 20 bp, Artificial Sequence
  sgRNA
tcagggtaggagatgggtgt

SEQ ID NO: 4982 - DNA, 20 bp, Artificial Sequence
  sgRNA
cgacctcggatgacgccagc

SEQ ID NO: 4983 - DNA, 20 bp, Artificial Sequence
  sgRNA
aattgctaacaatcagatag

SEQ ID NO: 4984 - DNA, 20 bp, Artificial Sequence
  sgRNA
ttgtgcggctcgcccaggcc

SEQ ID NO: 4985 - DNA, 20 bp, Artificial Sequence
  sgRNA
cggaggctgagcgatcgctg

SEQ ID NO: 4986 - DNA, 20 bp, Artificial Sequence
  sgRNA
atgccgtgtcctctgaacgg

SEQ ID NO: 4987 - DNA, 20 bp, Artificial Sequence
  sgRNA
gcctcaggtcagagtcgccc

SEQ ID NO: 4988 - DNA, 20 bp, Artificial Sequence
  sgRNA
acccggtgcggatagggctc

SEQ ID NO: 4989 - DNA, 20 bp, Artificial Sequence
  sgRNA
tctgaatatgagcaagtggt

SEQ ID NO: 4990 - DNA, 20 bp, Artificial Sequence
  sgRNA
atgctaagaccacaactaca

SEQ ID NO: 4991 - DNA, 20 bp, Artificial Sequence
  sgRNA
tcgctgcttcttacgtaagc

SEQ ID NO: 4992 - DNA, 20 bp, Artificial Sequence
  sgRNA
gcgaccagccaggttcagtc

SEQ ID NO: 4993 - DNA, 20 bp, Artificial Sequence
  sgRNA
tgcataacgctcgagcattc

SEQ ID NO: 4994 - DNA, 20 bp, Artificial Sequence
  sgRNA
attctgaagccagatgcgcc

SEQ ID NO: 4995 - DNA, 20 bp, Artificial Sequence
  sgRNA
gctcagagccttatccacac

SEQ ID NO: 4996 - DNA, 20 bp, Artificial Sequence
  sgRNA
actcatctgatcgtgatgcg

SEQ ID NO: 4997 - DNA, 20 bp, Artificial Sequence
  sgRNA
agctgcgcgcagtgccctcg

SEQ ID NO: 4998 - DNA, 20 bp, Artificial Sequence
  sgRNA
agttgattgcaaagaggcgg

SEQ ID NO: 4999 - DNA, 20 bp, Artificial Sequence
  sgRNA
caatactaaagaaagcatcc

SEQ ID NO: 5000 - DNA, 20 bp, Artificial Sequence
  sgRNA
ggaacagagcgtagtgccaa

SEQ ID NO: 5001 - DNA, 20 bp, Artificial Sequence
  sgRNA
ttgacagcgagagcgcctcc

SEQ ID NO: 5002 - DNA, 20 bp, Artificial Sequence
  sgRNA
gtcatagaggactcagtcct

SEQ ID NO: 5003 - DNA, 20 bp, Artificial Sequence
  sgRNA
cctggagggcgtcctggcgg

SEQ ID NO: 5004 - DNA, 20 bp, Artificial Sequence
  sgRNA
agctcgaatccgtcgctatg

SEQ ID NO: 5005 - DNA, 20 bp, Artificial Sequence
  sgRNA
tcaccgtcctctagggactc

SEQ ID NO: 5006 - DNA, 20 bp, Artificial Sequence
  sgRNA
gccgcagcaagtccctgccc

SEQ ID NO: 5007 - DNA, 20 bp, Artificial Sequence
  sgRNA
atagggcttgattctcatcc

SEQ ID NO: 5008 - DNA, 20 bp, Artificial Sequence
  sgRNA
cttccgcaaacgcgcctggg

SEQ ID NO: 5009 - DNA, 20 bp, Artificial Sequence
  sgRNA
atcaaaccagcccgctctat

SEQ ID NO: 5010 - DNA, 20 bp, Artificial Sequence
  sgRNA
tcagcaaccgccgagtagtg

SEQ ID NO: 5011 - DNA, 20 bp, Artificial Sequence
  sgRNA
gcggatgtcccgaccctcct

SEQ ID NO: 5012 - DNA, 20 bp, Artificial Sequence
  sgRNA
ggcggctccgcataaccacg

SEQ ID NO: 5013 - DNA, 20 bp, Artificial Sequence
  sgRNA
ggtggctttgcgggcgctcg

SEQ ID NO: 5014 - DNA, 20 bp, Artificial Sequence
  sgRNA
gggcaaggctaagtaaggta

SEQ ID NO: 5015 - DNA, 20 bp, Artificial Sequence
  sgRNA
gtttgggtgtcaccggctgc

SEQ ID NO: 5016 - DNA, 20 bp, Artificial Sequence
  sgRNA
acggagggtggcgcattgaa

SEQ ID NO: 5017 - DNA, 20 bp, Artificial Sequence
  sgRNA
gcttggcgggtgctgtgcgt

SEQ ID NO: 5018 - DNA, 20 bp, Artificial Sequence
  sgRNA
tccaaagcaagatccagata

SEQ ID NO: 5019 - DNA, 20 bp, Artificial Sequence
  sgRNA
gttctgctcagacaataaga

SEQ ID NO: 5020 - DNA, 20 bp, Artificial Sequence
  sgRNA
ctctctccctcctaacatgc

SEQ ID NO: 5021 - DNA, 20 bp, Artificial Sequence
  sgRNA
gggcccagccctttcccgac

SEQ ID NO: 5022 - DNA, 20 bp, Artificial Sequence
  sgRNA
cagaggccaacctgtcctct

SEQ ID NO: 5023 - DNA, 20 bp, Artificial Sequence
  sgRNA
gatgcaataaggcttgcccg

SEQ ID NO: 5024 - DNA, 20 bp, Artificial Sequence
  sgRNA
gtttgtgtttctggcctcta

SEQ ID NO: 5025 - DNA, 20 bp, Artificial Sequence
  sgRNA
gcccgaggctgacttctcat

SEQ ID NO: 5026 - DNA, 20 bp, Artificial Sequence
  sgRNA
gactatcatgctcagagcct

SEQ ID NO: 5027 - DNA, 20 bp, Artificial Sequence
  sgRNA
aacatcatcgggatctaatc

SEQ ID NO: 5028 - DNA, 20 bp, Artificial Sequence
  sgRNA
aaatcctattggcatccagg

SEQ ID NO: 5029 - DNA, 20 bp, Artificial Sequence
  sgRNA
agttctagttgcccaactat

SEQ ID NO: 5030 - DNA, 20 bp, Artificial Sequence
  sgRNA
gggacgttggttccctgcac

SEQ ID NO: 5031 - DNA, 20 bp, Artificial Sequence
  sgRNA
cgggaccctcggcacccatt

SEQ ID NO: 5032 - DNA, 20 bp, Artificial Sequence
  sgRNA
ttggcacagctacatcagcg

SEQ ID NO: 5033 - DNA, 20 bp, Artificial Sequence
  sgRNA
aaaggagctctggaccacta

SEQ ID NO: 5034 - DNA, 20 bp, Artificial Sequence
  sgRNA
tgccaaactccagaaatacc

SEQ ID NO: 5035 - DNA, 20 bp, Artificial Sequence
  sgRNA
atagagtttggttacttgaa

SEQ ID NO: 5036 - DNA, 20 bp, Artificial Sequence
  sgRNA
agactaccaccgtagacaag

SEQ ID NO: 5037 - DNA, 20 bp, Artificial Sequence
  sgRNA
gcgccgctgcccttgtagcc

SEQ ID NO: 5038 - DNA, 20 bp, Artificial Sequence
  sgRNA
tgcgcatgttccacccgctc

SEQ ID NO: 5039 - DNA, 20 bp, Artificial Sequence
  sgRNA
gaacccgcggagcctccggt

SEQ ID NO: 5040 - DNA, 20 bp, Artificial Sequence
  sgRNA
gtagcaaccataggttctaa

SEQ ID NO: 5041 - DNA, 20 bp, Artificial Sequence
  sgRNA
gaagcctgagagcgaggctg

SEQ ID NO: 5042 - DNA, 20 bp, Artificial Sequence
  sgRNA
gcaatcggctcgtgtctctc

SEQ ID NO: 5043 - DNA, 20 bp, Artificial Sequence
  sgRNA
gctttggcacggatggcacg

SEQ ID NO: 5044 - DNA, 20 bp, Artificial Sequence
  sgRNA
gagagcggcgactggtgacg

SEQ ID NO: 5045 - DNA, 20 bp, Artificial Sequence
  sgRNA
gtgcgaaagggtacccgagg

SEQ ID NO: 5046 - DNA, 20 bp, Artificial Sequence
  sgRNA
gctgtcttacctgattcctc

SEQ ID NO: 5047 - DNA, 20 bp, Artificial Sequence
  sgRNA
ggtcacatggcatagatgtc

SEQ ID NO: 5048 - DNA, 20 bp, Artificial Sequence
  sgRNA
tctagctgggcgcgagcccg

SEQ ID NO: 5049 - DNA, 20 bp, Artificial Sequence
  sgRNA
gtgctgctgcgctatagcgg

SEQ ID NO: 5050 - DNA, 20 bp, Artificial Sequence
  sgRNA
tacactaaacccatacctcc

SEQ ID NO: 5051 - DNA, 20 bp, Artificial Sequence
  sgRNA
ggagccaaacatggcgtcta

SEQ ID NO: 5052 - DNA, 20 bp, Artificial Sequence
  sgRNA
tgcgcagagccagcacaaat

SEQ ID NO: 5053 - DNA, 20 bp, Artificial Sequence
  sgRNA
agaggtggcagttgcaggcc

SEQ ID NO: 5054 - DNA, 20 bp, Artificial Sequence
  sgRNA
aggcggctgtgggtgggcag

SEQ ID NO: 5055 - DNA, 20 bp, Artificial Sequence
  sgRNA
cctttcgggcttcggtggag

SEQ ID NO: 5056 - DNA, 20 bp, Artificial Sequence
  sgRNA
aagatgagccgcgctcgctg

SEQ ID NO: 5057 - DNA, 20 bp, Artificial Sequence
  sgRNA
ggtaacccacagccagtgac

SEQ ID NO: 5058 - DNA, 20 bp, Artificial Sequence
  sgRNA
agtatgcaaaggatagtgat

SEQ ID NO: 5059 - DNA, 20 bp, Artificial Sequence
  sgRNA
gtgggaatgaaccggctggg

SEQ ID NO: 5060 - DNA, 20 bp, Artificial Sequence
  sgRNA
tttcggttctactcctgcag

SEQ ID NO: 5061 - DNA, 20 bp, Artificial Sequence
  sgRNA
acctcccttggatctcgccc

SEQ ID NO: 5062 - DNA, 20 bp, Artificial Sequence
  sgRNA
agaaacttatgacttcctaa

SEQ ID NO: 5063 - DNA, 20 bp, Artificial Sequence
  sgRNA
tcgccgtcagatttctttgg

SEQ ID NO: 5064 - DNA, 20 bp, Artificial Sequence
  sgRNA
aagacctcgtgagttggagg

SEQ ID NO: 5065 - DNA, 20 bp, Artificial Sequence
  sgRNA
ctacaccaattgaaggttac

SEQ ID NO: 5066 - DNA, 20 bp, Artificial Sequence
  sgRNA
tggaattcatgaagcagcca

SEQ ID NO: 5067 - DNA, 20 bp, Artificial Sequence
  sgRNA
attaagataaagcatcagag

SEQ ID NO: 5068 - DNA, 20 bp, Artificial Sequence
  sgRNA
tacgcatgtgcctcccagct

SEQ ID NO: 5069 - DNA, 20 bp, Artificial Sequence
  sgRNA
gaatagcagcaaggccaagg

SEQ ID NO: 5070 - DNA, 20 bp, Artificial Sequence
  sgRNA
gagaggagatggatgtccct

SEQ ID NO: 5071 - DNA, 20 bp, Artificial Sequence
  sgRNA
agcacaatctgggcgggtcc

SEQ ID NO: 5072 - DNA, 20 bp, Artificial Sequence
  sgRNA
ggtaccggaacaaatcttgc

SEQ ID NO: 5073 - DNA, 20 bp, Artificial Sequence
  sgRNA
ggtgtccatgcaggtgggcg

SEQ ID NO: 5074 - DNA, 20 bp, Artificial Sequence
  sgRNA
gtgagcactggcgccgcggg

SEQ ID NO: 5075 - DNA, 20 bp, Artificial Sequence
  sgRNA
cattacagagagttggaact

SEQ ID NO: 5076 - DNA, 20 bp, Artificial Sequence
  sgRNA
ggaaggaacgggagaactag

SEQ ID NO: 5077 - DNA, 20 bp, Artificial Sequence
  sgRNA
attgctcaggttatgacacc

SEQ ID NO: 5078 - DNA, 20 bp, Artificial Sequence
  sgRNA
tagagtgcgtgatttcatag

SEQ ID NO: 5079 - DNA, 20 bp, Artificial Sequence
  sgRNA
caataaacatgttggccctg

SEQ ID NO: 5080 - DNA, 20 bp, Artificial Sequence
  sgRNA
ggcctgttcggagggagtgg

SEQ ID NO: 5081 - DNA, 20 bp, Artificial Sequence
  sgRNA
gggtccggaaccggtttggg

SEQ ID NO: 5082 - DNA, 20 bp, Artificial Sequence
  sgRNA
gcagagcagcttctcctatg

SEQ ID NO: 5083 - DNA, 20 bp, Artificial Sequence
  sgRNA
ttacgtcagtgtgctgtttc

SEQ ID NO: 5084 - DNA, 20 bp, Artificial Sequence
  sgRNA
gacagagctagtccatcacc

SEQ ID NO: 5085 - DNA, 20 bp, Artificial Sequence
  sgRNA
acctgagccatgccaaggaa

SEQ ID NO: 5086 - DNA, 20 bp, Artificial Sequence
  sgRNA
ggcggagtttagggaagcag

SEQ ID NO: 5087 - DNA, 20 bp, Artificial Sequence
  sgRNA
ctcttgactatacataacag

SEQ ID NO: 5088 - DNA, 20 bp, Artificial Sequence
  sgRNA
gcgaggactgcgcgctaccc

SEQ ID NO: 5089 - DNA, 20 bp, Artificial Sequence
  sgRNA
agatactagcatttagcatg

SEQ ID NO: 5090 - DNA, 20 bp, Artificial Sequence
  sgRNA
tttagggtggagatagaact

SEQ ID NO: 5091 - DNA, 20 bp, Artificial Sequence
  sgRNA
ggcctctctttccatagacc

SEQ ID NO: 5092 - DNA, 20 bp, Artificial Sequence
  sgRNA
aagacccgacattcctcttc

SEQ ID NO: 5093 - DNA, 20 bp, Artificial Sequence
  sgRNA
gactcttccagagctgctga

SEQ ID NO: 5094 - DNA, 20 bp, Artificial Sequence
  sgRNA
atcacgtgatccatagtggg

SEQ ID NO: 5095 - DNA, 20 bp, Artificial Sequence
  sgRNA
ttgatcctggaaggcaatcc

SEQ ID NO: 5096 - DNA, 20 bp, Artificial Sequence
  sgRNA
cgtcagaggaaatagaggcg

SEQ ID NO: 5097 - DNA, 20 bp, Artificial Sequence
  sgRNA
caatcgccgcgccggccaga

SEQ ID NO: 5098 - DNA, 20 bp, Artificial Sequence
  sgRNA
ggatactctccgctgatcca

SEQ ID NO: 5099 - DNA, 20 bp, Artificial Sequence
  sgRNA
tgactcgtcttgttctattt

SEQ ID NO: 5100 - DNA, 20 bp, Artificial Sequence
  sgRNA
cccgtttggccaatgacaat

SEQ ID NO: 5101 - DNA, 20 bp, Artificial Sequence
  sgRNA
ctggagagggagtaacccgt

SEQ ID NO: 5102 - DNA, 20 bp, Artificial Sequence
  sgRNA
agtggaccggaatgcctgtc

SEQ ID NO: 5103 - DNA, 20 bp, Artificial Sequence
  sgRNA
tgcgcccagaggcgctacgg

SEQ ID NO: 5104 - DNA, 20 bp, Artificial Sequence
  sgRNA
ggatgaccgcgaccgcgcgc

SEQ ID NO: 5105 - DNA, 20 bp, Artificial Sequence
  sgRNA
ggtcagctcacaatgatgaa

SEQ ID NO: 5106 - DNA, 20 bp, Artificial Sequence
  sgRNA
acctccagggctagccaatg

SEQ ID NO: 5107 - DNA, 20 bp, Artificial Sequence
  sgRNA
gaggcagtctccagggaagt

SEQ ID NO: 5108 - DNA, 20 bp, Artificial Sequence
  sgRNA
aagccaagaactaggaggag

SEQ ID NO: 5109 - DNA, 20 bp, Artificial Sequence
  sgRNA
ttgcatcacaaagcgttgcc

SEQ ID NO: 5110 - DNA, 20 bp, Artificial Sequence
  sgRNA
tttatgcaatgttaagtgag

SEQ ID NO: 5111 - DNA, 20 bp, Artificial Sequence
  sgRNA
cacggcgtcttgggtggtcc

SEQ ID NO: 5112 - DNA, 20 bp, Artificial Sequence
  sgRNA
gaggcagtggagggttatcc

SEQ ID NO: 5113 - DNA, 20 bp, Artificial Sequence
  sgRNA
acctggcaggtttgcgtgcc

SEQ ID NO: 5114 - DNA, 20 bp, Artificial Sequence
  sgRNA
gagatcaggaaattctgcgt

SEQ ID NO: 5115 - DNA, 20 bp, Artificial Sequence
  sgRNA
ggcttagtggctagggttgg

SEQ ID NO: 5116 - DNA, 20 bp, Artificial Sequence
  sgRNA
gggtggcagagcagatcccg

SEQ ID NO: 5117 - DNA, 20 bp, Artificial Sequence
  sgRNA
gggtcagaggtccgggtggc

SEQ ID NO: 5118 - DNA, 20 bp, Artificial Sequence
  sgRNA
gggtctgtttactcctataa

SEQ ID NO: 5119 - DNA, 20 bp, Artificial Sequence
  sgRNA
ggaggcaggccgtgtgaaag

SEQ ID NO: 5120 - DNA, 20 bp, Artificial Sequence
  sgRNA
agaaagtacttggaggaaga

SEQ ID NO: 5121 - DNA, 20 bp, Artificial Sequence
  sgRNA
gtgtgatctgttggtgagcc

SEQ ID NO: 5122 - DNA, 20 bp, Artificial Sequence
  sgRNA
gcagctagaagcaaagcctc

SEQ ID NO: 5123 - DNA, 20 bp, Artificial Sequence
  sgRNA
cgcaaatagaaggacacgga

SEQ ID NO: 5124 - DNA, 20 bp, Artificial Sequence
  sgRNA
aagaaccaagtattcagcca

SEQ ID NO: 5125 - DNA, 20 bp, Artificial Sequence
  sgRNA
cccagagtcccagagccatt

SEQ ID NO: 5126 - DNA, 20 bp, Artificial Sequence
  sgRNA
tgagagagagagagagagag

SEQ ID NO: 5127 - DNA, 20 bp, Artificial Sequence
  sgRNA
agaaccatctgtggctcctg

SEQ ID NO: 5128 - DNA, 20 bp, Artificial Sequence
  sgRNA
atttcttctttggttctttg

SEQ ID NO: 5129 - DNA, 20 bp, Artificial Sequence
  sgRNA
tttatggagcgcccttgtcg

SEQ ID NO: 5130 - DNA, 20 bp, Artificial Sequence
  sgRNA
aatcacgctcatcgacctat

SEQ ID NO: 5131 - DNA, 20 bp, Artificial Sequence
  sgRNA
tgggcgggttcaaggctgcg

SEQ ID NO: 5132 - DNA, 20 bp, Artificial Sequence
  sgRNA
agtccaagtgctgcggcgag

SEQ ID NO: 5133 - DNA, 20 bp, Artificial Sequence
  sgRNA
ggaagaacactatattagtc

SEQ ID NO: 5134 - DNA, 20 bp, Artificial Sequence
  sgRNA
ccctgcagggcgcacccaac

SEQ ID NO: 5135 - DNA, 20 bp, Artificial Sequence
  sgRNA
ccgcgagctgccgcgaactc

SEQ ID NO: 5136 - DNA, 20 bp, Artificial Sequence
  sgRNA
cggacctgtggaccggatca

SEQ ID NO: 5137 - DNA, 20 bp, Artificial Sequence
  sgRNA
ggaggcagacatagtcaccg

SEQ ID NO: 5138 - DNA, 20 bp, Artificial Sequence
  sgRNA
tctcttcctgccagcactgc

SEQ ID NO: 5139 - DNA, 20 bp, Artificial Sequence
  sgRNA
cccacacctgccgggatgtc

SEQ ID NO: 5140 - DNA, 20 bp, Artificial Sequence
  sgRNA
taggtaacaacataatcatc

SEQ ID NO: 5141 - DNA, 20 bp, Artificial Sequence
  sgRNA
agctcgcagactatgagctg

SEQ ID NO: 5142 - DNA, 20 bp, Artificial Sequence
  sgRNA
cgccttatctctacggccat

SEQ ID NO: 5143 - DNA, 20 bp, Artificial Sequence
  sgRNA
cgcacagggttaagcggcag

SEQ ID NO: 5144 - DNA, 20 bp, Artificial Sequence
  sgRNA
gaactctgactcccagagcc

SEQ ID NO: 5145 - DNA, 20 bp, Artificial Sequence
  sgRNA
ctcaattggtcccgcctgtc

SEQ ID NO: 5146 - DNA, 20 bp, Artificial Sequence
  sgRNA
ggcgcgtcgtgcgcagagcg

SEQ ID NO: 5147 - DNA, 20 bp, Artificial Sequence
  sgRNA
ggcgggaactggtcggagaa

SEQ ID NO: 5148 - DNA, 20 bp, Artificial Sequence
  sgRNA
acacatccacactcctcgcc

SEQ ID NO: 5149 - DNA, 20 bp, Artificial Sequence
  sgRNA
gggagcaggcacgagcttta

SEQ ID NO: 5150 - DNA, 20 bp, Artificial Sequence
  sgRNA
gaggagggccgcgacgagcc

SEQ ID NO: 5151 - DNA, 20 bp, Artificial Sequence
  sgRNA
ggcttgtgtcaccgtcgccc

SEQ ID NO: 5152 - DNA, 20 bp, Artificial Sequence
  sgRNA
cttgcaaggaccacgaggag

SEQ ID NO: 5153 - DNA, 20 bp, Artificial Sequence
  sgRNA
taaagtcccggcgctgcccg

SEQ ID NO: 5154 - DNA, 20 bp, Artificial Sequence
  sgRNA
acagaacacaaccaacccaa

SEQ ID NO: 5155 - DNA, 20 bp, Artificial Sequence
  sgRNA
gtcgtgtcgtgtcgcggcgc

SEQ ID NO: 5156 - DNA, 20 bp, Artificial Sequence
  sgRNA
ccagcggactttggatctgg

SEQ ID NO: 5157 - DNA, 20 bp, Artificial Sequence
  sgRNA
ttacccaaatgtttgaaaga

SEQ ID NO: 5158 - DNA, 20 bp, Artificial Sequence
  sgRNA
gaagggtcttctgccaccga

SEQ ID NO: 5159 - DNA, 20 bp, Artificial Sequence
  sgRNA
tggcggctctgactttgctc

SEQ ID NO: 5160 - DNA, 20 bp, Artificial Sequence
  sgRNA
cgacatggctccgaactgcg

SEQ ID NO: 5161 - DNA, 20 bp, Artificial Sequence
  sgRNA
ctggccgctctcccagtgcc

SEQ ID NO: 5162 - DNA, 20 bp, Artificial Sequence
  sgRNA
aaatgcggctgccgcttgtt

SEQ ID NO: 5163 - DNA, 20 bp, Artificial Sequence
  sgRNA
actaggcagacaggtgacta

SEQ ID NO: 5164 - DNA, 20 bp, Artificial Sequence
  sgRNA
gccgagcgggcttggcggtg

SEQ ID NO: 5165 - DNA, 20 bp, Artificial Sequence
  sgRNA
ctaagctttacagctctgtg

SEQ ID NO: 5166 - DNA, 20 bp, Artificial Sequence
  sgRNA
tcagctggcaaccatgagaa

SEQ ID NO: 5167 - DNA, 20 bp, Artificial Sequence
  sgRNA
acccaagcgggaggctttgt

SEQ ID NO: 5168 - DNA, 20 bp, Artificial Sequence
  sgRNA
aactcgtgacaacccgtcgg

SEQ ID NO: 5169 - DNA, 20 bp, Artificial Sequence
  sgRNA
cgaggagttacagctggagc

SEQ ID NO: 5170 - DNA, 20 bp, Artificial Sequence
  sgRNA
ttcttctaggcagacaaacg

SEQ ID NO: 5171 - DNA, 20 bp, Artificial Sequence
  sgRNA
catttccacttggcctgtga

SEQ ID NO: 5172 - DNA, 20 bp, Artificial Sequence
  sgRNA
attccagcagagtctgtacc

SEQ ID NO: 5173 - DNA, 20 bp, Artificial Sequence
  sgRNA
ttctacacggcagggcacgt

SEQ ID NO: 5174 - DNA, 20 bp, Artificial Sequence
  sgRNA
actttccttccctacctaaa

SEQ ID NO: 5175 - DNA, 20 bp, Artificial Sequence
  sgRNA
tatgtacacattgcctcctc

SEQ ID NO: 5176 - DNA, 20 bp, Artificial Sequence
  sgRNA
tcctccgacaggcacagtcc

SEQ ID NO: 5177 - DNA, 20 bp, Artificial Sequence
  sgRNA
gtgaagtctgacctcacagg

SEQ ID NO: 5178 - DNA, 20 bp, Artificial Sequence
  sgRNA
tggaaggaggatgttctcaa

SEQ ID NO: 5179 - DNA, 20 bp, Artificial Sequence
  sgRNA
aaagggccagtatcccaatc

SEQ ID NO: 5180 - DNA, 20 bp, Artificial Sequence
  sgRNA
gggtggacccgtgacctgag

SEQ ID NO: 5181 - DNA, 20 bp, Artificial Sequence
  sgRNA
gaaaggaaactgtgtttaaa

SEQ ID NO: 5182 - DNA, 20 bp, Artificial Sequence
  sgRNA
tccgcgtgggccggatggcg

SEQ ID NO: 5183 - DNA, 20 bp, Artificial Sequence
  sgRNA
gggtttaaactcacctcctc

SEQ ID NO: 5184 - DNA, 20 bp, Artificial Sequence
  sgRNA
ctagctagcgagcatcctct

SEQ ID NO: 5185 - DNA, 20 bp, Artificial Sequence
  sgRNA
tgcagctataaatatcagag

SEQ ID NO: 5186 - DNA, 20 bp, Artificial Sequence
  sgRNA
gaacagatactatcggcaaa

SEQ ID NO: 5187 - DNA, 20 bp, Artificial Sequence
  sgRNA
agcttcctttctcacatctc

SEQ ID NO: 5188 - DNA, 20 bp, Artificial Sequence
  sgRNA
cgcaactcttcactgcggta

SEQ ID NO: 5189 - DNA, 20 bp, Artificial Sequence
  sgRNA
cagcaatcctgactcagcag

SEQ ID NO: 5190 - DNA, 20 bp, Artificial Sequence
  sgRNA
ctaggccggcctctcctgcg

SEQ ID NO: 5191 - DNA, 20 bp, Artificial Sequence
  sgRNA
caaaccaggtggcacatcgc

SEQ ID NO: 5192 - DNA, 20 bp, Artificial Sequence
  sgRNA
cggaggttgcgtggtgcagg

SEQ ID NO: 5193 - DNA, 20 bp, Artificial Sequence
  sgRNA
gtacagaaacacagatgatg

SEQ ID NO: 5194 - DNA, 20 bp, Artificial Sequence
  sgRNA
tgtttccgattgggcagaat

SEQ ID NO: 5195 - DNA, 20 bp, Artificial Sequence
  sgRNA
ggtctcgctgggaggtgcat

SEQ ID NO: 5196 - DNA, 20 bp, Artificial Sequence
  sgRNA
gggacacagcgcggcacgat

SEQ ID NO: 5197 - DNA, 20 bp, Artificial Sequence
  sgRNA
tctcctcctccggtctcgag

SEQ ID NO: 5198 - DNA, 20 bp, Artificial Sequence
  sgRNA
cgcggctgactgacgcggtg

SEQ ID NO: 5199 - DNA, 20 bp, Artificial Sequence
  sgRNA
tctgactctggagtgcttta

SEQ ID NO: 5200 - DNA, 20 bp, Artificial Sequence
  sgRNA
gactgaggtggaggcctggg

SEQ ID NO: 5201 - DNA, 20 bp, Artificial Sequence
  sgRNA
cacgtgtcatgttccatatt

SEQ ID NO: 5202 - DNA, 20 bp, Artificial Sequence
  sgRNA
cttgcgatttgctgcctacg

SEQ ID NO: 5203 - DNA, 20 bp, Artificial Sequence
  sgRNA
gaagcgtgcgagtacttatg

SEQ ID NO: 5204 - DNA, 20 bp, Artificial Sequence
  sgRNA
gcagttgggaaacttgatat

SEQ ID NO: 5205 - DNA, 20 bp, Artificial Sequence
  sgRNA
atgcagatgaggcgggcgcg

SEQ ID NO: 5206 - DNA, 20 bp, Artificial Sequence
  sgRNA
tggcaaccgtggcgcagctt

SEQ ID NO: 5207 - DNA, 20 bp, Artificial Sequence
  sgRNA
agcaaatctcattggtaaag

SEQ ID NO: 5208 - DNA, 20 bp, Artificial Sequence
  sgRNA
cgtgaccgccgatccctctg

SEQ ID NO: 5209 - DNA, 20 bp, Artificial Sequence
  sgRNA
gggagggcgcagatcacccg

SEQ ID NO: 5210 - DNA, 20 bp, Artificial Sequence
  sgRNA
tcagtcacagaagactgaga

SEQ ID NO: 5211 - DNA, 20 bp, Artificial Sequence
  sgRNA
gctgggcatgttaacccaca

SEQ ID NO: 5212 - DNA, 20 bp, Artificial Sequence
  sgRNA
atggtgggattgggcttctg

SEQ ID NO: 5213 - DNA, 20 bp, Artificial Sequence
  sgRNA
ggagggagggaggtgcaaag

SEQ ID NO: 5214 - DNA, 20 bp, Artificial Sequence
  sgRNA
gtaagtacatgcattaacat

SEQ ID NO: 5215 - DNA, 20 bp, Artificial Sequence
  sgRNA
ggccctaggcttgccctggg

SEQ ID NO: 5216 - DNA, 20 bp, Artificial Sequence
  sgRNA
ggtgatcgcgaccggtgccg

SEQ ID NO: 5217 - DNA, 20 bp, Artificial Sequence
  sgRNA
ctctacaaaggcttgtgtta

SEQ ID NO: 5218 - DNA, 20 bp, Artificial Sequence
  sgRNA
ccatggaatcgaaagggtct

SEQ ID NO: 5219 - DNA, 20 bp, Artificial Sequence
  sgRNA
gggagagctacgcacaagcg

SEQ ID NO: 5220 - DNA, 20 bp, Artificial Sequence
  sgRNA
atgctgggctggtatagact

SEQ ID NO: 5221 - DNA, 20 bp, Artificial Sequence
  sgRNA
ttccaccaacactgcattcg

SEQ ID NO: 5222 - DNA, 20 bp, Artificial Sequence
  sgRNA
ctcgagacggcggcgcgcct

SEQ ID NO: 5223 - DNA, 20 bp, Artificial Sequence
  sgRNA
gggtggacggtcagcggagg

SEQ ID NO: 5224 - DNA, 20 bp, Artificial Sequence
  sgRNA
cgggtccgattgtgattgga

SEQ ID NO: 5225 - DNA, 20 bp, Artificial Sequence
  sgRNA
ggatcagcccagatagggcg

SEQ ID NO: 5226 - DNA, 20 bp, Artificial Sequence
  sgRNA
tgcaggacagcatacacccg

SEQ ID NO: 5227 - DNA, 20 bp, Artificial Sequence
  sgRNA
ggtcgctcgggccaacttcc

SEQ ID NO: 5228 - DNA, 20 bp, Artificial Sequence
  sgRNA
atatggtgaatgcggataca

SEQ ID NO: 5229 - DNA, 20 bp, Artificial Sequence
  sgRNA
gagatcgggtctagctctgt

SEQ ID NO: 5230 - DNA, 20 bp, Artificial Sequence
  sgRNA
gccggacactacggagcaag

SEQ ID NO: 5231 - DNA, 20 bp, Artificial Sequence
  sgRNA
tttcagaacgcgcctggccc

SEQ ID NO: 5232 - DNA, 20 bp, Artificial Sequence
  sgRNA
aaggcgggatgcaaagcact

SEQ ID NO: 5233 - DNA, 20 bp, Artificial Sequence
  sgRNA
tatggcagatcgcagaagaa

SEQ ID NO: 5234 - DNA, 20 bp, Artificial Sequence
  sgRNA
tggcttcttcgtacggccat

SEQ ID NO: 5235 - DNA, 20 bp, Artificial Sequence
  sgRNA
aggctgataggacctatctg

SEQ ID NO: 5236 - DNA, 20 bp, Artificial Sequence
  sgRNA
ctgtgtgccggccgccaccg

SEQ ID NO: 5237 - DNA, 20 bp, Artificial Sequence
  sgRNA
atggatgattgggctaaact

SEQ ID NO: 5238 - DNA, 20 bp, Artificial Sequence
  sgRNA
ggagcaggagcacctgctgg

SEQ ID NO: 5239 - DNA, 20 bp, Artificial Sequence
  sgRNA
ggaggcgtgcgcttcgcaaa

SEQ ID NO: 5240 - DNA, 20 bp, Artificial Sequence
  sgRNA
aagctctctaggaagctcgg

SEQ ID NO: 5241 - DNA, 20 bp, Artificial Sequence
  sgRNA
ggaatgtgcttaattcattc

SEQ ID NO: 5242 - DNA, 20 bp, Artificial Sequence
  sgRNA
caagggaatcgctggctctc

SEQ ID NO: 5243 - DNA, 20 bp, Artificial Sequence
  sgRNA
cccaccactttgatctgctt

SEQ ID NO: 5244 - DNA, 20 bp, Artificial Sequence
  sgRNA
cctccgctccttggctcacg

SEQ ID NO: 5245 - DNA, 20 bp, Artificial Sequence
  sgRNA
gtcaccaaaccggtggccgg

SEQ ID NO: 5246 - DNA, 20 bp, Artificial Sequence
  sgRNA
ggatgtacgtgcaaagatat

SEQ ID NO: 5247 - DNA, 20 bp, Artificial Sequence
  sgRNA
gtccatttattcacttccgt

SEQ ID NO: 5248 - DNA, 20 bp, Artificial Sequence
  sgRNA
gccgctgtcgtgaggcatgc

SEQ ID NO: 5249 - DNA, 20 bp, Artificial Sequence
  sgRNA
tgcaaagagcaggagagacg

SEQ ID NO: 5250 - DNA, 20 bp, Artificial Sequence
  sgRNA
cggattccgtgacgccagcc

SEQ ID NO: 5251 - DNA, 20 bp, Artificial Sequence
  sgRNA
tgttaagtgccgtggcagta

SEQ ID NO: 5252 - DNA, 20 bp, Artificial Sequence
  sgRNA
gaagctgtcagagcatttga

SEQ ID NO: 5253 - DNA, 20 bp, Artificial Sequence
  sgRNA
agtgtccattggtcaattgt

SEQ ID NO: 5254 - DNA, 20 bp, Artificial Sequence
  sgRNA
ggaggaagtgctggtgcccg

SEQ ID NO: 5255 - DNA, 20 bp, Artificial Sequence
  sgRNA
cgttgggtcggtttgtcctc

SEQ ID NO: 5256 - DNA, 20 bp, Artificial Sequence
  sgRNA
tgggcgctgtgcgctgcgcg

SEQ ID NO: 5257 - DNA, 20 bp, Artificial Sequence
  sgRNA
tttacagtgtaaggattcat

SEQ ID NO: 5258 - DNA, 20 bp, Artificial Sequence
  sgRNA
cactgagtggcacagccttc

SEQ ID NO: 5259 - DNA, 20 bp, Artificial Sequence
  sgRNA
tcgggcagctcacctgtaaa

SEQ ID NO: 5260 - DNA, 20 bp, Artificial Sequence
  sgRNA
gcatgtgggtgtacaccgct

SEQ ID NO: 5261 - DNA, 20 bp, Artificial Sequence
  sgRNA
tgacaggtatgggtcagacc

SEQ ID NO: 5262 - DNA, 20 bp, Artificial Sequence
  sgRNA
gtacatctgccgcacctacc

SEQ ID NO: 5263 - DNA, 20 bp, Artificial Sequence
  sgRNA
atccatgtctaggattactg

SEQ ID NO: 5264 - DNA, 20 bp, Artificial Sequence
  sgRNA
agcgcccgccagcgggagcc

SEQ ID NO: 5265 - DNA, 20 bp, Artificial Sequence
  sgRNA
gcccggagcggaccctatgc

SEQ ID NO: 5266 - DNA, 20 bp, Artificial Sequence
  sgRNA
acttactcaagtgacaattt

SEQ ID NO: 5267 - DNA, 20 bp, Artificial Sequence
  sgRNA
tccatcaggagtagatgatc

SEQ ID NO: 5268 - DNA, 20 bp, Artificial Sequence
  sgRNA
tttccgcaacctccgaaacc

SEQ ID NO: 5269 - DNA, 20 bp, Artificial Sequence
  sgRNA
cccggcggagcagccgactc

SEQ ID NO: 5270 - DNA, 20 bp, Artificial Sequence
  sgRNA
tgagagacggcttcagccaa

SEQ ID NO: 5271 - DNA, 20 bp, Artificial Sequence
  sgRNA
ctgaaagagagataaagctg

SEQ ID NO: 5272 - DNA, 20 bp, Artificial Sequence
  sgRNA
cccgccactcagtgtgtggc

SEQ ID NO: 5273 - DNA, 20 bp, Artificial Sequence
  sgRNA
aggtcttagaactggcaggt

SEQ ID NO: 5274 - DNA, 20 bp, Artificial Sequence
  sgRNA
acggcttccgggttggcggg

SEQ ID NO: 5275 - DNA, 20 bp, Artificial Sequence
  sgRNA
cccgcgctcgctcgacccac

SEQ ID NO: 5276 - DNA, 20 bp, Artificial Sequence
  sgRNA
ttcttcgaattcgttcttcg

SEQ ID NO: 5277 - DNA, 20 bp, Artificial Sequence
  sgRNA
tgtgctccaatcagatacta

SEQ ID NO: 5278 - DNA, 20 bp, Artificial Sequence
  sgRNA
gtacatcacagtagccgatg

SEQ ID NO: 5279 - DNA, 20 bp, Artificial Sequence
  sgRNA
ctagttcttaggcagatgga

SEQ ID NO: 5280 - DNA, 20 bp, Artificial Sequence
  sgRNA
cggcttccctgcttcttacc

SEQ ID NO: 5281 - DNA, 20 bp, Artificial Sequence
  sgRNA
ccgaaacgccggcttctctt

SEQ ID NO: 5282 - DNA, 20 bp, Artificial Sequence
  sgRNA
gtggtgggaacaaagggagg

SEQ ID NO: 5283 - DNA, 20 bp, Artificial Sequence
  sgRNA
ggacaagaacacaaacgcac

SEQ ID NO: 5284 - DNA, 20 bp, Artificial Sequence
  sgRNA
tgccggagccaaggagcttg

SEQ ID NO: 5285 - DNA, 20 bp, Artificial Sequence
  sgRNA
gggtttccgaatccgggtct

SEQ ID NO: 5286 - DNA, 20 bp, Artificial Sequence
  sgRNA
tcagggctgggtctgtgttg

SEQ ID NO: 5287 - DNA, 20 bp, Artificial Sequence
  sgRNA
ccctccatcatcaacgcggg

SEQ ID NO: 5288 - DNA, 20 bp, Artificial Sequence
  sgRNA
ccggcctgacgcgcgcaccg

SEQ ID NO: 5289 - DNA, 20 bp, Artificial Sequence
  sgRNA
aagccacagctacctcacaa

SEQ ID NO: 5290 - DNA, 20 bp, Artificial Sequence
  sgRNA
aggcgtgacttcgacttctc

SEQ ID NO: 5291 - DNA, 20 bp, Artificial Sequence
  sgRNA
tccttcccggtcacgtgcgc

SEQ ID NO: 5292 - DNA, 20 bp, Artificial Sequence
  sgRNA
gcggccgttgccctggcgag

SEQ ID NO: 5293 - DNA, 20 bp, Artificial Sequence
  sgRNA
gaatgaaatgtaaatgggcc

SEQ ID NO: 5294 - DNA, 20 bp, Artificial Sequence
  sgRNA
ggagcatccgcgcgcgagcc

SEQ ID NO: 5295 - DNA, 20 bp, Artificial Sequence
  sgRNA
cccatgcctgcaccaatggg

SEQ ID NO: 5296 - DNA, 20 bp, Artificial Sequence
  sgRNA
tcttgaacagctgcgggcgc

SEQ ID NO: 5297 - DNA, 20 bp, Artificial Sequence
  sgRNA
acggttcaccggagcggccg

SEQ ID NO: 5298 - DNA, 20 bp, Artificial Sequence
  sgRNA
gagctaaggaggaaaggtgc

SEQ ID NO: 5299 - DNA, 20 bp, Artificial Sequence
  sgRNA
cggcctgagcttgcgctagg

SEQ ID NO: 5300 - DNA, 20 bp, Artificial Sequence
  sgRNA
ttggtgctggctgcgggttt

SEQ ID NO: 5301 - DNA, 20 bp, Artificial Sequence
  sgRNA
ggaaatgggcgggccacagc

SEQ ID NO: 5302 - DNA, 20 bp, Artificial Sequence
  sgRNA
aaacaacagaattcttggtg

SEQ ID NO: 5303 - DNA, 20 bp, Artificial Sequence
  sgRNA
ctgacgcgcgggctgacgtg

SEQ ID NO: 5304 - DNA, 20 bp, Artificial Sequence
  sgRNA
cggtgtcggcggaacaggtg

SEQ ID NO: 5305 - DNA, 20 bp, Artificial Sequence
  sgRNA
cactctcctaatctttgtct

SEQ ID NO: 5306 - DNA, 20 bp, Artificial Sequence
  sgRNA
ctgagaccaccacagagcta

SEQ ID NO: 5307 - DNA, 20 bp, Artificial Sequence
  sgRNA
catttactcattccgtcacc

SEQ ID NO: 5308 - DNA, 20 bp, Artificial Sequence
  sgRNA
ggtggcggtggctgccgcaa

SEQ ID NO: 5309 - DNA, 20 bp, Artificial Sequence
  sgRNA
ttctgaaagacgtgaaataa

SEQ ID NO: 5310 - DNA, 20 bp, Artificial Sequence
  sgRNA
acaagcaggtgtttgattcc

SEQ ID NO: 5311 - DNA, 20 bp, Artificial Sequence
  sgRNA
cgctgccgttcattggctcc

SEQ ID NO: 5312 - DNA, 20 bp, Artificial Sequence
  sgRNA
atcttgtatccatagtgcca

SEQ ID NO: 5313 - DNA, 20 bp, Artificial Sequence
  sgRNA
cccgcaggctcacctggctg

SEQ ID NO: 5314 - DNA, 20 bp, Artificial Sequence
  sgRNA
aatggtcattaataatgcag

SEQ ID NO: 5315 - DNA, 20 bp, Artificial Sequence
  sgRNA
tgatatatgggcggtttgga

SEQ ID NO: 5316 - DNA, 20 bp, Artificial Sequence
  sgRNA
actctaaagctgtcttcact

SEQ ID NO: 5317 - DNA, 20 bp, Artificial Sequence
  sgRNA
ctgcctgggtcttagagatc

SEQ ID NO: 5318 - DNA, 20 bp, Artificial Sequence
  sgRNA
tgagggtttgcaccaatccg

SEQ ID NO: 5319 - DNA, 20 bp, Artificial Sequence
  sgRNA
tgacgtagggatcacgtgac

SEQ ID NO: 5320 - DNA, 20 bp, Artificial Sequence
  sgRNA
ggaattgtagtccgggccag

SEQ ID NO: 5321 - DNA, 20 bp, Artificial Sequence
  sgRNA
cagtattcctgatgcagtaa

SEQ ID NO: 5322 - DNA, 20 bp, Artificial Sequence
  sgRNA
caatgctccgctcgagggcg

SEQ ID NO: 5323 - DNA, 20 bp, Artificial Sequence
  sgRNA
tactcttagtgccgcagccg

SEQ ID NO: 5324 - DNA, 20 bp, Artificial Sequence
  sgRNA
gcgtggcgagggagagggcg

SEQ ID NO: 5325 - DNA, 20 bp, Artificial Sequence
  sgRNA
tttctgctgctgcgcgaccc

SEQ ID NO: 5326 - DNA, 20 bp, Artificial Sequence
  sgRNA
aaagaaagcctctcccgggc

SEQ ID NO: 5327 - DNA, 20 bp, Artificial Sequence
  sgRNA
gggccggaacgcaccgccat

SEQ ID NO: 5328 - DNA, 20 bp, Artificial Sequence
  sgRNA
gatgattcaggaagctgcct

SEQ ID NO: 5329 - DNA, 20 bp, Artificial Sequence
  sgRNA
ggccctctggtggtagcacc

SEQ ID NO: 5330 - DNA, 20 bp, Artificial Sequence
  sgRNA
gtggccgaggcggagcgccc

SEQ ID NO: 5331 - DNA, 20 bp, Artificial Sequence
  sgRNA
tctgttggcgtccttcctgt

SEQ ID NO: 5332 - DNA, 20 bp, Artificial Sequence
  sgRNA
cgtagcttctgctatgtggc

SEQ ID NO: 5333 - DNA, 20 bp, Artificial Sequence
  sgRNA
gtgtgcttgaaatggctttg

SEQ ID NO: 5334 - DNA, 20 bp, Artificial Sequence
  sgRNA
gaggttcacgtgatcattgc

SEQ ID NO: 5335 - DNA, 20 bp, Artificial Sequence
  sgRNA
ctagtactgttcaacttgtg

SEQ ID NO: 5336 - DNA, 20 bp, Artificial Sequence
  sgRNA
cgtgatagcccagctgcctg

SEQ ID NO: 5337 - DNA, 20 bp, Artificial Sequence
  sgRNA
gggagcatgttgtgtctttc

SEQ ID NO: 5338 - DNA, 20 bp, Artificial Sequence
  sgRNA
tcaatgggcaccgatgggcg

SEQ ID NO: 5339 - DNA, 20 bp, Artificial Sequence
  sgRNA
agctgtctggagaatctaac

SEQ ID NO: 5340 - DNA, 20 bp, Artificial Sequence
  sgRNA
gatcccgtagctagagaacg

SEQ ID NO: 5341 - DNA, 20 bp, Artificial Sequence
  sgRNA
tgattggcggagcgcgatgc

SEQ ID NO: 5342 - DNA, 20 bp, Artificial Sequence
  sgRNA
gggatgtctataaatgtgcc

SEQ ID NO: 5343 - DNA, 20 bp, Artificial Sequence
  sgRNA
gtcgccgagccgggttgcta

SEQ ID NO: 5344 - DNA, 20 bp, Artificial Sequence
  sgRNA
aaatcccgcgatttgtaccg

SEQ ID NO: 5345 - DNA, 20 bp, Artificial Sequence
  sgRNA
aatgactgtttaatttgggt

SEQ ID NO: 5346 - DNA, 20 bp, Artificial Sequence
  sgRNA
gctcgggaagtgcgggctcc

SEQ ID NO: 5347 - DNA, 20 bp, Artificial Sequence
  sgRNA
acactatcccagagtctccc

SEQ ID NO: 5348 - DNA, 20 bp, Artificial Sequence
  sgRNA
ggtaccaagaagctgacttt

SEQ ID NO: 5349 - DNA, 20 bp, Artificial Sequence
  sgRNA
cactagttacaactcctgca

SEQ ID NO: 5350 - DNA, 20 bp, Artificial Sequence
  sgRNA
gagcaatacagcaggagtcg

SEQ ID NO: 5351 - DNA, 20 bp, Artificial Sequence
  sgRNA
tttgggctcatgaaaggttt

SEQ ID NO: 5352 - DNA, 20 bp, Artificial Sequence
  sgRNA
gagtgatggcaaggaagccc

SEQ ID NO: 5353 - DNA, 20 bp, Artificial Sequence
  sgRNA
cctgaatgtatgaatcccac

SEQ ID NO: 5354 - DNA, 20 bp, Artificial Sequence
  sgRNA
gctcgtatatccaacctcag

SEQ ID NO: 5355 - DNA, 20 bp, Artificial Sequence
  sgRNA
tcaggacagacagttaggca

SEQ ID NO: 5356 - DNA, 20 bp, Artificial Sequence
  sgRNA
gaccctaattcagtagatct

SEQ ID NO: 5357 - DNA, 20 bp, Artificial Sequence
  sgRNA
tgaacaagcacatccgcccg

SEQ ID NO: 5358 - DNA, 20 bp, Artificial Sequence
  sgRNA
agaggcttgtctacatgcct

SEQ ID NO: 5359 - DNA, 20 bp, Artificial Sequence
  sgRNA
ggtgctcttgagtgctggct

SEQ ID NO: 5360 - DNA, 20 bp, Artificial Sequence
  sgRNA
gccacagttagaggaggttg

SEQ ID NO: 5361 - DNA, 20 bp, Artificial Sequence
  sgRNA
gtgttggagagggcccaggg

SEQ ID NO: 5362 - DNA, 20 bp, Artificial Sequence
  sgRNA
gctgctctacacctgccgcg

SEQ ID NO: 5363 - DNA, 20 bp, Artificial Sequence
  sgRNA
tgtcgacgccggtgctcgtg

SEQ ID NO: 5364 - DNA, 20 bp, Artificial Sequence
  sgRNA
gaagacaagaatgtgatgtg

SEQ ID NO: 5365 - DNA, 20 bp, Artificial Sequence
  sgRNA
gacgcgctctgggccagccg

SEQ ID NO: 5366 - DNA, 20 bp, Artificial Sequence
  sgRNA
ggcgtgtctcaacagagaat

SEQ ID NO: 5367 - DNA, 20 bp, Artificial Sequence
  sgRNA
tacaagaatctttctcatgg

SEQ ID NO: 5368 - DNA, 20 bp, Artificial Sequence
  sgRNA
gaccggaaccgtggtgtcct

SEQ ID NO: 5369 - DNA, 20 bp, Artificial Sequence
  sgRNA
gccacccgggatgcgagcac

SEQ ID NO: 5370 - DNA, 20 bp, Artificial Sequence
  sgRNA
ccaggtgaccggcagggctc

SEQ ID NO: 5371 - DNA, 20 bp, Artificial Sequence
  sgRNA
ttaatctgtgagagttaatc

SEQ ID NO: 5372 - DNA, 20 bp, Artificial Sequence
  sgRNA
ttgtacttcgtccagtacaa

SEQ ID NO: 5373 - DNA, 20 bp, Artificial Sequence
  sgRNA
ggaatcacctagaacaggcc

SEQ ID NO: 5374 - DNA, 20 bp, Artificial Sequence
  sgRNA
gggcgttgcttctacgggct

SEQ ID NO: 5375 - DNA, 20 bp, Artificial Sequence
  sgRNA
cccacatctccaccacccgc

SEQ ID NO: 5376 - DNA, 20 bp, Artificial Sequence
  sgRNA
tggcatctcaggttgcagcc

SEQ ID NO: 5377 - DNA, 20 bp, Artificial Sequence
  sgRNA
atctgtcactgaagctgaaa

SEQ ID NO: 5378 - DNA, 20 bp, Artificial Sequence
  sgRNA
ggtgaagcacttggtgcagg

SEQ ID NO: 5379 - DNA, 20 bp, Artificial Sequence
  sgRNA
tccgcccgcatgtctgttgg

SEQ ID NO: 5380 - DNA, 20 bp, Artificial Sequence
  sgRNA
ttattccatggaatctcatt

SEQ ID NO: 5381 - DNA, 20 bp, Artificial Sequence
  sgRNA
gggctaactgccaatcgcaa

SEQ ID NO: 5382 - DNA, 20 bp, Artificial Sequence
  sgRNA
tcccagctactgttagtctg

SEQ ID NO: 5383 - DNA, 20 bp, Artificial Sequence
  sgRNA
tagtgataacacttagaagc

SEQ ID NO: 5384 - DNA, 20 bp, Artificial Sequence
  sgRNA
agggcatcactgaactggcc

SEQ ID NO: 5385 - DNA, 20 bp, Artificial Sequence
  sgRNA
gccggatccaaattccaggg

SEQ ID NO: 5386 - DNA, 20 bp, Artificial Sequence
  sgRNA
agacaacctacagaggctga

SEQ ID NO: 5387 - DNA, 20 bp, Artificial Sequence
  sgRNA
tcagagggcgttcttgaggc

SEQ ID NO: 5388 - DNA, 20 bp, Artificial Sequence
  sgRNA
gcgctgtgtgcgggttgtgc

SEQ ID NO: 5389 - DNA, 20 bp, Artificial Sequence
  sgRNA
ggctttcatcggagcacgct

SEQ ID NO: 5390 - DNA, 20 bp, Artificial Sequence
  sgRNA
aataaactgaaagccctctg

SEQ ID NO: 5391 - DNA, 20 bp, Artificial Sequence
  sgRNA
catatttgtcatttgcctgt

SEQ ID NO: 5392 - DNA, 20 bp, Artificial Sequence
  sgRNA
gccctgggcgagcagcttgg

SEQ ID NO: 5393 - DNA, 20 bp, Artificial Sequence
  sgRNA
ccgcatctgcctataactga

SEQ ID NO: 5394 - DNA, 20 bp, Artificial Sequence
  sgRNA
cctgggtttggcatctctcg

SEQ ID NO: 5395 - DNA, 20 bp, Artificial Sequence
  sgRNA
gtcagaaccgcgttccctca

SEQ ID NO: 5396 - DNA, 20 bp, Artificial Sequence
  sgRNA
tataggcaccaacgagtagc

SEQ ID NO: 5397 - DNA, 20 bp, Artificial Sequence
  sgRNA
ttgcggagaatccatactcc

SEQ ID NO: 5398 - DNA, 20 bp, Artificial Sequence
  sgRNA
tgctatggtcaccagatacc

SEQ ID NO: 5399 - DNA, 20 bp, Artificial Sequence
  sgRNA
gcatgatggtgttaaattac

SEQ ID NO: 5400 - DNA, 20 bp, Artificial Sequence
  sgRNA
gggacgccacctccggaggt

SEQ ID NO: 5401 - DNA, 20 bp, Artificial Sequence
  sgRNA
cagcaagtagctgacaggaa

SEQ ID NO: 5402 - DNA, 20 bp, Artificial Sequence
  sgRNA
cgtgtggaatatttcacaac

SEQ ID NO: 5403 - DNA, 20 bp, Artificial Sequence
  sgRNA
ggtcccttagttagagcaag

SEQ ID NO: 5404 - DNA, 20 bp, Artificial Sequence
  sgRNA
gcgcgctccgagacgcagag

SEQ ID NO: 5405 - DNA, 20 bp, Artificial Sequence
  sgRNA
tgtagaaagctcccgtgtgg

SEQ ID NO: 5406 - DNA, 20 bp, Artificial Sequence
  sgRNA
ctgagatattgttcagattg

SEQ ID NO: 5407 - DNA, 20 bp, Artificial Sequence
  sgRNA
cctccctttccctctggctc

SEQ ID NO: 5408 - DNA, 20 bp, Artificial Sequence
  sgRNA
tacttacctttgcaactgcc

SEQ ID NO: 5409 - DNA, 20 bp, Artificial Sequence
  sgRNA
acaggcagtggttgaaattc

SEQ ID NO: 5410 - DNA, 20 bp, Artificial Sequence
  sgRNA
ttcgggaagcaggtatggca

SEQ ID NO: 5411 - DNA, 20 bp, Artificial Sequence
  sgRNA
ccagagcccttcagcaccat

SEQ ID NO: 5412 - DNA, 20 bp, Artificial Sequence
  sgRNA
ggcactaaatatagacttca

SEQ ID NO: 5413 - DNA, 20 bp, Artificial Sequence
  sgRNA
tcgttcagtaaattgctctt

SEQ ID NO: 5414 - DNA, 20 bp, Artificial Sequence
  sgRNA
aggcggtgcttgggccttgg

SEQ ID NO: 5415 - DNA, 20 bp, Artificial Sequence
  sgRNA
gtacctcaggtttcctgcag

SEQ ID NO: 5416 - DNA, 20 bp, Artificial Sequence
  sgRNA
aattgctaacaggcttcctt

SEQ ID NO: 5417 - DNA, 20 bp, Artificial Sequence
  sgRNA
taggagccctggaagtcgcg

SEQ ID NO: 5418 - DNA, 20 bp, Artificial Sequence
  sgRNA
agggaaggagcgaggctaag

SEQ ID NO: 5419 - DNA, 20 bp, Artificial Sequence
  sgRNA
gcagctctccgcaggcacgc

SEQ ID NO: 5420 - DNA, 20 bp, Artificial Sequence
  sgRNA
acctaccgggtgcacttcac

SEQ ID NO: 5421 - DNA, 20 bp, Artificial Sequence
  sgRNA
tcagacaagaaatccagttc

SEQ ID NO: 5422 - DNA, 20 bp, Artificial Sequence
  sgRNA
gggaggaccaatctggaaga

SEQ ID NO: 5423 - DNA, 20 bp, Artificial Sequence
  sgRNA
ggagtctgagccgcggaacc

SEQ ID NO: 5424 - DNA, 20 bp, Artificial Sequence
  sgRNA
acctgagactgtattaatta

SEQ ID NO: 5425 - DNA, 20 bp, Artificial Sequence
  sgRNA
gcgtattcttgtgggatggc

SEQ ID NO: 5426 - DNA, 20 bp, Artificial Sequence
  sgRNA
gggctacaggttagggcgac

SEQ ID NO: 5427 - DNA, 20 bp, Artificial Sequence
  sgRNA
gttcacatttcaaacagagc

SEQ ID NO: 5428 - DNA, 20 bp, Artificial Sequence
  sgRNA
cgggacttccatgcgcgcct

SEQ ID NO: 5429 - DNA, 20 bp, Artificial Sequence
  sgRNA
gttcggcaagaatcctcacg

SEQ ID NO: 5430 - DNA, 20 bp, Artificial Sequence
  sgRNA
ccaactgattaactctgccg

SEQ ID NO: 5431 - DNA, 20 bp, Artificial Sequence
  sgRNA
ctggacattctattgtctcc

SEQ ID NO: 5432 - DNA, 20 bp, Artificial Sequence
  sgRNA
gggtctgtctacacgggctc

SEQ ID NO: 5433 - DNA, 20 bp, Artificial Sequence
  sgRNA
accctattgatttcttcttc

SEQ ID NO: 5434 - DNA, 20 bp, Artificial Sequence
  sgRNA
gtctgttaattgcatcactt

SEQ ID NO: 5435 - DNA, 20 bp, Artificial Sequence
  sgRNA
ggtggagatggagataagga

SEQ ID NO: 5436 - DNA, 20 bp, Artificial Sequence
  sgRNA
gtacgcgactgtcctccttg

SEQ ID NO: 5437 - DNA, 20 bp, Artificial Sequence
  sgRNA
acacttggtgaggaggtaaa

SEQ ID NO: 5438 - DNA, 20 bp, Artificial Sequence
  sgRNA
tggaagttcatttagactgc

SEQ ID NO: 5439 - DNA, 20 bp, Artificial Sequence
  sgRNA
agagagaaatggagagggag

SEQ ID NO: 5440 - DNA, 20 bp, Artificial Sequence
  sgRNA
actgtgaagctgagggaact

SEQ ID NO: 5441 - DNA, 20 bp, Artificial Sequence
  sgRNA
gagcccatcctcagctaaga

SEQ ID NO: 5442 - DNA, 20 bp, Artificial Sequence
  sgRNA
ataaagggtcatacaggtag

SEQ ID NO: 5443 - DNA, 20 bp, Artificial Sequence
  sgRNA
ggagggtgaagtgatgtgac

SEQ ID NO: 5444 - DNA, 20 bp, Artificial Sequence
  sgRNA
gggcgctaaccagtccttga

SEQ ID NO: 5445 - DNA, 20 bp, Artificial Sequence
  sgRNA
cgaatgcttatgtgagctct

SEQ ID NO: 5446 - DNA, 20 bp, Artificial Sequence
  sgRNA
ttgatgaatcacgtgtgtcg

SEQ ID NO: 5447 - DNA, 20 bp, Artificial Sequence
  sgRNA
tggtaaggtctaggaggctt

SEQ ID NO: 5448 - DNA, 20 bp, Artificial Sequence
  sgRNA
ccgcggccagcgccagagtt

SEQ ID NO: 5449 - DNA, 20 bp, Artificial Sequence
  sgRNA
gggcgcgggcggaggctcgg

SEQ ID NO: 5450 - DNA, 20 bp, Artificial Sequence
  sgRNA
agatgacggctctcatatgg

SEQ ID NO: 5451 - DNA, 20 bp, Artificial Sequence
  sgRNA
caggcactggtgccaagcga

SEQ ID NO: 5452 - DNA, 20 bp, Artificial Sequence
  sgRNA
gaagcgttatcatgtgaggc

SEQ ID NO: 5453 - DNA, 20 bp, Artificial Sequence
  sgRNA
cctacacaggcgtctctgat

SEQ ID NO: 5454 - DNA, 20 bp, Artificial Sequence
  sgRNA
aaacttacaaaccttccgat

SEQ ID NO: 5455 - DNA, 20 bp, Artificial Sequence
  sgRNA
tggtccggcagactattcca

SEQ ID NO: 5456 - DNA, 20 bp, Artificial Sequence
  sgRNA
attccgctctactccgggag

SEQ ID NO: 5457 - DNA, 20 bp, Artificial Sequence
  sgRNA
aggagacggagggtgggacc

SEQ ID NO: 5458 - DNA, 20 bp, Artificial Sequence
  sgRNA
agggagttaccagcgagtcg

SEQ ID NO: 5459 - DNA, 20 bp, Artificial Sequence
  sgRNA
gccctggaattcgagaagcc

SEQ ID NO: 5460 - DNA, 20 bp, Artificial Sequence
  sgRNA
gagcccagagtcagtttaaa

SEQ ID NO: 5461 - DNA, 20 bp, Artificial Sequence
  sgRNA
aggagagtgtaatcttactc

SEQ ID NO: 5462 - DNA, 20 bp, Artificial Sequence
  sgRNA
accagagcaggctgaacttg

SEQ ID NO: 5463 - DNA, 20 bp, Artificial Sequence
  sgRNA
ttggattcgcgcgccggccc

SEQ ID NO: 5464 - DNA, 20 bp, Artificial Sequence
  sgRNA
cgttcaagcgaagctgcagc

SEQ ID NO: 5465 - DNA, 20 bp, Artificial Sequence
  sgRNA
ataaaccagtttacccggca

SEQ ID NO: 5466 - DNA, 20 bp, Artificial Sequence
  sgRNA
attggtcggtgttggcgcga

SEQ ID NO: 5467 - DNA, 20 bp, Artificial Sequence
  sgRNA
tccctttaaggtctccagct

SEQ ID NO: 5468 - DNA, 20 bp, Artificial Sequence
  sgRNA
cagggatgtgtttactaagc

SEQ ID NO: 5469 - DNA, 20 bp, Artificial Sequence
  sgRNA
tatgtatgagctccctccct

SEQ ID NO: 5470 - DNA, 20 bp, Artificial Sequence
  sgRNA
agaagtggtcgggacattta

SEQ ID NO: 5471 - DNA, 20 bp, Artificial Sequence
  sgRNA
ggtcactaccaagtttggtt

SEQ ID NO: 5472 - DNA, 20 bp, Artificial Sequence
  sgRNA
gcctgtcacctagtagattc

SEQ ID NO: 5473 - DNA, 20 bp, Artificial Sequence
  sgRNA
gggtccagcgagcctgaccg

SEQ ID NO: 5474 - DNA, 20 bp, Artificial Sequence
  sgRNA
aacgagctatgctaaagtga

SEQ ID NO: 5475 - DNA, 20 bp, Artificial Sequence
  sgRNA
aaacggattagtgggcatct

SEQ ID NO: 5476 - DNA, 20 bp, Artificial Sequence
  sgRNA
caaagctgatgcaagactct

SEQ ID NO: 5477 - DNA, 20 bp, Artificial Sequence
  sgRNA
ccagaggctgcacaagatcc

SEQ ID NO: 5478 - DNA, 20 bp, Artificial Sequence
  sgRNA
cgccgcagctccggccatag

SEQ ID NO: 5479 - DNA, 20 bp, Artificial Sequence
  sgRNA
cccggtagtgctccattctc

SEQ ID NO: 5480 - DNA, 20 bp, Artificial Sequence
  sgRNA
ctggcatgtccacaatagtg

SEQ ID NO: 5481 - DNA, 20 bp, Artificial Sequence
  sgRNA
catcctaacctcatgcaagg

SEQ ID NO: 5482 - DNA, 20 bp, Artificial Sequence
  sgRNA
gcagaccgtgaagggaggcg

SEQ ID NO: 5483 - DNA, 20 bp, Artificial Sequence
  sgRNA
atggacattgaggctctaag

SEQ ID NO: 5484 - DNA, 20 bp, Artificial Sequence
  sgRNA
agccaactccagtccacgac

SEQ ID NO: 5485 - DNA, 20 bp, Artificial Sequence
  sgRNA
tgagatgcagttagacttac

SEQ ID NO: 5486 - DNA, 20 bp, Artificial Sequence
  sgRNA
tcagcagcccaggagcctag

SEQ ID NO: 5487 - DNA, 20 bp, Artificial Sequence
  sgRNA
acgaaacttcaagtaccaaa

SEQ ID NO: 5488 - DNA, 20 bp, Artificial Sequence
  sgRNA
ggtctcacaatcgcgtggcc

SEQ ID NO: 5489 - DNA, 20 bp, Artificial Sequence
  sgRNA
gattgggtatgaccttcagt

SEQ ID NO: 5490 - DNA, 20 bp, Artificial Sequence
  sgRNA
ggagggaccaccgattgatg

SEQ ID NO: 5491 - DNA, 20 bp, Artificial Sequence
  sgRNA
taagcgacgttcctagttca

SEQ ID NO: 5492 - DNA, 20 bp, Artificial Sequence
  sgRNA
tacagtcgtgggtggaccag

SEQ ID NO: 5493 - DNA, 20 bp, Artificial Sequence
  sgRNA
ttggctgatgtacgggcgtg

SEQ ID NO: 5494 - DNA, 20 bp, Artificial Sequence
  sgRNA
ctctaggcagaggacagcga

SEQ ID NO: 5495 - DNA, 20 bp, Artificial Sequence
  sgRNA
caagtgtccgagtggcgcgg

SEQ ID NO: 5496 - DNA, 20 bp, Artificial Sequence
  sgRNA
gaggaaaggtcacttgtgac

SEQ ID NO: 5497 - DNA, 20 bp, Artificial Sequence
  sgRNA
tagatgtcggagagtgtgcc

SEQ ID NO: 5498 - DNA, 20 bp, Artificial Sequence
  sgRNA
aatactgtttaactaaggtg

SEQ ID NO: 5499 - DNA, 20 bp, Artificial Sequence
  sgRNA
cccaaagtccagtgcaataa

SEQ ID NO: 5500 - DNA, 20 bp, Artificial Sequence
  sgRNA
tctgatccattctgcgcagc

SEQ ID NO: 5501 - DNA, 20 bp, Artificial Sequence
  sgRNA
gatgagggcggagctaagtg

SEQ ID NO: 5502 - DNA, 20 bp, Artificial Sequence
  sgRNA
ccgctgggctgcgcgctgat

SEQ ID NO: 5503 - DNA, 20 bp, Artificial Sequence
  sgRNA
tgcctaactcttggcccacg

SEQ ID NO: 5504 - DNA, 20 bp, Artificial Sequence
  sgRNA
aaactgccgagctttcccga

SEQ ID NO: 5505 - DNA, 20 bp, Artificial Sequence
  sgRNA
gccggctgttaagactcctg

SEQ ID NO: 5506 - DNA, 20 bp, Artificial Sequence
  sgRNA
agtggtgggcggagtcatcg

SEQ ID NO: 5507 - DNA, 20 bp, Artificial Sequence
  sgRNA
ttatcaccatttacaagacc

SEQ ID NO: 5508 - DNA, 20 bp, Artificial Sequence
  sgRNA
caatatcagcagggcccaga

SEQ ID NO: 5509 - DNA, 20 bp, Artificial Sequence
  sgRNA
caccggctgtcagtcaacca

SEQ ID NO: 5510 - DNA, 20 bp, Artificial Sequence
  sgRNA
agattgctttccagcgagcc

SEQ ID NO: 5511 - DNA, 20 bp, Artificial Sequence
  sgRNA
tgcgccgatgctccaaggcc

SEQ ID NO: 5512 - DNA, 20 bp, Artificial Sequence
  sgRNA
gtgcatgtatgcatgcatgt

SEQ ID NO: 5513 - DNA, 20 bp, Artificial Sequence
  sgRNA
cccttcggccaccgtcggag

SEQ ID NO: 5514 - DNA, 20 bp, Artificial Sequence
  sgRNA
actccaaactcgcgcctagc

SEQ ID NO: 5515 - DNA, 20 bp, Artificial Sequence
  sgRNA
actgcctgccagtcccaagc

SEQ ID NO: 5516 - DNA, 20 bp, Artificial Sequence
  sgRNA
aaggacccggcacgcggcaa

SEQ ID NO: 5517 - DNA, 20 bp, Artificial Sequence
  sgRNA
ggctaaaggtgtcagggtat

SEQ ID NO: 5518 - DNA, 20 bp, Artificial Sequence
  sgRNA
gggtcccacgggcgggcgcg

SEQ ID NO: 5519 - DNA, 20 bp, Artificial Sequence
  sgRNA
caatctagggaaggcgggcc

SEQ ID NO: 5520 - DNA, 20 bp, Artificial Sequence
  sgRNA
ctctggttgagagtgccttg

SEQ ID NO: 5521 - DNA, 20 bp, Artificial Sequence
  sgRNA
cgcagatgccgccgagtcgg

SEQ ID NO: 5522 - DNA, 20 bp, Artificial Sequence
  sgRNA
tggagcagccctggtggtac

SEQ ID NO: 5523 - DNA, 20 bp, Artificial Sequence
  sgRNA
atgcaactgtacgcccagag

SEQ ID NO: 5524 - DNA, 20 bp, Artificial Sequence
  sgRNA
atctgatactgtttctttag

SEQ ID NO: 5525 - DNA, 20 bp, Artificial Sequence
  sgRNA
ctttcggccacgcctgattc

SEQ ID NO: 5526 - DNA, 20 bp, Artificial Sequence
  sgRNA
gaacagggaaccctagaacc

SEQ ID NO: 5527 - DNA, 20 bp, Artificial Sequence
  sgRNA
gaggcacctgcctcgctaat

SEQ ID NO: 5528 - DNA, 20 bp, Artificial Sequence
  sgRNA
cgctggactcctcagtctcc

SEQ ID NO: 5529 - DNA, 20 bp, Artificial Sequence
  sgRNA
gcgttgctttagttgatatg

SEQ ID NO: 5530 - DNA, 20 bp, Artificial Sequence
  sgRNA
tgtgtctgccagcgtgcagc

SEQ ID NO: 5531 - DNA, 20 bp, Artificial Sequence
  sgRNA
aatactagataaagtcactg

SEQ ID NO: 5532 - DNA, 20 bp, Artificial Sequence
  sgRNA
ggcgggcctaagcagggtag

SEQ ID NO: 5533 - DNA, 20 bp, Artificial Sequence
  sgRNA
tgaggttccggcttctttaa

SEQ ID NO: 5534 - DNA, 20 bp, Artificial Sequence
  sgRNA
ggatcaatatcactcacatg

SEQ ID NO: 5535 - DNA, 20 bp, Artificial Sequence
  sgRNA
gtttatttacttccggcttg

SEQ ID NO: 5536 - DNA, 20 bp, Artificial Sequence
  sgRNA
ctgtgctttctgaatcttgt

SEQ ID NO: 5537 - DNA, 20 bp, Artificial Sequence
  sgRNA
tccgccgtgactttcgcccg

SEQ ID NO: 5538 - DNA, 20 bp, Artificial Sequence
  sgRNA
tgcaccaaatctctcgagtt

SEQ ID NO: 5539 - DNA, 20 bp, Artificial Sequence
  sgRNA
gccgggactcgagggtcgcc

SEQ ID NO: 5540 - DNA, 20 bp, Artificial Sequence
  sgRNA
agagatttggtttgttaaag

SEQ ID NO: 5541 - DNA, 20 bp, Artificial Sequence
  sgRNA
acagtgtttactaagcacat

SEQ ID NO: 5542 - DNA, 20 bp, Artificial Sequence
  sgRNA
tcttacccgagtactccagg

SEQ ID NO: 5543 - DNA, 20 bp, Artificial Sequence
  sgRNA
agcaggttagtgggcgccac

SEQ ID NO: 5544 - DNA, 20 bp, Artificial Sequence
  sgRNA
tgggaagctaagaccagaag

SEQ ID NO: 5545 - DNA, 20 bp, Artificial Sequence
  sgRNA
ctttacatatgcagtcccac

SEQ ID NO: 5546 - DNA, 20 bp, Artificial Sequence
  sgRNA
ctggcagcccgcgcgaggtg

SEQ ID NO: 5547 - DNA, 20 bp, Artificial Sequence
  sgRNA
aaacagctacaaggcttgct

SEQ ID NO: 5548 - DNA, 20 bp, Artificial Sequence
  sgRNA
ggcggttcccgtgctctgat

SEQ ID NO: 5549 - DNA, 20 bp, Artificial Sequence
  sgRNA
tatcccaccattccctctag

SEQ ID NO: 5550 - DNA, 20 bp, Artificial Sequence
  sgRNA
ggtctgacgtcagccatgtg

SEQ ID NO: 5551 - DNA, 20 bp, Artificial Sequence
  sgRNA
gtactgctccctaagctcta

SEQ ID NO: 5552 - DNA, 20 bp, Artificial Sequence
  sgRNA
tttctgacttcctgtcagag

SEQ ID NO: 5553 - DNA, 20 bp, Artificial Sequence
  sgRNA
ccctccatctgtgaagatgg

SEQ ID NO: 5554 - DNA, 20 bp, Artificial Sequence
  sgRNA
gaataaacacagaaagaatc

SEQ ID NO: 5555 - DNA, 20 bp, Artificial Sequence
  sgRNA
gggtgaaccaaaccagtttg

SEQ ID NO: 5556 - DNA, 20 bp, Artificial Sequence
  sgRNA
ggcgggtctgtaaccggaaa

SEQ ID NO: 5557 - DNA, 20 bp, Artificial Sequence
  sgRNA
tgttgctggttgtatggagt

SEQ ID NO: 5558 - DNA, 20 bp, Artificial Sequence
  sgRNA
ggaggcgacctcggactctg

SEQ ID NO: 5559 - DNA, 20 bp, Artificial Sequence
  sgRNA
actcaactttgagtgacttc

SEQ ID NO: 5560 - DNA, 20 bp, Artificial Sequence
  sgRNA
cgggaatgccgcgccgtggg

SEQ ID NO: 5561 - DNA, 20 bp, Artificial Sequence
  sgRNA
tattcacacagagtgcaggg

SEQ ID NO: 5562 - DNA, 20 bp, Artificial Sequence
  sgRNA
aaacagtctcattcacagga

SEQ ID NO: 5563 - DNA, 20 bp, Artificial Sequence
  sgRNA
ctttgtctggttctgttgtg

SEQ ID NO: 5564 - DNA, 20 bp, Artificial Sequence
  sgRNA
tcttctctcggttaatgtct

SEQ ID NO: 5565 - DNA, 20 bp, Artificial Sequence
  sgRNA
acgcagcgtcagctcctgat

SEQ ID NO: 5566 - DNA, 20 bp, Artificial Sequence
  sgRNA
agcactgcgggcggtcgacc

SEQ ID NO: 5567 - DNA, 20 bp, Artificial Sequence
  sgRNA
atgtgtgagcacagacttcc

SEQ ID NO: 5568 - DNA, 20 bp, Artificial Sequence
  sgRNA
ccgcccaatctcgggtgtcc

SEQ ID NO: 5569 - DNA, 20 bp, Artificial Sequence
  sgRNA
ctgtagggaagagtgggctg

SEQ ID NO: 5570 - DNA, 20 bp, Artificial Sequence
  sgRNA
ccagattggtgttaagagga

SEQ ID NO: 5571 - DNA, 20 bp, Artificial Sequence
  sgRNA
agcttcggaggacaggctgt

SEQ ID NO: 5572 - DNA, 20 bp, Artificial Sequence
  sgRNA
gcagctttggtgtccgggag

SEQ ID NO: 5573 - DNA, 20 bp, Artificial Sequence
  sgRNA
gcggttgcttagcaactaag

SEQ ID NO: 5574 - DNA, 20 bp, Artificial Sequence
  sgRNA
gggcaatgcgggtccagcca

SEQ ID NO: 5575 - DNA, 20 bp, Artificial Sequence
  sgRNA
aaacggcgagagggcgggac

SEQ ID NO: 5576 - DNA, 20 bp, Artificial Sequence
  sgRNA
atcacatttattaagcacag

SEQ ID NO: 5577 - DNA, 20 bp, Artificial Sequence
  sgRNA
actcatagtcagtgtgggtg

SEQ ID NO: 5578 - DNA, 20 bp, Artificial Sequence
  sgRNA
aacgtgttactgccatctac

SEQ ID NO: 5579 - DNA, 20 bp, Artificial Sequence
  sgRNA
tttggatcagatctgtactc

SEQ ID NO: 5580 - DNA, 20 bp, Artificial Sequence
  sgRNA
cccacctccgcgattgcggg

SEQ ID NO: 5581 - DNA, 20 bp, Artificial Sequence
  sgRNA
acctaacaagtgtaaggccc

SEQ ID NO: 5582 - DNA, 20 bp, Artificial Sequence
  sgRNA
gggcgtggcccagcggacca

SEQ ID NO: 5583 - DNA, 20 bp, Artificial Sequence
  sgRNA
aaagccagccttctagatat

SEQ ID NO: 5584 - DNA, 20 bp, Artificial Sequence
  sgRNA
aattaatcaatggaacactc

SEQ ID NO: 5585 - DNA, 20 bp, Artificial Sequence
  sgRNA
ccaagcggaccctattctgg

SEQ ID NO: 5586 - DNA, 20 bp, Artificial Sequence
  sgRNA
gttgcacgagatccgatccg

SEQ ID NO: 5587 - DNA, 20 bp, Artificial Sequence
  sgRNA
ccaggaactcatatattacc

SEQ ID NO: 5588 - DNA, 20 bp, Artificial Sequence
  sgRNA
gtggccacgcctctcctcag

SEQ ID NO: 5589 - DNA, 20 bp, Artificial Sequence
  sgRNA
ttagcatgtgagcgcgaccc

SEQ ID NO: 5590 - DNA, 20 bp, Artificial Sequence
  sgRNA
ctgatggtttggcttctgat

SEQ ID NO: 5591 - DNA, 20 bp, Artificial Sequence
  sgRNA
aataccagatgcagtcacta

SEQ ID NO: 5592 - DNA, 20 bp, Artificial Sequence
  sgRNA
gtgaggcttgaaggccttgc

SEQ ID NO: 5593 - DNA, 20 bp, Artificial Sequence
  sgRNA
gcaggcggtgggtgtagcaa

SEQ ID NO: 5594 - DNA, 20 bp, Artificial Sequence
  sgRNA
cttgcgggtagcagatgctt

SEQ ID NO: 5595 - DNA, 20 bp, Artificial Sequence
  sgRNA
gccgaccagccgctacgaag

SEQ ID NO: 5596 - DNA, 20 bp, Artificial Sequence
  sgRNA
ccgcccatctcacctgtgat

SEQ ID NO: 5597 - DNA, 20 bp, Artificial Sequence
  sgRNA
tttggatgtgggctggcagc

SEQ ID NO: 5598 - DNA, 20 bp, Artificial Sequence
  sgRNA
agatctagcatgccaagcct

SEQ ID NO: 5599 - DNA, 20 bp, Artificial Sequence
  sgRNA
gtggaaagttgctttcgttg

SEQ ID NO: 5600 - DNA, 20 bp, Artificial Sequence
  sgRNA
cacgccctgatcacccgcaa

SEQ ID NO: 5601 - DNA, 20 bp, Artificial Sequence
  sgRNA
tagactcgtcaccttcctga

SEQ ID NO: 5602 - DNA, 20 bp, Artificial Sequence
  sgRNA
gaaggaagcgtacaattggc

SEQ ID NO: 5603 - DNA, 20 bp, Artificial Sequence
  sgRNA
ctcaggtccttgataaagca

SEQ ID NO: 5604 - DNA, 20 bp, Artificial Sequence
  sgRNA
tgtgcaagtgcctatagcga

SEQ ID NO: 5605 - DNA, 20 bp, Artificial Sequence
  sgRNA
cagctgatgtgagctccttc

SEQ ID NO: 5606 - DNA, 20 bp, Artificial Sequence
  sgRNA
gtcagagaccagagcagtgg

SEQ ID NO: 5607 - DNA, 20 bp, Artificial Sequence
  sgRNA
tctgtcctgccctcacatgt

SEQ ID NO: 5608 - DNA, 20 bp, Artificial Sequence
  sgRNA
ctgtgcaactgtagagttgg

SEQ ID NO: 5609 - DNA, 20 bp, Artificial Sequence
  sgRNA
ggattcttaacatttctggt

SEQ ID NO: 5610 - DNA, 20 bp, Artificial Sequence
  sgRNA
cctcgcgcgcatgcgtgaca

SEQ ID NO: 5611 - DNA, 20 bp, Artificial Sequence
  sgRNA
actggagatgtccggatgcg

SEQ ID NO: 5612 - DNA, 20 bp, Artificial Sequence
  sgRNA
gcacttgtgatgtcgaacgt

SEQ ID NO: 5613 - DNA, 20 bp, Artificial Sequence
  sgRNA
ttcttcttgcggtgtcccgg

SEQ ID NO: 5614 - DNA, 20 bp, Artificial Sequence
  sgRNA
aatatttccatccacatgcc

SEQ ID NO: 5615 - DNA, 20 bp, Artificial Sequence
  sgRNA
ccagaactaccatgagcaag

SEQ ID NO: 5616 - DNA, 20 bp, Artificial Sequence
  sgRNA
gggctaactgcatgctaatg

SEQ ID NO: 5617 - DNA, 20 bp, Artificial Sequence
  sgRNA
gcttgcagttcacgtcatca

SEQ ID NO: 5618 - DNA, 20 bp, Artificial Sequence
  sgRNA
gacaaagatctgaacgttat

SEQ ID NO: 5619 - DNA, 20 bp, Artificial Sequence
  sgRNA
tttcctttcccactgcgcgg

SEQ ID NO: 5620 - DNA, 20 bp, Artificial Sequence
  sgRNA
tcagtccatccctcagcggg

SEQ ID NO: 5621 - DNA, 20 bp, Artificial Sequence
  sgRNA
ttccggctcctggcgtacta

SEQ ID NO: 5622 - DNA, 20 bp, Artificial Sequence
  sgRNA
gggaggaagctctatcaagt

SEQ ID NO: 5623 - DNA, 20 bp, Artificial Sequence
  sgRNA
aacgccactagtgagatgca

SEQ ID NO: 5624 - DNA, 20 bp, Artificial Sequence
  sgRNA
caccggcgcttcacccgctg

SEQ ID NO: 5625 - DNA, 20 bp, Artificial Sequence
  sgRNA
ccttgtctctcgcggctgag

SEQ ID NO: 5626 - DNA, 20 bp, Artificial Sequence
  sgRNA
tacgtcagcgtgctgctttc

SEQ ID NO: 5627 - DNA, 20 bp, Artificial Sequence
  sgRNA
gcacatacttatatcctgaa

SEQ ID NO: 5628 - DNA, 20 bp, Artificial Sequence
  sgRNA
gtttggaaggatcactggta

SEQ ID NO: 5629 - DNA, 20 bp, Artificial Sequence
  sgRNA
gatgggagaggacccgactc

SEQ ID NO: 5630 - DNA, 20 bp, Artificial Sequence
  sgRNA
agttgcacaagacatctaca

SEQ ID NO: 5631 - DNA, 20 bp, Artificial Sequence
  sgRNA
tctttctctaaccgaccttc

SEQ ID NO: 5632 - DNA, 20 bp, Artificial Sequence
  sgRNA
tccagggctccctcagctgc

SEQ ID NO: 5633 - DNA, 20 bp, Artificial Sequence
  sgRNA
gatcgcagctgcaagcttgg

SEQ ID NO: 5634 - DNA, 20 bp, Artificial Sequence
  sgRNA
cagatactacatcatcagtc

SEQ ID NO: 5635 - DNA, 20 bp, Artificial Sequence
  sgRNA
ttcaagcaatcgactgacgt

SEQ ID NO: 5636 - DNA, 20 bp, Artificial Sequence
  sgRNA
cgcagaacaatgcaagcttg

SEQ ID NO: 5637 - DNA, 20 bp, Artificial Sequence
  sgRNA
attcgcttccaacagtcaac

SEQ ID NO: 5638 - DNA, 20 bp, Artificial Sequence
  sgRNA
aatcaagagttgggatgagc

SEQ ID NO: 5639 - DNA, 20 bp, Artificial Sequence
  sgRNA
acacagtagcattggcttcc

SEQ ID NO: 5640 - DNA, 20 bp, Artificial Sequence
  sgRNA
acgcgaaaccggataaggac

SEQ ID NO: 5641 - DNA, 20 bp, Artificial Sequence
  sgRNA
tctgacatgtttatggcttc

SEQ ID NO: 5642 - DNA, 20 bp, Artificial Sequence
  sgRNA
agctccacctgcagctcgag

SEQ ID NO: 5643 - DNA, 20 bp, Artificial Sequence
  sgRNA
cggttaccttcccaggtctg

SEQ ID NO: 5644 - DNA, 20 bp, Artificial Sequence
  sgRNA
ggtctgttctcggcgttgag

SEQ ID NO: 5645 - DNA, 20 bp, Artificial Sequence
  sgRNA
acgtccgggccctcagcctt

SEQ ID NO: 5646 - DNA, 20 bp, Artificial Sequence
  sgRNA
agagccgagagagatgcttg

SEQ ID NO: 5647 - DNA, 20 bp, Artificial Sequence
  sgRNA
cagcaaagcgcccagtctct

SEQ ID NO: 5648 - DNA, 20 bp, Artificial Sequence
  sgRNA
cttcaattctctaggtttgc

SEQ ID NO: 5649 - DNA, 20 bp, Artificial Sequence
  sgRNA
ggcgaatccttggctgtgca

SEQ ID NO: 5650 - DNA, 20 bp, Artificial Sequence
  sgRNA
cccgttgtgacctcagcagc

SEQ ID NO: 5651 - DNA, 20 bp, Artificial Sequence
  sgRNA
cagagtctgtagaacaaagg

SEQ ID NO: 5652 - DNA, 20 bp, Artificial Sequence
  sgRNA
gaggagctcgggcagaaccg

SEQ ID NO: 5653 - DNA, 20 bp, Artificial Sequence
  sgRNA
cccgtgtttggctctgggac

SEQ ID NO: 5654 - DNA, 20 bp, Artificial Sequence
  sgRNA
ataaatatcaggaagtcttg

SEQ ID NO: 5655 - DNA, 20 bp, Artificial Sequence
  sgRNA
tctccaccaatgggagggct

SEQ ID NO: 5656 - DNA, 20 bp, Artificial Sequence
  sgRNA
tttgtttaactagccatgat

SEQ ID NO: 5657 - DNA, 20 bp, Artificial Sequence
  sgRNA
agtgtggctgatgtgctcac

SEQ ID NO: 5658 - DNA, 20 bp, Artificial Sequence
  sgRNA
tcctgctcgttggtctgata

SEQ ID NO: 5659 - DNA, 20 bp, Artificial Sequence
  sgRNA
atgccttagtgtatggtgag

SEQ ID NO: 5660 - DNA, 20 bp, Artificial Sequence
  sgRNA
gggcggaagaaacttccaat

SEQ ID NO: 5661 - DNA, 20 bp, Artificial Sequence
  sgRNA
agagtgctcagaagtcaacg

SEQ ID NO: 5662 - DNA, 20 bp, Artificial Sequence
  sgRNA
gagtgacgaaggtagtggcg

SEQ ID NO: 5663 - DNA, 20 bp, Artificial Sequence
  sgRNA
ctctctggtcctcagcttgg

SEQ ID NO: 5664 - DNA, 20 bp, Artificial Sequence
  sgRNA
ggcgggcagaatagtgggac

SEQ ID NO: 5665 - DNA, 20 bp, Artificial Sequence
  sgRNA
gcaagcccagctttgagagc

SEQ ID NO: 5666 - DNA, 20 bp, Artificial Sequence
  sgRNA
tacatttcccagaagcgcgg

SEQ ID NO: 5667 - DNA, 20 bp, Artificial Sequence
  sgRNA
gggctgctcaggttgctaag

SEQ ID NO: 5668 - DNA, 20 bp, Artificial Sequence
  sgRNA
cgcttagccacacccaccca

SEQ ID NO: 5669 - DNA, 20 bp, Artificial Sequence
  sgRNA
gcgcctcaacagacgatgac

SEQ ID NO: 5670 - DNA, 20 bp, Artificial Sequence
  sgRNA
ttgcccgaccaactacatcc

SEQ ID NO: 5671 - DNA, 20 bp, Artificial Sequence
  sgRNA
gcctgggcccagttaggaaa

SEQ ID NO: 5672 - DNA, 20 bp, Artificial Sequence
  sgRNA
ccacctccagccctgggcgg

SEQ ID NO: 5673 - DNA, 20 bp, Artificial Sequence
  sgRNA
caggtaaacaggtcactcaa

SEQ ID NO: 5674 - DNA, 20 bp, Artificial Sequence
  sgRNA
tcggagaatggaatcttctt

SEQ ID NO: 5675 - DNA, 20 bp, Artificial Sequence
  sgRNA
agcgcaatggccagagcccg

SEQ ID NO: 5676 - DNA, 20 bp, Artificial Sequence
  sgRNA
ggtctggtcaggagggcctt

SEQ ID NO: 5677 - DNA, 20 bp, Artificial Sequence
  sgRNA
aataaggaccaattcatgct

SEQ ID NO: 5678 - DNA, 20 bp, Artificial Sequence
  sgRNA
cacagtctctgagcattcat

SEQ ID NO: 5679 - DNA, 20 bp, Artificial Sequence
  sgRNA
cctgcagcataaacatttcc

SEQ ID NO: 5680 - DNA, 20 bp, Artificial Sequence
  sgRNA
gcgctacggcaagccggagg

SEQ ID NO: 5681 - DNA, 20 bp, Artificial Sequence
  sgRNA
agccagagagggagcggcgg

SEQ ID NO: 5682 - DNA, 20 bp, Artificial Sequence
  sgRNA
gaagaaggcgctagaaccgg

SEQ ID NO: 5683 - DNA, 20 bp, Artificial Sequence
  sgRNA
cccaggctgaggaggcgaaa

SEQ ID NO: 5684 - DNA, 20 bp, Artificial Sequence
  sgRNA
atatcctcattatgtaatcc

SEQ ID NO: 5685 - DNA, 20 bp, Artificial Sequence
  sgRNA
cagagccaaggtaagccaac

SEQ ID NO: 5686 - DNA, 20 bp, Artificial Sequence
  sgRNA
aaccacagtagaatgtcctc

SEQ ID NO: 5687 - DNA, 20 bp, Artificial Sequence
  sgRNA
acactagccgtctgtttgcc

SEQ ID NO: 5688 - DNA, 20 bp, Artificial Sequence
  sgRNA
gctgtccaatcatagccaag

SEQ ID NO: 5689 - DNA, 20 bp, Artificial Sequence
  sgRNA
aagatggagcccttaaagaa

SEQ ID NO: 5690 - DNA, 20 bp, Artificial Sequence
  sgRNA
aggcggagcaggaggcgagt

SEQ ID NO: 5691 - DNA, 20 bp, Artificial Sequence
  sgRNA
gaaagggctcggatgccctg

SEQ ID NO: 5692 - DNA, 20 bp, Artificial Sequence
  sgRNA
agaacctcacagaggaaggg

SEQ ID NO: 5693 - DNA, 20 bp, Artificial Sequence
  sgRNA
taggagctttgcggcccggt

SEQ ID NO: 5694 - DNA, 20 bp, Artificial Sequence
  sgRNA
gcagttgtgcaggtctcacg

SEQ ID NO: 5695 - DNA, 20 bp, Artificial Sequence
  sgRNA
tgcaaactggccaggaggcg

SEQ ID NO: 5696 - DNA, 20 bp, Artificial Sequence
  sgRNA
gcgcgtggtgggagctccct

SEQ ID NO: 5697 - DNA, 20 bp, Artificial Sequence
  sgRNA
aagtccctcgcgccctctgg

SEQ ID NO: 5698 - DNA, 20 bp, Artificial Sequence
  sgRNA
tcagtggtaccgttcaagcg

SEQ ID NO: 5699 - DNA, 20 bp, Artificial Sequence
  sgRNA
ggccggttccctgtgggctt

SEQ ID NO: 5700 - DNA, 20 bp, Artificial Sequence
  sgRNA
gggtgagcgagtggaaggcg

SEQ ID NO: 5701 - DNA, 20 bp, Artificial Sequence
  sgRNA
ctatatttaagacggttaca

SEQ ID NO: 5702 - DNA, 20 bp, Artificial Sequence
  sgRNA
gttggaagcgatttaaactc

SEQ ID NO: 5703 - DNA, 20 bp, Artificial Sequence
  sgRNA
acataccgctcatgcctcac

SEQ ID NO: 5704 - DNA, 20 bp, Artificial Sequence
  sgRNA
tcgtcagctctggtaggtag

SEQ ID NO: 5705 - DNA, 20 bp, Artificial Sequence
  sgRNA
gcatggcaaccgctctctga

SEQ ID NO: 5706 - DNA, 20 bp, Artificial Sequence
  sgRNA
acttagagcgctatgtgccc

SEQ ID NO: 5707 - DNA, 20 bp, Artificial Sequence
  sgRNA
gcgcagcgcgaggcgcctcg

SEQ ID NO: 5708 - DNA, 20 bp, Artificial Sequence
  sgRNA
gcccagatagcgcaacttcg

SEQ ID NO: 5709 - DNA, 20 bp, Artificial Sequence
  sgRNA
ctctatggtaggccagcaaa

SEQ ID NO: 5710 - DNA, 20 bp, Artificial Sequence
  sgRNA
ccggtcctgggcgttcacag

SEQ ID NO: 5711 - DNA, 20 bp, Artificial Sequence
  sgRNA
cgggcggcggccgtgcggtg

SEQ ID NO: 5712 - DNA, 20 bp, Artificial Sequence
  sgRNA
actaaagaactaccaaccaa

SEQ ID NO: 5713 - DNA, 20 bp, Artificial Sequence
  sgRNA
acaaagcgatgctaagcatc

SEQ ID NO: 5714 - DNA, 20 bp, Artificial Sequence
  sgRNA
gaatctggcagctctttaag

SEQ ID NO: 5715 - DNA, 20 bp, Artificial Sequence
  sgRNA
ctataagagtcggccgctgc

SEQ ID NO: 5716 - DNA, 20 bp, Artificial Sequence
  sgRNA
tggtggcaacccgcactgct

SEQ ID NO: 5717 - DNA, 20 bp, Artificial Sequence
  sgRNA
ctttatattcagggtctccc

SEQ ID NO: 5718 - DNA, 20 bp, Artificial Sequence
  sgRNA
ggctagcttacctcacaaag

SEQ ID NO: 5719 - DNA, 20 bp, Artificial Sequence
  sgRNA
taaacggagcttctattggc

SEQ ID NO: 5720 - DNA, 20 bp, Artificial Sequence
  sgRNA
gggagctgcgcggttgtgct

SEQ ID NO: 5721 - DNA, 20 bp, Artificial Sequence
  sgRNA
aaatgcgccaagtagccaga

SEQ ID NO: 5722 - DNA, 20 bp, Artificial Sequence
  sgRNA
ggtgttgtactgtctggttc

SEQ ID NO: 5723 - DNA, 20 bp, Artificial Sequence
  sgRNA
agagcggaagttatggcgcg

SEQ ID NO: 5724 - DNA, 20 bp, Artificial Sequence
  sgRNA
tggcctgaccttcgtgtagc

SEQ ID NO: 5725 - DNA, 20 bp, Artificial Sequence
  sgRNA
tccgtcatatcccgtcctcg

SEQ ID NO: 5726 - DNA, 20 bp, Artificial Sequence
  sgRNA
gctcctcccagcacctcacg

SEQ ID NO: 5727 - DNA, 20 bp, Artificial Sequence
  sgRNA
ccggacaaggatgctgcagc

SEQ ID NO: 5728 - DNA, 20 bp, Artificial Sequence
  sgRNA
ccagacacattgatgtaggg

SEQ ID NO: 5729 - DNA, 20 bp, Artificial Sequence
  sgRNA
ccaaggctctgcgactagga

SEQ ID NO: 5730 - DNA, 20 bp, Artificial Sequence
  sgRNA
ttgaacaggatcgtccaagg

SEQ ID NO: 5731 - DNA, 20 bp, Artificial Sequence
  sgRNA
cgccgcggcgcgtcactgcc

SEQ ID NO: 5732 - DNA, 20 bp, Artificial Sequence
  sgRNA
agccctcagctggcggcgtg

SEQ ID NO: 5733 - DNA, 20 bp, Artificial Sequence
  sgRNA
cgggtctgcgcaccgcacgg

SEQ ID NO: 5734 - DNA, 20 bp, Artificial Sequence
  sgRNA
ctcctttctggccgttacca

SEQ ID NO: 5735 - DNA, 20 bp, Artificial Sequence
  sgRNA
gacagtttgatatgagctcc

SEQ ID NO: 5736 - DNA, 20 bp, Artificial Sequence
  sgRNA
tacacacaccctgcaggagg

SEQ ID NO: 5737 - DNA, 20 bp, Artificial Sequence
  sgRNA
ctggatcgccggccgaagaa

SEQ ID NO: 5738 - DNA, 20 bp, Artificial Sequence
  sgRNA
agacgtgctctgaagactac

SEQ ID NO: 5739 - DNA, 20 bp, Artificial Sequence
  sgRNA
tgtgagggacggagcagtaa

SEQ ID NO: 5740 - DNA, 20 bp, Artificial Sequence
  sgRNA
tcaggctacaggctgggcct

SEQ ID NO: 5741 - DNA, 20 bp, Artificial Sequence
  sgRNA
gactcactgtagggttggta

SEQ ID NO: 5742 - DNA, 20 bp, Artificial Sequence
  sgRNA
gaggttgccaagaactctct

SEQ ID NO: 5743 - DNA, 20 bp, Artificial Sequence
  sgRNA
taggaaactgaagctcgggc

SEQ ID NO: 5744 - DNA, 20 bp, Artificial Sequence
  sgRNA
tgatctaagcatccttccgg

SEQ ID NO: 5745 - DNA, 20 bp, Artificial Sequence
  sgRNA
gggccctccacttgggctgc

SEQ ID NO: 5746 - DNA, 20 bp, Artificial Sequence
  sgRNA
aaatgacaccagggcaacgt

SEQ ID NO: 5747 - DNA, 20 bp, Artificial Sequence
  sgRNA
gatgcttccagggcagcccg

SEQ ID NO: 5748 - DNA, 20 bp, Artificial Sequence
  sgRNA
aatgttcttcggtccaatag

SEQ ID NO: 5749 - DNA, 20 bp, Artificial Sequence
  sgRNA
gaagcagcataagaagagag

SEQ ID NO: 5750 - DNA, 20 bp, Artificial Sequence
  sgRNA
gggcaaaggcacctgaggtt

SEQ ID NO: 5751 - DNA, 20 bp, Artificial Sequence
  sgRNA
agaactaagtgctaatggaa

SEQ ID NO: 5752 - DNA, 20 bp, Artificial Sequence
  sgRNA
ctggtcgttggtggactttg

SEQ ID NO: 5753 - DNA, 20 bp, Artificial Sequence
  sgRNA
gagtccacgcccgcgaccgt

SEQ ID NO: 5754 - DNA, 20 bp, Artificial Sequence
  sgRNA
aaacgcccagggaaggtggc

SEQ ID NO: 5755 - DNA, 20 bp, Artificial Sequence
  sgRNA
cgagcacgacaagagcgcct

SEQ ID NO: 5756 - DNA, 20 bp, Artificial Sequence
  sgRNA
gcatctccaccttgggaggt

SEQ ID NO: 5757 - DNA, 20 bp, Artificial Sequence
  sgRNA
gcgcccgtcgtctaggcgag

SEQ ID NO: 5758 - DNA, 20 bp, Artificial Sequence
  sgRNA
aagactggctgagtcaatcc

SEQ ID NO: 5759 - DNA, 20 bp, Artificial Sequence
  sgRNA
ggcccaggagcgcctctgat

SEQ ID NO: 5760 - DNA, 20 bp, Artificial Sequence
  sgRNA
cagggcgaggaagctcggga

SEQ ID NO: 5761 - DNA, 20 bp, Artificial Sequence
  sgRNA
accatcgggccaggcctcgg

SEQ ID NO: 5762 - DNA, 20 bp, Artificial Sequence
  sgRNA
ccgcccggagaccgccatga

SEQ ID NO: 5763 - DNA, 20 bp, Artificial Sequence
  sgRNA
tcagaagcgcagaaacttca

SEQ ID NO: 5764 - DNA, 20 bp, Artificial Sequence
  sgRNA
agctctgtctttcaggagct

SEQ ID NO: 5765 - DNA, 20 bp, Artificial Sequence
  sgRNA
ttctcgggcacacaggaggc

SEQ ID NO: 5766 - DNA, 20 bp, Artificial Sequence
  sgRNA
cagagtgtcagtcaaggagt

SEQ ID NO: 5767 - DNA, 20 bp, Artificial Sequence
  sgRNA
gttcccacctacactgttag

SEQ ID NO: 5768 - DNA, 20 bp, Artificial Sequence
  sgRNA
ctcggatcttggttcccttg

SEQ ID NO: 5769 - DNA, 20 bp, Artificial Sequence
  sgRNA
aggagtgcgctgagacgaag

SEQ ID NO: 5770 - DNA, 20 bp, Artificial Sequence
  sgRNA
ctgacagatggtcccataaa

SEQ ID NO: 5771 - DNA, 20 bp, Artificial Sequence
  sgRNA
atccagggaggcgtgtccag

SEQ ID NO: 5772 - DNA, 20 bp, Artificial Sequence
  sgRNA
gtaatccatcctgagatttg

SEQ ID NO: 5773 - DNA, 20 bp, Artificial Sequence
  sgRNA
ctgctcacagcaggtagaac

SEQ ID NO: 5774 - DNA, 20 bp, Artificial Sequence
  sgRNA
gtcagccaccagggaacgtg

SEQ ID NO: 5775 - DNA, 20 bp, Artificial Sequence
  sgRNA
atccagctgtggtgtgcgcc

SEQ ID NO: 5776 - DNA, 20 bp, Artificial Sequence
  sgRNA
ctgactccagcattagctta

SEQ ID NO: 5777 - DNA, 20 bp, Artificial Sequence
  sgRNA
tcctttagcatgtcattagt

SEQ ID NO: 5778 - DNA, 20 bp, Artificial Sequence
  sgRNA
attggcctacagcgtgccgg

SEQ ID NO: 5779 - DNA, 20 bp, Artificial Sequence
  sgRNA
ctgagctcgtgggacagcct

SEQ ID NO: 5780 - DNA, 20 bp, Artificial Sequence
  sgRNA
ttctataccagctgttgctc

SEQ ID NO: 5781 - DNA, 20 bp, Artificial Sequence
  sgRNA
gtcattcaggatgaaggaac

SEQ ID NO: 5782 - DNA, 20 bp, Artificial Sequence
  sgRNA
acgccgccaccgaggcgcag

SEQ ID NO: 5783 - DNA, 20 bp, Artificial Sequence
  sgRNA
atgggttctttcgtgacgtc

SEQ ID NO: 5784 - DNA, 20 bp, Artificial Sequence
  sgRNA
agtgggcgcgctaagagatg

SEQ ID NO: 5785 - DNA, 20 bp, Artificial Sequence
  sgRNA
attcccaatgcctatgtaaa

SEQ ID NO: 5786 - DNA, 20 bp, Artificial Sequence
  sgRNA
tgccttggctagcagtcgcc

SEQ ID NO: 5787 - DNA, 20 bp, Artificial Sequence
  sgRNA
gctcagcttccctctgtctc

SEQ ID NO: 5788 - DNA, 20 bp, Artificial Sequence
  sgRNA
ttcttcctgaaggcagagac

SEQ ID NO: 5789 - DNA, 20 bp, Artificial Sequence
  sgRNA
tcaccgcgggaatcccaggg

SEQ ID NO: 5790 - DNA, 20 bp, Artificial Sequence
  sgRNA
cacctgcgcagtacgctgcg

SEQ ID NO: 5791 - DNA, 20 bp, Artificial Sequence
  sgRNA
agttaaagttgctgaaacca

SEQ ID NO: 5792 - DNA, 20 bp, Artificial Sequence
  sgRNA
gcctcaggttccagcagttt

SEQ ID NO: 5793 - DNA, 20 bp, Artificial Sequence
  sgRNA
ggctcgtcgccgggaagggc

SEQ ID NO: 5794 - DNA, 20 bp, Artificial Sequence
  sgRNA
tgtagtccacagtggaaacc

SEQ ID NO: 5795 - DNA, 20 bp, Artificial Sequence
  sgRNA
tcacgataagatgggcgtgg

SEQ ID NO: 5796 - DNA, 20 bp, Artificial Sequence
  sgRNA
cctggccatatgagaagtcc

SEQ ID NO: 5797 - DNA, 20 bp, Artificial Sequence
  sgRNA
ttgaaagggaagctggcgag

SEQ ID NO: 5798 - DNA, 20 bp, Artificial Sequence
  sgRNA
ggctttgcactgatgctagg

SEQ ID NO: 5799 - DNA, 20 bp, Artificial Sequence
  sgRNA
gaatcatgataaacctacca

SEQ ID NO: 5800 - DNA, 20 bp, Artificial Sequence
  sgRNA
ctgggctccactcacgaacc

SEQ ID NO: 5801 - DNA, 20 bp, Artificial Sequence
  sgRNA
gaggaactaggtaggcgagg

SEQ ID NO: 5802 - DNA, 20 bp, Artificial Sequence
  sgRNA
tataaggatatgccctatgg

SEQ ID NO: 5803 - DNA, 20 bp, Artificial Sequence
  sgRNA
accgtgaacaccactgtgcg

SEQ ID NO: 5804 - DNA, 20 bp, Artificial Sequence
  sgRNA
gcgtttaaacagaccggaag

SEQ ID NO: 5805 - DNA, 20 bp, Artificial Sequence
  sgRNA
ttcacttggaagtcccttta

SEQ ID NO: 5806 - DNA, 20 bp, Artificial Sequence
  sgRNA
tgcgagctagacggcggcga

SEQ ID NO: 5807 - DNA, 20 bp, Artificial Sequence
  sgRNA
ccgtagccgccgtgcccttt

SEQ ID NO: 5808 - DNA, 20 bp, Artificial Sequence
  sgRNA
tctttaagcaagaggaggcg

SEQ ID NO: 5809 - DNA, 20 bp, Artificial Sequence
  sgRNA
ccaccggctacccttccggc

SEQ ID NO: 5810 - DNA, 20 bp, Artificial Sequence
  sgRNA
ctacttatcagttctcaatc

SEQ ID NO: 5811 - DNA, 20 bp, Artificial Sequence
  sgRNA
ttagaccctcttcatctgat

SEQ ID NO: 5812 - DNA, 20 bp, Artificial Sequence
  sgRNA
aactaagagatctctaatct

SEQ ID NO: 5813 - DNA, 20 bp, Artificial Sequence
  sgRNA
accgatccgtctctaggcag

SEQ ID NO: 5814 - DNA, 20 bp, Artificial Sequence
  sgRNA
atcgcctaggactaagggat

SEQ ID NO: 5815 - DNA, 20 bp, Artificial Sequence
  sgRNA
cttcatggagattgttgcta

SEQ ID NO: 5816 - DNA, 20 bp, Artificial Sequence
  sgRNA
tgggtggagcccaaccacag

SEQ ID NO: 5817 - DNA, 20 bp, Artificial Sequence
  sgRNA
tagcaggcgtcaggcaatcc

SEQ ID NO: 5818 - DNA, 20 bp, Artificial Sequence
  sgRNA
cctgatgtcatggagtcctg

SEQ ID NO: 5819 - DNA, 20 bp, Artificial Sequence
  sgRNA
tccactgcggacgaatcccg

SEQ ID NO: 5820 - DNA, 20 bp, Artificial Sequence
  sgRNA
agtggactacaagtcccgtg

SEQ ID NO: 5821 - DNA, 20 bp, Artificial Sequence
  sgRNA
cagacctctaggctccactg

SEQ ID NO: 5822 - DNA, 20 bp, Artificial Sequence
  sgRNA
gagaagggcctccagtccca

SEQ ID NO: 5823 - DNA, 20 bp, Artificial Sequence
  sgRNA
gggcagatgtatcagagtgc

SEQ ID NO: 5824 - DNA, 20 bp, Artificial Sequence
  sgRNA
gttagccaatggcacggcgg

SEQ ID NO: 5825 - DNA, 20 bp, Artificial Sequence
  sgRNA
gactggctagagagcgactc

SEQ ID NO: 5826 - DNA, 20 bp, Artificial Sequence
  sgRNA
ctgtgcaaagctgaggttcc

SEQ ID NO: 5827 - DNA, 20 bp, Artificial Sequence
  sgRNA
ccgacgtcgctttcacttcc

SEQ ID NO: 5828 - DNA, 20 bp, Artificial Sequence
  sgRNA
gtgtgtgttggttagtgact

SEQ ID NO: 5829 - DNA, 20 bp, Artificial Sequence
  sgRNA
cttatcaacacatctacctc

SEQ ID NO: 5830 - DNA, 20 bp, Artificial Sequence
  sgRNA
ctaaattggttgcattcaaa

SEQ ID NO: 5831 - DNA, 20 bp, Artificial Sequence
  sgRNA
acttaagttctatgtgattc

SEQ ID NO: 5832 - DNA, 20 bp, Artificial Sequence
  sgRNA
caagtaaatcagcttagcac

SEQ ID NO: 5833 - DNA, 20 bp, Artificial Sequence
  sgRNA
gcgacgtccctccgaccgat

SEQ ID NO: 5834 - DNA, 20 bp, Artificial Sequence
  sgRNA
ctggagagcactcagaccgc

SEQ ID NO: 5835 - DNA, 20 bp, Artificial Sequence
  sgRNA
ggtcgccggcctgtgtggca

SEQ ID NO: 5836 - DNA, 20 bp, Artificial Sequence
  sgRNA
gccgcggaccgtgagacgcg

SEQ ID NO: 5837 - DNA, 20 bp, Artificial Sequence
  sgRNA
gcgggacggccgcgtgcccg

SEQ ID NO: 5838 - DNA, 20 bp, Artificial Sequence
  sgRNA
ccgcctctgggctgactgca

SEQ ID NO: 5839 - DNA, 20 bp, Artificial Sequence
  sgRNA
aaacagtgtaggtggagctg

SEQ ID NO: 5840 - DNA, 20 bp, Artificial Sequence
  sgRNA
gttgcaggaacacggctcac

SEQ ID NO: 5841 - DNA, 20 bp, Artificial Sequence
  sgRNA
ctctgcgcgggatgacgccc

SEQ ID NO: 5842 - DNA, 20 bp, Artificial Sequence
  sgRNA
acttcctcattcaccttata

SEQ ID NO: 5843 - DNA, 20 bp, Artificial Sequence
  sgRNA
gtggtaatttacctggaagt

SEQ ID NO: 5844 - DNA, 20 bp, Artificial Sequence
  sgRNA
catttacatcacaattgggc

SEQ ID NO: 5845 - DNA, 20 bp, Artificial Sequence
  sgRNA
aaccggagcaggcaggactg

SEQ ID NO: 5846 - DNA, 20 bp, Artificial Sequence
  sgRNA
tttcagtcctaccagagcca

SEQ ID NO: 5847 - DNA, 20 bp, Artificial Sequence
  sgRNA
ctctgcctactgtgcagccc

SEQ ID NO: 5848 - DNA, 20 bp, Artificial Sequence
  sgRNA
aagactgatatttcctgaag

SEQ ID NO: 5849 - DNA, 20 bp, Artificial Sequence
  sgRNA
tgaggatgaccaacacagca

SEQ ID NO: 5850 - DNA, 20 bp, Artificial Sequence
  sgRNA
agacggacttaagcgacagc

SEQ ID NO: 5851 - DNA, 20 bp, Artificial Sequence
  sgRNA
tttaatgttgggtggtgatg

SEQ ID NO: 5852 - DNA, 20 bp, Artificial Sequence
  sgRNA
aaactatatgccgccaaatt

SEQ ID NO: 5853 - DNA, 20 bp, Artificial Sequence
  sgRNA
tgggtcttccgcggttgcca

SEQ ID NO: 5854 - DNA, 20 bp, Artificial Sequence
  sgRNA
gctggatagggcgtgtctcc

SEQ ID NO: 5855 - DNA, 20 bp, Artificial Sequence
  sgRNA
tctgctcacgctacatggtg

SEQ ID NO: 5856 - DNA, 20 bp, Artificial Sequence
  sgRNA
gcacatctagaggagatttc

SEQ ID NO: 5857 - DNA, 20 bp, Artificial Sequence
  sgRNA
agggcgaggtgtgcgcgaag

SEQ ID NO: 5858 - DNA, 20 bp, Artificial Sequence
  sgRNA
cagtattggtttctgtggcc

SEQ ID NO: 5859 - DNA, 20 bp, Artificial Sequence
  sgRNA
atggaacaaggaggatctag

SEQ ID NO: 5860 - DNA, 20 bp, Artificial Sequence
  sgRNA
gcactccggctgtgattgct

SEQ ID NO: 5861 - DNA, 20 bp, Artificial Sequence
  sgRNA
gatctgcgccgctccgccct

SEQ ID NO: 5862 - DNA, 20 bp, Artificial Sequence
  sgRNA
taattcatcttgtctggctg

SEQ ID NO: 5863 - DNA, 20 bp, Artificial Sequence
  sgRNA
cactgggccgcgaccctccc

SEQ ID NO: 5864 - DNA, 20 bp, Artificial Sequence
  sgRNA
ggcttccggaagccgtcccg

SEQ ID NO: 5865 - DNA, 20 bp, Artificial Sequence
  sgRNA
gtggaaataggcgcgctccc

SEQ ID NO: 5866 - DNA, 20 bp, Artificial Sequence
  sgRNA
attgggccgcgccagtgact

SEQ ID NO: 5867 - DNA, 20 bp, Artificial Sequence
  sgRNA
cggaccctaggcgcgggcgg

SEQ ID NO: 5868 - DNA, 20 bp, Artificial Sequence
  sgRNA
aattgcccttctggctagag

SEQ ID NO: 5869 - DNA, 20 bp, Artificial Sequence
  sgRNA
aatctagtgcgcatgctctt

SEQ ID NO: 5870 - DNA, 20 bp, Artificial Sequence
  sgRNA
ctggtgtggactggaagcgc

SEQ ID NO: 5871 - DNA, 20 bp, Artificial Sequence
  sgRNA
caactaagaaagctggtgca

SEQ ID NO: 5872 - DNA, 20 bp, Artificial Sequence
  sgRNA
aagggtactttcaaagtgcc

SEQ ID NO: 5873 - DNA, 20 bp, Artificial Sequence
  sgRNA
ggcgcagcgtcatgacgtca

SEQ ID NO: 5874 - DNA, 20 bp, Artificial Sequence
  sgRNA
agtctgtgcgcgcatcccgc

SEQ ID NO: 5875 - DNA, 20 bp, Artificial Sequence
  sgRNA
aaggatgcagggttaggaaa

SEQ ID NO: 5876 - DNA, 20 bp, Artificial Sequence
  sgRNA
aaggcgtggcctcaccagag

SEQ ID NO: 5877 - DNA, 20 bp, Artificial Sequence
  sgRNA
ggaggcacccagatctgcac

SEQ ID NO: 5878 - DNA, 20 bp, Artificial Sequence
  sgRNA
gggcagctaatcccgcaggg

SEQ ID NO: 5879 - DNA, 20 bp, Artificial Sequence
  sgRNA
tgcactaatctggcttccaa

SEQ ID NO: 5880 - DNA, 20 bp, Artificial Sequence
  sgRNA
gaaacgggcttctgtctgat

SEQ ID NO: 5881 - DNA, 20 bp, Artificial Sequence
  sgRNA
ggcgcaacagcagaaggagg

SEQ ID NO: 5882 - DNA, 20 bp, Artificial Sequence
  sgRNA
acctgatacccaacaaagac

SEQ ID NO: 5883 - DNA, 20 bp, Artificial Sequence
  sgRNA
taacagagatcagtgtttga

SEQ ID NO: 5884 - DNA, 20 bp, Artificial Sequence
  sgRNA
ggacctgggttgagatgaac

SEQ ID NO: 5885 - DNA, 20 bp, Artificial Sequence
  sgRNA
gcccgacttccgcttaaccc

SEQ ID NO: 5886 - DNA, 20 bp, Artificial Sequence
  sgRNA
aattataaataccctacggc

SEQ ID NO: 5887 - DNA, 20 bp, Artificial Sequence
  sgRNA
aatgtcagtgtcttaagccc

SEQ ID NO: 5888 - DNA, 20 bp, Artificial Sequence
  sgRNA
tgagccattgttatcatccc

SEQ ID NO: 5889 - DNA, 20 bp, Artificial Sequence
  sgRNA
aagccacgcccatcctcaga

SEQ ID NO: 5890 - DNA, 20 bp, Artificial Sequence
  sgRNA
tgtttggatgacacgccttt

SEQ ID NO: 5891 - DNA, 20 bp, Artificial Sequence
  sgRNA
ggctagtgcctggcgtagcc

SEQ ID NO: 5892 - DNA, 20 bp, Artificial Sequence
  sgRNA
tcagcaagagttaacctagg

SEQ ID NO: 5893 - DNA, 20 bp, Artificial Sequence
  sgRNA
acctgcactagacgcgtcat

SEQ ID NO: 5894 - DNA, 20 bp, Artificial Sequence
  sgRNA
agagttggactaatctaggg

SEQ ID NO: 5895 - DNA, 20 bp, Artificial Sequence
  sgRNA
cccgttgcggcgggccaatg

SEQ ID NO: 5896 - DNA, 20 bp, Artificial Sequence
  sgRNA
caatcattaactggttgcac

SEQ ID NO: 5897 - DNA, 20 bp, Artificial Sequence
  sgRNA
ttcttagatcttgcgcaaag

SEQ ID NO: 5898 - DNA, 20 bp, Artificial Sequence
  sgRNA
atgggcagggccaaactccc

SEQ ID NO: 5899 - DNA, 20 bp, Artificial Sequence
  sgRNA
agccacagttaacaggcgta

SEQ ID NO: 5900 - DNA, 20 bp, Artificial Sequence
  sgRNA
ttagggcgtggtggagggag

SEQ ID NO: 5901 - DNA, 20 bp, Artificial Sequence
  sgRNA
tcaggtgagaactcatgtat

SEQ ID NO: 5902 - DNA, 20 bp, Artificial Sequence
  sgRNA
gggtctctctaggtgttagc

SEQ ID NO: 5903 - DNA, 20 bp, Artificial Sequence
  sgRNA
aggtagaactatcaagtctc

SEQ ID NO: 5904 - DNA, 20 bp, Artificial Sequence
  sgRNA
gttgagggtgggaccagaag

SEQ ID NO: 5905 - DNA, 20 bp, Artificial Sequence
  sgRNA
ggaggaccgctgccgacgtg

SEQ ID NO: 5906 - DNA, 20 bp, Artificial Sequence
  sgRNA
aatgggccatatctttatca

SEQ ID NO: 5907 - DNA, 20 bp, Artificial Sequence
  sgRNA
aagctatttagaaagcgatg

SEQ ID NO: 5908 - DNA, 20 bp, Artificial Sequence
  sgRNA
agtgggcacgtgacactctc

SEQ ID NO: 5909 - DNA, 20 bp, Artificial Sequence
  sgRNA
cacctttgtaggctccggct

SEQ ID NO: 5910 - DNA, 20 bp, Artificial Sequence
  sgRNA
ggtcgtagggcgtggcgaag

SEQ ID NO: 5911 - DNA, 20 bp, Artificial Sequence
  sgRNA
ggatgcaggacaagtcctac

SEQ ID NO: 5912 - DNA, 20 bp, Artificial Sequence
  sgRNA
agctctgtgcacgtgatcag

SEQ ID NO: 5913 - DNA, 20 bp, Artificial Sequence
  sgRNA
caggcaagtgtccttgatag

SEQ ID NO: 5914 - DNA, 20 bp, Artificial Sequence
  sgRNA
taatcacccagtaattgctt

SEQ ID NO: 5915 - DNA, 20 bp, Artificial Sequence
  sgRNA
ctgtggcttgctcgtcattg

SEQ ID NO: 5916 - DNA, 20 bp, Artificial Sequence
  sgRNA
cattctacaactgaagacag

SEQ ID NO: 5917 - DNA, 20 bp, Artificial Sequence
  sgRNA
cttgcagactcatagacacc

SEQ ID NO: 5918 - DNA, 20 bp, Artificial Sequence
  sgRNA
tggtcggagaggcagcacgg

SEQ ID NO: 5919 - DNA, 20 bp, Artificial Sequence
  sgRNA
tcactccgcactctgaccaa

SEQ ID NO: 5920 - DNA, 20 bp, Artificial Sequence
  sgRNA
caactgtgttccgtgaattg

SEQ ID NO: 5921 - DNA, 20 bp, Artificial Sequence
  sgRNA
ggaaggtgttctccctcccg

SEQ ID NO: 5922 - DNA, 20 bp, Artificial Sequence
  sgRNA
cgcgagagttgaggaagttg

SEQ ID NO: 5923 - DNA, 20 bp, Artificial Sequence
  sgRNA
aatagtccagctgtcaactt

SEQ ID NO: 5924 - DNA, 20 bp, Artificial Sequence
  sgRNA
gaaccctgtttgctagggaa

SEQ ID NO: 5925 - DNA, 20 bp, Artificial Sequence
  sgRNA
ttggctagcacaaaggccag

SEQ ID NO: 5926 - DNA, 20 bp, Artificial Sequence
  sgRNA
ctaaggagcacaacgcttgc

SEQ ID NO: 5927 - DNA, 20 bp, Artificial Sequence
  sgRNA
ggcgggctggcagtgcggcg

SEQ ID NO: 5928 - DNA, 20 bp, Artificial Sequence
  sgRNA
gacagaaggacacaccaatc

SEQ ID NO: 5929 - DNA, 20 bp, Artificial Sequence
  sgRNA
tctgtttgctttctcctaac

SEQ ID NO: 5930 - DNA, 20 bp, Artificial Sequence
  sgRNA
gggcgtgaccagggagttag

SEQ ID NO: 5931 - DNA, 20 bp, Artificial Sequence
  sgRNA
cagagtagttgtcccgggcc

SEQ ID NO: 5932 - DNA, 20 bp, Artificial Sequence
  sgRNA
atcagtgcgtccatcccgcg

SEQ ID NO: 5933 - DNA, 20 bp, Artificial Sequence
  sgRNA
cgggcgtagaggtacgatgc

SEQ ID NO: 5934 - DNA, 20 bp, Artificial Sequence
  sgRNA
ccgggccggttgggtcgccc

SEQ ID NO: 5935 - DNA, 20 bp, Artificial Sequence
  sgRNA
tttgcacgagaagtggaaac

SEQ ID NO: 5936 - DNA, 20 bp, Artificial Sequence
  sgRNA
gaagagagaattcaaccgca

SEQ ID NO: 5937 - DNA, 20 bp, Artificial Sequence
  sgRNA
aagtcttgcaactgttgtga

SEQ ID NO: 5938 - DNA, 20 bp, Artificial Sequence
  sgRNA
catgaagacaagagtctgca

SEQ ID NO: 5939 - DNA, 20 bp, Artificial Sequence
  sgRNA
tgcaggcctttatgcaaatg

SEQ ID NO: 5940 - DNA, 20 bp, Artificial Sequence
  sgRNA
aaggtgtttccacgctcttc

SEQ ID NO: 5941 - DNA, 20 bp, Artificial Sequence
  sgRNA
tactatggaaatcagagtac

SEQ ID NO: 5942 - DNA, 20 bp, Artificial Sequence
  sgRNA
cttcgaaatatctgtctgat

SEQ ID NO: 5943 - DNA, 20 bp, Artificial Sequence
  sgRNA
gccctcagcttcggctgccc

SEQ ID NO: 5944 - DNA, 20 bp, Artificial Sequence
  sgRNA
gttaacttggagctgggaag

SEQ ID NO: 5945 - DNA, 20 bp, Artificial Sequence
  sgRNA
gaagtgaacagcaggcgacc

SEQ ID NO: 5946 - DNA, 20 bp, Artificial Sequence
  sgRNA
aaggcgtgcgccaccacgct

SEQ ID NO: 5947 - DNA, 20 bp, Artificial Sequence
  sgRNA
agcgggcgggacgtaagggt

SEQ ID NO: 5948 - DNA, 20 bp, Artificial Sequence
  sgRNA
gggcagctaaggtgacatta

SEQ ID NO: 5949 - DNA, 20 bp, Artificial Sequence
  sgRNA
tgaacccgaaaggttagcgt

SEQ ID NO: 5950 - DNA, 20 bp, Artificial Sequence
  sgRNA
acagtaggcctagctggcac

SEQ ID NO: 5951 - DNA, 20 bp, Artificial Sequence
  sgRNA
aagctgccacgagattctgg

SEQ ID NO: 5952 - DNA, 20 bp, Artificial Sequence
  sgRNA
gagttcataatcctatcaga

SEQ ID NO: 5953 - DNA, 20 bp, Artificial Sequence
  sgRNA
gcccagcggcagcccagagc

SEQ ID NO: 5954 - DNA, 20 bp, Artificial Sequence
  sgRNA
agtaggtagcccagtccgtg

SEQ ID NO: 5955 - DNA, 20 bp, Artificial Sequence
  sgRNA
tcgcggctgcggagactaga

SEQ ID NO: 5956 - DNA, 20 bp, Artificial Sequence
  sgRNA
acgtggtgctctcgcgagag

SEQ ID NO: 5957 - DNA, 20 bp, Artificial Sequence
  sgRNA
aatagctctgaagagttcat

SEQ ID NO: 5958 - DNA, 20 bp, Artificial Sequence
  sgRNA
cagtgctttccaagcgcgta

SEQ ID NO: 5959 - DNA, 20 bp, Artificial Sequence
  sgRNA
ctcagccctgtgtccgtgcc

SEQ ID NO: 5960 - DNA, 20 bp, Artificial Sequence
  sgRNA
cccaggattctttaaacaac

SEQ ID NO: 5961 - DNA, 20 bp, Artificial Sequence
  sgRNA
cgtcagctgttctgccaagg

SEQ ID NO: 5962 - DNA, 20 bp, Artificial Sequence
  sgRNA
taaatcatccaggcatacgg

SEQ ID NO: 5963 - DNA, 20 bp, Artificial Sequence
  sgRNA
gcggagtagttgagagatgc

SEQ ID NO: 5964 - DNA, 20 bp, Artificial Sequence
  sgRNA
attgtactttacgttgggaa

SEQ ID NO: 5965 - DNA, 20 bp, Artificial Sequence
  sgRNA
ttgagcgtaggcaaaggtta

SEQ ID NO: 5966 - DNA, 20 bp, Artificial Sequence
  sgRNA
ggctctaccctgtgaccaat

SEQ ID NO: 5967 - DNA, 20 bp, Artificial Sequence
  sgRNA
gctgtttcataacagacttt

SEQ ID NO: 5968 - DNA, 20 bp, Artificial Sequence
  sgRNA
ccgcgagcgcacaaggcacc

SEQ ID NO: 5969 - DNA, 20 bp, Artificial Sequence
  sgRNA
tgttccattagcctcttggc

SEQ ID NO: 5970 - DNA, 20 bp, Artificial Sequence
  sgRNA
acctgcagtcagggactccc

SEQ ID NO: 5971 - DNA, 20 bp, Artificial Sequence
  sgRNA
gcctgcattaacagctagaa

SEQ ID NO: 5972 - DNA, 20 bp, Artificial Sequence
  sgRNA
tgtgcgagctggtgcgaact

SEQ ID NO: 5973 - DNA, 20 bp, Artificial Sequence
  sgRNA
gtggagaaattctggagttg

SEQ ID NO: 5974 - DNA, 20 bp, Artificial Sequence
  sgRNA
gctaccatcgggccaggcct

SEQ ID NO: 5975 - DNA, 20 bp, Artificial Sequence
  sgRNA
tagttagcacacactggaac

SEQ ID NO: 5976 - DNA, 20 bp, Artificial Sequence
  sgRNA
ccatcggccgtgctgggagc

SEQ ID NO: 5977 - DNA, 20 bp, Artificial Sequence
  sgRNA
tgtgctggtgaagaggcaag

SEQ ID NO: 5978 - DNA, 20 bp, Artificial Sequence
  sgRNA
tagccgatctgacagaggag

SEQ ID NO: 5979 - DNA, 20 bp, Artificial Sequence
  sgRNA
gctggagcgcacggcgacac

SEQ ID NO: 5980 - DNA, 20 bp, Artificial Sequence
  sgRNA
gctattggtggccgctctcg

SEQ ID NO: 5981 - DNA, 20 bp, Artificial Sequence
  sgRNA
gagctgttacgaggctccta

SEQ ID NO: 5982 - DNA, 20 bp, Artificial Sequence
  sgRNA
cgccgggaagccgagtcctc

SEQ ID NO: 5983 - DNA, 20 bp, Artificial Sequence
  sgRNA
gaagcctccgcctgaagatt

SEQ ID NO: 5984 - DNA, 20 bp, Artificial Sequence
  sgRNA
tttacaccgctttatttgtc

SEQ ID NO: 5985 - DNA, 20 bp, Artificial Sequence
  sgRNA
taaagaagtagtaggtctca

SEQ ID NO: 5986 - DNA, 20 bp, Artificial Sequence
  sgRNA
aggccaagtgtccaccgtga

SEQ ID NO: 5987 - DNA, 20 bp, Artificial Sequence
  sgRNA
atcaagagttgactgaagac

SEQ ID NO: 5988 - DNA, 20 bp, Artificial Sequence
  sgRNA
aggtcacgttccaacccttt

SEQ ID NO: 5989 - DNA, 20 bp, Artificial Sequence
  sgRNA
cgttgggcgatggacaagct

SEQ ID NO: 5990 - DNA, 20 bp, Artificial Sequence
  sgRNA
agagttcaacggccggaagt

SEQ ID NO: 5991 - DNA, 20 bp, Artificial Sequence
  sgRNA
tatctctgtgtctagggtat

SEQ ID NO: 5992 - DNA, 20 bp, Artificial Sequence
  sgRNA
gaagtgtgtgaggaggttgg

SEQ ID NO: 5993 - DNA, 20 bp, Artificial Sequence
  sgRNA
aaacaggcgggaatcggtgg

SEQ ID NO: 5994 - DNA, 20 bp, Artificial Sequence
  sgRNA
tcttcagttaggaacagtcc

SEQ ID NO: 5995 - DNA, 20 bp, Artificial Sequence
  sgRNA
cccgccctgtcaaggcagcc

SEQ ID NO: 5996 - DNA, 20 bp, Artificial Sequence
  sgRNA
aaaggaaacacttggccttt

SEQ ID NO: 5997 - DNA, 20 bp, Artificial Sequence
  sgRNA
ggagggccttaacgtgggcg

SEQ ID NO: 5998 - DNA, 20 bp, Artificial Sequence
  sgRNA
gcgtcctggatactttagga

SEQ ID NO: 5999 - DNA, 20 bp, Artificial Sequence
  sgRNA
ttagcaggagtctgattggc

SEQ ID NO: 6000 - DNA, 20 bp, Artificial Sequence
  sgRNA
tatctgcgactccagcgcgg

SEQ ID NO: 6001 - DNA, 20 bp, Artificial Sequence
  sgRNA
gacagtctcccgcgggaccg

SEQ ID NO: 6002 - DNA, 20 bp, Artificial Sequence
  sgRNA
caggaaggaggaactcaaga

SEQ ID NO: 6003 - DNA, 20 bp, Artificial Sequence
  sgRNA
ctactaagcaataagtcaag

SEQ ID NO: 6004 - DNA, 20 bp, Artificial Sequence
  sgRNA
tcgtctcagcgctctctcat

SEQ ID NO: 6005 - DNA, 20 bp, Artificial Sequence
  sgRNA
gagcttccttctttcaaacc

SEQ ID NO: 6006 - DNA, 20 bp, Artificial Sequence
  sgRNA
tggtgaggtatggaggaagg

SEQ ID NO: 6007 - DNA, 20 bp, Artificial Sequence
  sgRNA
tgggctagacagcgagtagc

SEQ ID NO: 6008 - DNA, 20 bp, Artificial Sequence
  sgRNA
tgagcctaactaagcaaggg

SEQ ID NO: 6009 - DNA, 20 bp, Artificial Sequence
  sgRNA
ttgggccctcctaatacatg

SEQ ID NO: 6010 - DNA, 20 bp, Artificial Sequence
  sgRNA
aaagcccagggcggtgaaga

SEQ ID NO: 6011 - DNA, 20 bp, Artificial Sequence
  sgRNA
cttcttcccagggcgaggtg

SEQ ID NO: 6012 - DNA, 20 bp, Artificial Sequence
  sgRNA
acagtcgggcccaaccacag

SEQ ID NO: 6013 - DNA, 20 bp, Artificial Sequence
  sgRNA
tgtgctacggtggccgcgcg

SEQ ID NO: 6014 - DNA, 20 bp, Artificial Sequence
  sgRNA
ggagacaccaaccactaaga

SEQ ID NO: 6015 - DNA, 20 bp, Artificial Sequence
  sgRNA
gccgacctgaacaccggcac

SEQ ID NO: 6016 - DNA, 20 bp, Artificial Sequence
  sgRNA
gcatcacgtgggccaaggag

SEQ ID NO: 6017 - DNA, 20 bp, Artificial Sequence
  sgRNA
cacaaggtagtgttgacaga

SEQ ID NO: 6018 - DNA, 20 bp, Artificial Sequence
  sgRNA
aaagaaaggagcatgatgat

SEQ ID NO: 6019 - DNA, 20 bp, Artificial Sequence
  sgRNA
tcttagtctcgtcgtacgat

SEQ ID NO: 6020 - DNA, 20 bp, Artificial Sequence
  sgRNA
agtgaaggtagcggcggcta

SEQ ID NO: 6021 - DNA, 20 bp, Artificial Sequence
  sgRNA
tcctgcaggactggtgcacc

SEQ ID NO: 6022 - DNA, 20 bp, Artificial Sequence
  sgRNA
ctgcgcatgactgaagggcg

SEQ ID NO: 6023 - DNA, 20 bp, Artificial Sequence
  sgRNA
ggctgggcacgcgcagtgcg

SEQ ID NO: 6024 - DNA, 20 bp, Artificial Sequence
  sgRNA
agcgcactgggcgtggttag

SEQ ID NO: 6025 - DNA, 20 bp, Artificial Sequence
  sgRNA
gcacacctacctctccctca

SEQ ID NO: 6026 - DNA, 20 bp, Artificial Sequence
  sgRNA
tataagcgccaaagtccaga

SEQ ID NO: 6027 - DNA, 20 bp, Artificial Sequence
  sgRNA
gttctgacgcgcggaaaccc

SEQ ID NO: 6028 - DNA, 20 bp, Artificial Sequence
  sgRNA
aattgaactggtggcatatc

SEQ ID NO: 6029 - DNA, 20 bp, Artificial Sequence
  sgRNA
ttgagtaggtgtagccttgt

SEQ ID NO: 6030 - DNA, 20 bp, Artificial Sequence
  sgRNA
ctctgcacagggcaggctgg

SEQ ID NO: 6031 - DNA, 20 bp, Artificial Sequence
  sgRNA
tcagcggtagatctagcaaa

SEQ ID NO: 6032 - DNA, 20 bp, Artificial Sequence
  sgRNA
agctttgcccaccgtgctcc

SEQ ID NO: 6033 - DNA, 20 bp, Artificial Sequence
  sgRNA
tccgaccgatgctcgatgct

SEQ ID NO: 6034 - DNA, 20 bp, Artificial Sequence
  sgRNA
gcacctcagacagctcccgc

SEQ ID NO: 6035 - DNA, 20 bp, Artificial Sequence
  sgRNA
ccgcccacagcacaaactct

SEQ ID NO: 6036 - DNA, 20 bp, Artificial Sequence
  sgRNA
ctaactgcagtgagccgcca

SEQ ID NO: 6037 - DNA, 20 bp, Artificial Sequence
  sgRNA
taactgagtaagggattaac

SEQ ID NO: 6038 - DNA, 20 bp, Artificial Sequence
  sgRNA
ccgccatcttgtcattgagt

SEQ ID NO: 6039 - DNA, 20 bp, Artificial Sequence
  sgRNA
taggatgtgactcaatgttt

SEQ ID NO: 6040 - DNA, 20 bp, Artificial Sequence
  sgRNA
cagatgtgtcagttggctga

SEQ ID NO: 6041 - DNA, 20 bp, Artificial Sequence
  sgRNA
ctatcgtcaccttggctgcc

SEQ ID NO: 6042 - DNA, 20 bp, Artificial Sequence
  sgRNA
agttgatatattcagctgaa

SEQ ID NO: 6043 - DNA, 20 bp, Artificial Sequence
  sgRNA
catctcgtgcgtaagatcca

SEQ ID NO: 6044 - DNA, 20 bp, Artificial Sequence
  sgRNA
ggcatgtcattgttaggcat

SEQ ID NO: 6045 - DNA, 20 bp, Artificial Sequence
  sgRNA
cccgctcggcgggacgggag

SEQ ID NO: 6046 - DNA, 20 bp, Artificial Sequence
  sgRNA
tgcagagttgcatctaaccc

SEQ ID NO: 6047 - DNA, 20 bp, Artificial Sequence
  sgRNA
gggcacaagtcccttccagc

SEQ ID NO: 6048 - DNA, 20 bp, Artificial Sequence
  sgRNA
gagcgggccgcttagaattg

SEQ ID NO: 6049 - DNA, 20 bp, Artificial Sequence
  sgRNA
ctcagatctagttgcatgat

SEQ ID NO: 6050 - DNA, 20 bp, Artificial Sequence
  sgRNA
gggaatgtagtcccgccttg

SEQ ID NO: 6051 - DNA, 20 bp, Artificial Sequence
  sgRNA
ttatgaagggcccacttgtt

SEQ ID NO: 6052 - DNA, 20 bp, Artificial Sequence
  sgRNA
gctagattgactttcataaa

SEQ ID NO: 6053 - DNA, 20 bp, Artificial Sequence
  sgRNA
ggaggcacgcacgcgacgca

SEQ ID NO: 6054 - DNA, 20 bp, Artificial Sequence
  sgRNA
cctggaaatggctagcttgt

SEQ ID NO: 6055 - DNA, 20 bp, Artificial Sequence
  sgRNA
gttgaggctgcctgtgacgg

SEQ ID NO: 6056 - DNA, 20 bp, Artificial Sequence
  sgRNA
cagagggtacctcgctagcc

SEQ ID NO: 6057 - DNA, 20 bp, Artificial Sequence
  sgRNA
cggtgtcgatgcgaaaccct

SEQ ID NO: 6058 - DNA, 20 bp, Artificial Sequence
  sgRNA
gagaagaattagctctacaa

SEQ ID NO: 6059 - DNA, 20 bp, Artificial Sequence
  sgRNA
gcctccaactgcgatggccg

SEQ ID NO: 6060 - DNA, 20 bp, Artificial Sequence
  sgRNA
gtagagcaaggcctgctgag

SEQ ID NO: 6061 - DNA, 20 bp, Artificial Sequence
  sgRNA
tgccctccctccctgcctaa

SEQ ID NO: 6062 - DNA, 20 bp, Artificial Sequence
  sgRNA
tttccggcagtgccgcaagt

SEQ ID NO: 6063 - DNA, 20 bp, Artificial Sequence
  sgRNA
gcctgggcagccgagccaat

SEQ ID NO: 6064 - DNA, 20 bp, Artificial Sequence
  sgRNA
gcgtcggcgcggacttctcg

SEQ ID NO: 6065 - DNA, 20 bp, Artificial Sequence
  sgRNA
atttattacctccgactccg

SEQ ID NO: 6066 - DNA, 20 bp, Artificial Sequence
  sgRNA
agtttagagggtctgggtgc

SEQ ID NO: 6067 - DNA, 20 bp, Artificial Sequence
  sgRNA
aggtggagctaagactcgga

SEQ ID NO: 6068 - DNA, 20 bp, Artificial Sequence
  sgRNA
gaggttgctaagaactctcc

SEQ ID NO: 6069 - DNA, 20 bp, Artificial Sequence
  sgRNA
ttcctaggcccttctgcatt

SEQ ID NO: 6070 - DNA, 20 bp, Artificial Sequence
  sgRNA
tccttagggccctactttaa

SEQ ID NO: 6071 - DNA, 20 bp, Artificial Sequence
  sgRNA
aagacctggtctgtgtggtg

SEQ ID NO: 6072 - DNA, 20 bp, Artificial Sequence
  sgRNA
cccaggctgcctgtcacttg

SEQ ID NO: 6073 - DNA, 20 bp, Artificial Sequence
  sgRNA
ccggtagggtttggccttgg

SEQ ID NO: 6074 - DNA, 20 bp, Artificial Sequence
  sgRNA
ttcgccaaagtccggctgcc

SEQ ID NO: 6075 - DNA, 20 bp, Artificial Sequence
  sgRNA
taactgcactgtggttgatt

SEQ ID NO: 6076 - DNA, 20 bp, Artificial Sequence
  sgRNA
attgtaagaccgggacaatc

SEQ ID NO: 6077 - DNA, 20 bp, Artificial Sequence
  sgRNA
tctggaactcagcagaagag

SEQ ID NO: 6078 - DNA, 20 bp, Artificial Sequence
  sgRNA
cctagctcggagggatgtca

SEQ ID NO: 6079 - DNA, 20 bp, Artificial Sequence
  sgRNA
gactaagcaggagaggttga

SEQ ID NO: 6080 - DNA, 20 bp, Artificial Sequence
  sgRNA
gagagcagcagcactgattt

SEQ ID NO: 6081 - DNA, 20 bp, Artificial Sequence
  sgRNA
gatccctgccaggccctcac

SEQ ID NO: 6082 - DNA, 20 bp, Artificial Sequence
  sgRNA
ggttaatgcttggactcctg

SEQ ID NO: 6083 - DNA, 20 bp, Artificial Sequence
  sgRNA
tgctaaagagaacggaggag

SEQ ID NO: 6084 - DNA, 20 bp, Artificial Sequence
  sgRNA
agcgctggaattgctttatg

SEQ ID NO: 6085 - DNA, 20 bp, Artificial Sequence
  sgRNA
ttcccagcagccaacagcag

SEQ ID NO: 6086 - DNA, 20 bp, Artificial Sequence
  sgRNA
ttcataaagagagtgcctat

SEQ ID NO: 6087 - DNA, 20 bp, Artificial Sequence
  sgRNA
tttggtgtaatcaggtacag

SEQ ID NO: 6088 - DNA, 20 bp, Artificial Sequence
  sgRNA
gagataccaccgcgccggtg

SEQ ID NO: 6089 - DNA, 20 bp, Artificial Sequence
  sgRNA
ggagactcttgtcattgacc

SEQ ID NO: 6090 - DNA, 20 bp, Artificial Sequence
  sgRNA
ttagcagacattaaatactg

SEQ ID NO: 6091 - DNA, 20 bp, Artificial Sequence
  sgRNA
agatccttcctcaaagggcc

SEQ ID NO: 6092 - DNA, 20 bp, Artificial Sequence
  sgRNA
taggttcactgctgcccgac

SEQ ID NO: 6093 - DNA, 20 bp, Artificial Sequence
  sgRNA
tggagcacctagctcttagc

SEQ ID NO: 6094 - DNA, 20 bp, Artificial Sequence
  sgRNA
ttcacgctcagtggcgttta

SEQ ID NO: 6095 - DNA, 20 bp, Artificial Sequence
  sgRNA
tctgtgacgtcagggacggc

SEQ ID NO: 6096 - DNA, 20 bp, Artificial Sequence
  sgRNA
agtctcggctagtcggtggg

SEQ ID NO: 6097 - DNA, 20 bp, Artificial Sequence
  sgRNA
ccatgctgtgagtgaacttt

SEQ ID NO: 6098 - DNA, 20 bp, Artificial Sequence
  sgRNA
gaacgcagatccaacctact

SEQ ID NO: 6099 - DNA, 20 bp, Artificial Sequence
  sgRNA
gagagaagtcttcctagtgt

SEQ ID NO: 6100 - DNA, 20 bp, Artificial Sequence
  sgRNA
gcggagttcgagacactcat

SEQ ID NO: 6101 - DNA, 20 bp, Artificial Sequence
  sgRNA
cacggttcccacaatactcc

SEQ ID NO: 6102 - DNA, 20 bp, Artificial Sequence
  sgRNA
aaagccctggacctgtgcac

SEQ ID NO: 6103 - DNA, 20 bp, Artificial Sequence
  sgRNA
ttgcagaaacttggtgagat

SEQ ID NO: 6104 - DNA, 20 bp, Artificial Sequence
  sgRNA
acaaacgcagggcggaaata

SEQ ID NO: 6105 - DNA, 20 bp, Artificial Sequence
  sgRNA
ctgagacagtgcggtgacaa

SEQ ID NO: 6106 - DNA, 20 bp, Artificial Sequence
  sgRNA
ggagtatctttagaacatcc

SEQ ID NO: 6107 - DNA, 20 bp, Artificial Sequence
  sgRNA
gcggcggtcgggccattgtg

SEQ ID NO: 6108 - DNA, 20 bp, Artificial Sequence
  sgRNA
cgatgggctggcaaccgagg

SEQ ID NO: 6109 - DNA, 20 bp, Artificial Sequence
  sgRNA
gcaggaggagcgcagccggg

SEQ ID NO: 6110 - DNA, 20 bp, Artificial Sequence
  sgRNA
aaaccacgacctggctccac

SEQ ID NO: 6111 - DNA, 20 bp, Artificial Sequence
  sgRNA
taggccagccaatcagaact

SEQ ID NO: 6112 - DNA, 20 bp, Artificial Sequence
  sgRNA
tgagcagtcggtgccggtgc

SEQ ID NO: 6113 - DNA, 20 bp, Artificial Sequence
  sgRNA
cactggaaatatggcagggc

SEQ ID NO: 6114 - DNA, 20 bp, Artificial Sequence
  sgRNA
tctggtcccggtctccgagc

SEQ ID NO: 6115 - DNA, 20 bp, Artificial Sequence
  sgRNA
aacaatcacagatgaagtca

SEQ ID NO: 6116 - DNA, 20 bp, Artificial Sequence
  sgRNA
cagacggcgagccgcctagg

SEQ ID NO: 6117 - DNA, 20 bp, Artificial Sequence
  sgRNA
acactgcactctttcgggtc

SEQ ID NO: 6118 - DNA, 20 bp, Artificial Sequence
  sgRNA
tatcactcctctgcagcaga

SEQ ID NO: 6119 - DNA, 20 bp, Artificial Sequence
  sgRNA
tttccggcgagctgcatacg

SEQ ID NO: 6120 - DNA, 20 bp, Artificial Sequence
  sgRNA
aaggttcgcgaagtgccgct

SEQ ID NO: 6121 - DNA, 20 bp, Artificial Sequence
  sgRNA
aaggccgtttgcgacgcgaa

SEQ ID NO: 6122 - DNA, 20 bp, Artificial Sequence
  sgRNA
acggtagcagcgcagcggca

SEQ ID NO: 6123 - DNA, 20 bp, Artificial Sequence
  sgRNA
aacacaatcaagaaacagtt

SEQ ID NO: 6124 - DNA, 20 bp, Artificial Sequence
  sgRNA
atctgagattaaagatgtgg

SEQ ID NO: 6125 - DNA, 20 bp, Artificial Sequence
  sgRNA
atgaaggactctaagcccag

SEQ ID NO: 6126 - DNA, 20 bp, Artificial Sequence
  sgRNA
gggcagctggccaaggccta

SEQ ID NO: 6127 - DNA, 20 bp, Artificial Sequence
  sgRNA
gggaggagggcagtgggttt

SEQ ID NO: 6128 - DNA, 20 bp, Artificial Sequence
  sgRNA
cgcccactgtatatttagat

SEQ ID NO: 6129 - DNA, 20 bp, Artificial Sequence
  sgRNA
atcggatcaatagcagtctg

SEQ ID NO: 6130 - DNA, 20 bp, Artificial Sequence
  sgRNA
aacagagggtgcgtgcgaga

SEQ ID NO: 6131 - DNA, 20 bp, Artificial Sequence
  sgRNA
gcagctgacctcttgaccac

SEQ ID NO: 6132 - DNA, 20 bp, Artificial Sequence
  sgRNA
ggtagggaggactgcgtggg

SEQ ID NO: 6133 - DNA, 20 bp, Artificial Sequence
  sgRNA
ctggacagctggctttggtg

SEQ ID NO: 6134 - DNA, 20 bp, Artificial Sequence
  sgRNA
ggcttcattcataattacaa

SEQ ID NO: 6135 - DNA, 20 bp, Artificial Sequence
  sgRNA
taagatagatgccatttcaa

SEQ ID NO: 6136 - DNA, 20 bp, Artificial Sequence
  sgRNA
ttctcggcgtctagcagcct

SEQ ID NO: 6137 - DNA, 20 bp, Artificial Sequence
  sgRNA
ttctgtaggttgtaggaccc

SEQ ID NO: 6138 - DNA, 20 bp, Artificial Sequence
  sgRNA
tcgggaccaatgagctgcgc

SEQ ID NO: 6139 - DNA, 20 bp, Artificial Sequence
  sgRNA
acacgaattcgacaccgccc

SEQ ID NO: 6140 - DNA, 20 bp, Artificial Sequence
  sgRNA
gttaggctcccttgctaagg

SEQ ID NO: 6141 - DNA, 20 bp, Artificial Sequence
  sgRNA
agagcagggcgcgctgtgat

SEQ ID NO: 6142 - DNA, 20 bp, Artificial Sequence
  sgRNA
cacggcctgctggactagcc

SEQ ID NO: 6143 - DNA, 20 bp, Artificial Sequence
  sgRNA
agtgaatgcgctcagcttga

SEQ ID NO: 6144 - DNA, 20 bp, Artificial Sequence
  sgRNA
cggttggttgtgggttcccg

SEQ ID NO: 6145 - DNA, 20 bp, Artificial Sequence
  sgRNA
ctggacattctattgtgtcc

SEQ ID NO: 6146 - DNA, 20 bp, Artificial Sequence
  sgRNA
cgggcgcagccctccgtaca

SEQ ID NO: 6147 - DNA, 20 bp, Artificial Sequence
  sgRNA
gtccggaggacgtcacactg

SEQ ID NO: 6148 - DNA, 20 bp, Artificial Sequence
  sgRNA
gttgctgcaggacgcagtcg

SEQ ID NO: 6149 - DNA, 20 bp, Artificial Sequence
  sgRNA
ggcagggcagtagtagaaag

SEQ ID NO: 6150 - DNA, 20 bp, Artificial Sequence
  sgRNA
cctggcactctttgatgaag

SEQ ID NO: 6151 - DNA, 20 bp, Artificial Sequence
  sgRNA
cgggcggctggcgagggact

SEQ ID NO: 6152 - DNA, 20 bp, Artificial Sequence
  sgRNA
gtttccgcatacccagcttc

SEQ ID NO: 6153 - DNA, 20 bp, Artificial Sequence
  sgRNA
ggttagcactcgtgattctg

SEQ ID NO: 6154 - DNA, 20 bp, Artificial Sequence
  sgRNA
cttctggcgtggagcgccgc

SEQ ID NO: 6155 - DNA, 20 bp, Artificial Sequence
  sgRNA
ggaggaggagacacctcagc

SEQ ID NO: 6156 - DNA, 20 bp, Artificial Sequence
  sgRNA
ccacctgagtcaaacagaac

SEQ ID NO: 6157 - DNA, 20 bp, Artificial Sequence
  sgRNA
actcttcggtaggacgatag

SEQ ID NO: 6158 - DNA, 20 bp, Artificial Sequence
  sgRNA
agcgccgcccacttggccag

SEQ ID NO: 6159 - DNA, 20 bp, Artificial Sequence
  sgRNA
ctcccagagccttctgtccc

SEQ ID NO: 6160 - DNA, 20 bp, Artificial Sequence
  sgRNA
gcgccctgcgacgcaccagt

SEQ ID NO: 6161 - DNA, 20 bp, Artificial Sequence
  sgRNA
cgcgtgtcttctgtaggatg

SEQ ID NO: 6162 - DNA, 20 bp, Artificial Sequence
  sgRNA
gttggcactgattgttcctg

SEQ ID NO: 6163 - DNA, 20 bp, Artificial Sequence
  sgRNA
agcgaggctcgatccggcct

SEQ ID NO: 6164 - DNA, 20 bp, Artificial Sequence
  sgRNA
ggatcctcatcctaaccaag

SEQ ID NO: 6165 - DNA, 20 bp, Artificial Sequence
  sgRNA
ggtttcctagctacatcttg

SEQ ID NO: 6166 - DNA, 20 bp, Artificial Sequence
  sgRNA
agataactgtgtaagagctc

SEQ ID NO: 6167 - DNA, 20 bp, Artificial Sequence
  sgRNA
cccgcacaatagcggtggga

SEQ ID NO: 6168 - DNA, 20 bp, Artificial Sequence
  sgRNA
aatggcagtctttctttccc

SEQ ID NO: 6169 - DNA, 20 bp, Artificial Sequence
  sgRNA
tgaaggcgagggctggaaag

SEQ ID NO: 6170 - DNA, 20 bp, Artificial Sequence
  sgRNA
ctgtcacgcggtctgcttgc

SEQ ID NO: 6171 - DNA, 20 bp, Artificial Sequence
  sgRNA
aaagggaggagacaaacgtt

SEQ ID NO: 6172 - DNA, 20 bp, Artificial Sequence
  sgRNA
cctgcagagattccatagcc

SEQ ID NO: 6173 - DNA, 20 bp, Artificial Sequence
  sgRNA
tacgcgcttgagtgcgcgag

SEQ ID NO: 6174 - DNA, 20 bp, Artificial Sequence
  sgRNA
ttggaagggagaaagactta

SEQ ID NO: 6175 - DNA, 20 bp, Artificial Sequence
  sgRNA
agcgctcgcggaacgcaacc

SEQ ID NO: 6176 - DNA, 20 bp, Artificial Sequence
  sgRNA
ccgctctccattcataaatc

SEQ ID NO: 6177 - DNA, 20 bp, Artificial Sequence
  sgRNA
gacgcgcatgcgtgtctcca

SEQ ID NO: 6178 - DNA, 20 bp, Artificial Sequence
  sgRNA
aaaggccaccagcactgaaa

SEQ ID NO: 6179 - DNA, 20 bp, Artificial Sequence
  sgRNA
ggcctcagagcaggaactaa

SEQ ID NO: 6180 - DNA, 20 bp, Artificial Sequence
  sgRNA
gggcgcgaggaacccaggga

SEQ ID NO: 6181 - DNA, 20 bp, Artificial Sequence
  sgRNA
gcaaagcaaagaattcaatc

SEQ ID NO: 6182 - DNA, 20 bp, Artificial Sequence
  sgRNA
tttataacgtgtcgttgaga

SEQ ID NO: 6183 - DNA, 20 bp, Artificial Sequence
  sgRNA
ctctcaacactgagtcacgc

SEQ ID NO: 6184 - DNA, 20 bp, Artificial Sequence
  sgRNA
gttcccagtgaggtttgtcc

SEQ ID NO: 6185 - DNA, 20 bp, Artificial Sequence
  sgRNA
aacataagcacccatcagct

SEQ ID NO: 6186 - DNA, 20 bp, Artificial Sequence
  sgRNA
aacatgcgctcctgggaaga

SEQ ID NO: 6187 - DNA, 20 bp, Artificial Sequence
  sgRNA
aaggcagggtctgagagcac

SEQ ID NO: 6188 - DNA, 20 bp, Artificial Sequence
  sgRNA
aagtacagtggagctacagc

SEQ ID NO: 6189 - DNA, 20 bp, Artificial Sequence
  sgRNA
gacagggtatcctagcggag

SEQ ID NO: 6190 - DNA, 20 bp, Artificial Sequence
  sgRNA
gatgtgatcgcagcggtgat

SEQ ID NO: 6191 - DNA, 20 bp, Artificial Sequence
  sgRNA
gctctcgaccaatcggcgct

SEQ ID NO: 6192 - DNA, 20 bp, Artificial Sequence
  sgRNA
actaattggagcccatgaga

SEQ ID NO: 6193 - DNA, 20 bp, Artificial Sequence
  sgRNA
gccgatggatcttgtcgacg

SEQ ID NO: 6194 - DNA, 20 bp, Artificial Sequence
  sgRNA
agccatcttgagttccggcc

SEQ ID NO: 6195 - DNA, 20 bp, Artificial Sequence
  sgRNA
cgccgtgcggagtccttcct

SEQ ID NO: 6196 - DNA, 20 bp, Artificial Sequence
  sgRNA
tccatgggcagtcctattat

SEQ ID NO: 6197 - DNA, 20 bp, Artificial Sequence
  sgRNA
tttgccttggttcccggagc

SEQ ID NO: 6198 - DNA, 20 bp, Artificial Sequence
  sgRNA
gcagagtagggtttcaaagc

SEQ ID NO: 6199 - DNA, 20 bp, Artificial Sequence
  sgRNA
aggtgcagtgtgtgtcacgc

SEQ ID NO: 6200 - DNA, 20 bp, Artificial Sequence
  sgRNA
aacactcctgtcacccattt

SEQ ID NO: 6201 - DNA, 20 bp, Artificial Sequence
  sgRNA
acactcaagagttcttgacc

SEQ ID NO: 6202 - DNA, 20 bp, Artificial Sequence
  sgRNA
tttccctaagaagtcaagta

SEQ ID NO: 6203 - DNA, 20 bp, Artificial Sequence
  sgRNA
gcggctttctctagcccggt

SEQ ID NO: 6204 - DNA, 20 bp, Artificial Sequence
  sgRNA
atatatgatagtagcgttag

SEQ ID NO: 6205 - DNA, 20 bp, Artificial Sequence
  sgRNA
taacctagtggctgtgttgg

SEQ ID NO: 6206 - DNA, 20 bp, Artificial Sequence
  sgRNA
cgtggtgcgcccacacttcc

SEQ ID NO: 6207 - DNA, 20 bp, Artificial Sequence
  sgRNA
tccctaaaggcaattcaagc

SEQ ID NO: 6208 - DNA, 20 bp, Artificial Sequence
  sgRNA
ggcgtgacgtcgccacgcgc

SEQ ID NO: 6209 - DNA, 20 bp, Artificial Sequence
  sgRNA
ccctggcttgtaaggcagga

SEQ ID NO: 6210 - DNA, 20 bp, Artificial Sequence
  sgRNA
ctagagtaggagtatacttt

SEQ ID NO: 6211 - DNA, 20 bp, Artificial Sequence
  sgRNA
aggccatgatggactccgcg

SEQ ID NO: 6212 - DNA, 20 bp, Artificial Sequence
  sgRNA
tggtggagcgtcacgtcgcc

SEQ ID NO: 6213 - DNA, 20 bp, Artificial Sequence
  sgRNA
ggatgggaggatagtcagag

SEQ ID NO: 6214 - DNA, 20 bp, Artificial Sequence
  sgRNA
gtttgcacctagaaggtgtt

SEQ ID NO: 6215 - DNA, 20 bp, Artificial Sequence
  sgRNA
agaccgcctaaaggcgaagc

SEQ ID NO: 6216 - DNA, 20 bp, Artificial Sequence
  sgRNA
gatattaatgaacctccaag

SEQ ID NO: 6217 - DNA, 20 bp, Artificial Sequence
  sgRNA
gggacccggtctattgtcaa

SEQ ID NO: 6218 - DNA, 20 bp, Artificial Sequence
  sgRNA
gacgcaccacggagccggac

SEQ ID NO: 6219 - DNA, 20 bp, Artificial Sequence
  sgRNA
tacgtagctggcgggctctg

SEQ ID NO: 6220 - DNA, 20 bp, Artificial Sequence
  sgRNA
ataagagcaagagagagctt

SEQ ID NO: 6221 - DNA, 20 bp, Artificial Sequence
  sgRNA
cattgcgggtagcaactgag

SEQ ID NO: 6222 - DNA, 20 bp, Artificial Sequence
  sgRNA
atgcagacatggagtctctc

SEQ ID NO: 6223 - DNA, 20 bp, Artificial Sequence
  sgRNA
agaggtagttaagccaatcc

SEQ ID NO: 6224 - DNA, 20 bp, Artificial Sequence
  sgRNA
agtaaacgctactacttgat

SEQ ID NO: 6225 - DNA, 20 bp, Artificial Sequence
  sgRNA
aagggcagggacggtactca

SEQ ID NO: 6226 - DNA, 20 bp, Artificial Sequence
  sgRNA
taagggaggaagggtcccgg

SEQ ID NO: 6227 - DNA, 20 bp, Artificial Sequence
  sgRNA
cctgattggttgccaagagg

SEQ ID NO: 6228 - DNA, 20 bp, Artificial Sequence
  sgRNA
gcacaggacatgatgctcct

SEQ ID NO: 6229 - DNA, 20 bp, Artificial Sequence
  sgRNA
gtggccgaagaggagcgaac

SEQ ID NO: 6230 - DNA, 20 bp, Artificial Sequence
  sgRNA
ctacttgacagaattccaaa

SEQ ID NO: 6231 - DNA, 20 bp, Artificial Sequence
  sgRNA
gcacagagtctccgctactc

SEQ ID NO: 6232 - DNA, 20 bp, Artificial Sequence
  sgRNA
tgtgtcaggattgtgtggcc

SEQ ID NO: 6233 - DNA, 20 bp, Artificial Sequence
  sgRNA
taagctaggaaagatggagg

SEQ ID NO: 6234 - DNA, 20 bp, Artificial Sequence
  sgRNA
gaactacctacaggcacaga

SEQ ID NO: 6235 - DNA, 20 bp, Artificial Sequence
  sgRNA
taacaatgtcctgcgtttcc

SEQ ID NO: 6236 - DNA, 20 bp, Artificial Sequence
  sgRNA
ctgggctggcagtaggacaa

SEQ ID NO: 6237 - DNA, 20 bp, Artificial Sequence
  sgRNA
ggtggtgcagcaggtgccca

SEQ ID NO: 6238 - DNA, 20 bp, Artificial Sequence
  sgRNA
aattcctgccatgctgccct

SEQ ID NO: 6239 - DNA, 20 bp, Artificial Sequence
  sgRNA
ggtggagtttccgaccgggc

SEQ ID NO: 6240 - DNA, 20 bp, Artificial Sequence
  sgRNA
ttactatggacgtgagatgt

SEQ ID NO: 6241 - DNA, 20 bp, Artificial Sequence
  sgRNA
gggtgctgacctgcgcaccc

SEQ ID NO: 6242 - DNA, 20 bp, Artificial Sequence
  sgRNA
ttgaggagtaaatagcacct

SEQ ID NO: 6243 - DNA, 20 bp, Artificial Sequence
  sgRNA
ccggatgcggctgtcctcta

SEQ ID NO: 6244 - DNA, 20 bp, Artificial Sequence
  sgRNA
aaagcaggtgttaagggaac

SEQ ID NO: 6245 - DNA, 20 bp, Artificial Sequence
  sgRNA
catgacctcgcgcagggaaa

SEQ ID NO: 6246 - DNA, 20 bp, Artificial Sequence
  sgRNA
aaagcactcagttagctggc

SEQ ID NO: 6247 - DNA, 20 bp, Artificial Sequence
  sgRNA
gctcagcccaagagattgtc

SEQ ID NO: 6248 - DNA, 20 bp, Artificial Sequence
  sgRNA
ttcttctattacaggtggcc

SEQ ID NO: 6249 - DNA, 20 bp, Artificial Sequence
  sgRNA
agctgggcgactggaaccaa

SEQ ID NO: 6250 - DNA, 20 bp, Artificial Sequence
  sgRNA
ttgtctgctgaaccaaagcg

SEQ ID NO: 6251 - DNA, 20 bp, Artificial Sequence
  sgRNA
gcggcctgccactcacgcgc

SEQ ID NO: 6252 - DNA, 20 bp, Artificial Sequence
  sgRNA
catgtgtttacatatctatc

SEQ ID NO: 6253 - DNA, 20 bp, Artificial Sequence
  sgRNA
ctgctttgtgctggttctta

SEQ ID NO: 6254 - DNA, 20 bp, Artificial Sequence
  sgRNA
ctctcgcctgggcgcggaaa

SEQ ID NO: 6255 - DNA, 20 bp, Artificial Sequence
  sgRNA
aagtaggagcaacttcctca

SEQ ID NO: 6256 - DNA, 20 bp, Artificial Sequence
  sgRNA
ggaacagatggcaagagacc

SEQ ID NO: 6257 - DNA, 20 bp, Artificial Sequence
  sgRNA
cgcagagaactcgagccgga

SEQ ID NO: 6258 - DNA, 20 bp, Artificial Sequence
  sgRNA
ggcggagcatagcgaggact

SEQ ID NO: 6259 - DNA, 20 bp, Artificial Sequence
  sgRNA
tactccaggtacctacaagt

SEQ ID NO: 6260 - DNA, 20 bp, Artificial Sequence
  sgRNA
gagccaatcagagctggcgg

SEQ ID NO: 6261 - DNA, 20 bp, Artificial Sequence
  sgRNA
gtatgtgaaatgtatttcgt

SEQ ID NO: 6262 - DNA, 20 bp, Artificial Sequence
  sgRNA
cgctccgcctaagaagtgcg

SEQ ID NO: 6263 - DNA, 20 bp, Artificial Sequence
  sgRNA
cgagcgccctcagctacacc

SEQ ID NO: 6264 - DNA, 20 bp, Artificial Sequence
  sgRNA
gtgttgttagaaggagaagc

SEQ ID NO: 6265 - DNA, 20 bp, Artificial Sequence
  sgRNA
agccctggcgaaggcactac

SEQ ID NO: 6266 - DNA, 20 bp, Artificial Sequence
  sgRNA
tgcgcacaaagccgccacgg

SEQ ID NO: 6267 - DNA, 20 bp, Artificial Sequence
  sgRNA
gaagcgtgaagtacaaggcg

SEQ ID NO: 6268 - DNA, 20 bp, Artificial Sequence
  sgRNA
cggctccttcgttgggatcc

SEQ ID NO: 6269 - DNA, 20 bp, Artificial Sequence
  sgRNA
caagtctgagttggagctgg

SEQ ID NO: 6270 - DNA, 20 bp, Artificial Sequence
  sgRNA
gaaggatgtgaatgagccag

SEQ ID NO: 6271 - DNA, 20 bp, Artificial Sequence
  sgRNA
tggcgcaagtcggccggagg

SEQ ID NO: 6272 - DNA, 20 bp, Artificial Sequence
  sgRNA
catgcgagaacgctcaacca

SEQ ID NO: 6273 - DNA, 20 bp, Artificial Sequence
  sgRNA
tatgatgacgccttgtcctg

SEQ ID NO: 6274 - DNA, 20 bp, Artificial Sequence
  sgRNA
cagacacagatatagagatt

SEQ ID NO: 6275 - DNA, 20 bp, Artificial Sequence
  sgRNA
gaaagagattccctgctccc

SEQ ID NO: 6276 - DNA, 20 bp, Artificial Sequence
  sgRNA
gcagcggcacctgtacttgc

SEQ ID NO: 6277 - DNA, 20 bp, Artificial Sequence
  sgRNA
cttgcagagtttgtgaagcg

SEQ ID NO: 6278 - DNA, 20 bp, Artificial Sequence
  sgRNA
agaagttgaaatctagaact

SEQ ID NO: 6279 - DNA, 20 bp, Artificial Sequence
  sgRNA
gcctgcgctcgcagtgcttg

SEQ ID NO: 6280 - DNA, 20 bp, Artificial Sequence
  sgRNA
ctactttctctgcacgtggg

SEQ ID NO: 6281 - DNA, 20 bp, Artificial Sequence
  sgRNA
gatggccttggccctaactg

SEQ ID NO: 6282 - DNA, 20 bp, Artificial Sequence
  sgRNA
gatcttcacgtcccaagctg

SEQ ID NO: 6283 - DNA, 20 bp, Artificial Sequence
  sgRNA
tggtgacctggaggacaatg

SEQ ID NO: 6284 - DNA, 20 bp, Artificial Sequence
  sgRNA
gaatgaatcacagtgagagt

SEQ ID NO: 6285 - DNA, 20 bp, Artificial Sequence
  sgRNA
cccgggcgctgagttgggcg

SEQ ID NO: 6286 - DNA, 20 bp, Artificial Sequence
  sgRNA
tctgcgtgggttcccttctc

SEQ ID NO: 6287 - DNA, 20 bp, Artificial Sequence
  sgRNA
tgacagaccaggagagcaag

SEQ ID NO: 6288 - DNA, 20 bp, Artificial Sequence
  sgRNA
agactgctgtgacgaccaat

SEQ ID NO: 6289 - DNA, 20 bp, Artificial Sequence
  sgRNA
attagctttctcggcttcta

SEQ ID NO: 6290 - DNA, 20 bp, Artificial Sequence
  sgRNA
gagcgagcgcagcgcagcag

SEQ ID NO: 6291 - DNA, 20 bp, Artificial Sequence
  sgRNA
tgtgacaccagctttcttaa

SEQ ID NO: 6292 - DNA, 20 bp, Artificial Sequence
  sgRNA
cagtgtcgcggtgaccttta

SEQ ID NO: 6293 - DNA, 20 bp, Artificial Sequence
  sgRNA
atgaatgccttcaagtctga

SEQ ID NO: 6294 - DNA, 20 bp, Artificial Sequence
  sgRNA
ctaggacgcggtaacatggt

SEQ ID NO: 6295 - DNA, 20 bp, Artificial Sequence
  sgRNA
ccgccaccacgcctttatga

SEQ ID NO: 6296 - DNA, 20 bp, Artificial Sequence
  sgRNA
gggcgtcttgggcgagcttg

SEQ ID NO: 6297 - DNA, 20 bp, Artificial Sequence
  sgRNA
ggcacgtgcggcgcgtgcgc

SEQ ID NO: 6298 - DNA, 20 bp, Artificial Sequence
  sgRNA
gcagagcctcgtggctgtgg

SEQ ID NO: 6299 - DNA, 20 bp, Artificial Sequence
  sgRNA
cgggtaacccacagacttgt

SEQ ID NO: 6300 - DNA, 20 bp, Artificial Sequence
  sgRNA
acggtgaataatcaaactgg

SEQ ID NO: 6301 - DNA, 20 bp, Artificial Sequence
  sgRNA
gcgaatgaaacccttccggg

SEQ ID NO: 6302 - DNA, 20 bp, Artificial Sequence
  sgRNA
gtttgtgggcgttgcatagg

SEQ ID NO: 6303 - DNA, 20 bp, Artificial Sequence
  sgRNA
agacaatagaatgtccagga

SEQ ID NO: 6304 - DNA, 20 bp, Artificial Sequence
  sgRNA
taatcaatcaccgctctaaa

SEQ ID NO: 6305 - DNA, 20 bp, Artificial Sequence
  sgRNA
ggtcccagacgactagactt

SEQ ID NO: 6306 - DNA, 20 bp, Artificial Sequence
  sgRNA
acactcaccagagctactgt

SEQ ID NO: 6307 - DNA, 20 bp, Artificial Sequence
  sgRNA
tcagttccgcagcttaagga

SEQ ID NO: 6308 - DNA, 20 bp, Artificial Sequence
  sgRNA
agcagtaagcacagtgtgcc

SEQ ID NO: 6309 - DNA, 20 bp, Artificial Sequence
  sgRNA
gcgcactaagctgactgcgc

SEQ ID NO: 6310 - DNA, 20 bp, Artificial Sequence
  sgRNA
agagagcgggaatgctgttc

SEQ ID NO: 6311 - DNA, 20 bp, Artificial Sequence
  sgRNA
ccttctcttcttcatgggac

SEQ ID NO: 6312 - DNA, 20 bp, Artificial Sequence
  sgRNA
cagaaacataggctcgcccg

SEQ ID NO: 6313 - DNA, 20 bp, Artificial Sequence
  sgRNA
ctcggatcggcgggaggcag

SEQ ID NO: 6314 - DNA, 20 bp, Artificial Sequence
  sgRNA
caattggtccctccgagagg

SEQ ID NO: 6315 - DNA, 20 bp, Artificial Sequence
  sgRNA
aggtttagggtctatggact

SEQ ID NO: 6316 - DNA, 20 bp, Artificial Sequence
  sgRNA
tgctagctgacaaatagact

SEQ ID NO: 6317 - DNA, 20 bp, Artificial Sequence
  sgRNA
gggccttgtttgtgccctgt

SEQ ID NO: 6318 - DNA, 20 bp, Artificial Sequence
  sgRNA
cctgtgagggcaagcaggag

SEQ ID NO: 6319 - DNA, 20 bp, Artificial Sequence
  sgRNA
cctcccaagcctccaggaca

SEQ ID NO: 6320 - DNA, 20 bp, Artificial Sequence
  sgRNA
gacgccaaacagaccaatcg

SEQ ID NO: 6321 - DNA, 20 bp, Artificial Sequence
  sgRNA
gcgggcggccctgcaggctg

SEQ ID NO: 6322 - DNA, 20 bp, Artificial Sequence
  sgRNA
gggacgagtggaacatcgcg

SEQ ID NO: 6323 - DNA, 20 bp, Artificial Sequence
  sgRNA
cgtggcacaaggaagaagag

SEQ ID NO: 6324 - DNA, 20 bp, Artificial Sequence
  sgRNA
ggccaatcagctgttcgcag

SEQ ID NO: 6325 - DNA, 20 bp, Artificial Sequence
  sgRNA
aatctaaagagttgtcccag

SEQ ID NO: 6326 - DNA, 20 bp, Artificial Sequence
  sgRNA
agtgctgaggtgtcccacgt

SEQ ID NO: 6327 - DNA, 20 bp, Artificial Sequence
  sgRNA
cgagagcgcggctcgcgagt

SEQ ID NO: 6328 - DNA, 20 bp, Artificial Sequence
  sgRNA
catatctggtgattaaatca

SEQ ID NO: 6329 - DNA, 20 bp, Artificial Sequence
  sgRNA
gtgctgcagggaatgtatgg

SEQ ID NO: 6330 - DNA, 20 bp, Artificial Sequence
  sgRNA
gactgtcataggacagctct

SEQ ID NO: 6331 - DNA, 20 bp, Artificial Sequence
  sgRNA
aggtggtgctgtctatccct

SEQ ID NO: 6332 - DNA, 20 bp, Artificial Sequence
  sgRNA
tacagttaccctgatgggcg

SEQ ID NO: 6333 - DNA, 20 bp, Artificial Sequence
  sgRNA
ttctagcgattgttaacgcc

SEQ ID NO: 6334 - DNA, 20 bp, Artificial Sequence
  sgRNA
aagctgatgaggccaggcgt

SEQ ID NO: 6335 - DNA, 20 bp, Artificial Sequence
  sgRNA
caccagattgtcagttattc

SEQ ID NO: 6336 - DNA, 20 bp, Artificial Sequence
  sgRNA
cacagcgaggccaaggcggc

SEQ ID NO: 6337 - DNA, 20 bp, Artificial Sequence
  sgRNA
catcacctgctgtgaaatgt

SEQ ID NO: 6338 - DNA, 20 bp, Artificial Sequence
  sgRNA
gctgaggaggcggagctccc

SEQ ID NO: 6339 - DNA, 20 bp, Artificial Sequence
  sgRNA
taattgtgacgcaccaaggc

SEQ ID NO: 6340 - DNA, 20 bp, Artificial Sequence
  sgRNA
cacacatcccagattgaggg

SEQ ID NO: 6341 - DNA, 20 bp, Artificial Sequence
  sgRNA
gctggcaggaaggtcggctg

SEQ ID NO: 6342 - DNA, 20 bp, Artificial Sequence
  sgRNA
actcgcaacccgactccgct

SEQ ID NO: 6343 - DNA, 20 bp, Artificial Sequence
  sgRNA
tctgggcggataggtgggtg

SEQ ID NO: 6344 - DNA, 20 bp, Artificial Sequence
  sgRNA
gaccggtcccgtagagtgta

SEQ ID NO: 6345 - DNA, 20 bp, Artificial Sequence
  sgRNA
ggagtcacgcctccggttcc

SEQ ID NO: 6346 - DNA, 20 bp, Artificial Sequence
  sgRNA
ctgaaaggcgcaccctgccc

SEQ ID NO: 6347 - DNA, 20 bp, Artificial Sequence
  sgRNA
tcaccgggctgggccactgc

SEQ ID NO: 6348 - DNA, 20 bp, Artificial Sequence
  sgRNA
tgagtggctgcgaaagggtg

SEQ ID NO: 6349 - DNA, 20 bp, Artificial Sequence
  sgRNA
catgattctgcaagccttac

SEQ ID NO: 6350 - DNA, 20 bp, Artificial Sequence
  sgRNA
gctctgttaggaaggcatga

SEQ ID NO: 6351 - DNA, 20 bp, Artificial Sequence
  sgRNA
gtttcttcccatcaatgtcc

SEQ ID NO: 6352 - DNA, 20 bp, Artificial Sequence
  sgRNA
gtgcccgcggcagctccggt

SEQ ID NO: 6353 - DNA, 20 bp, Artificial Sequence
  sgRNA
tcaaagatacactgcctccc

SEQ ID NO: 6354 - DNA, 20 bp, Artificial Sequence
  sgRNA
ctgaatgaggcgccgcgcgg

SEQ ID NO: 6355 - DNA, 20 bp, Artificial Sequence
  sgRNA
tgtctgatgcacagattact

SEQ ID NO: 6356 - DNA, 20 bp, Artificial Sequence
  sgRNA
gaggctgttccctagcgccg

SEQ ID NO: 6357 - DNA, 20 bp, Artificial Sequence
  sgRNA
cagcttcgcctttgcgcaac

SEQ ID NO: 6358 - DNA, 20 bp, Artificial Sequence
  sgRNA
tccatcatgacctttcaagg

SEQ ID NO: 6359 - DNA, 20 bp, Artificial Sequence
  sgRNA
aggaggagggaggccgacgc

SEQ ID NO: 6360 - DNA, 20 bp, Artificial Sequence
  sgRNA
gtctgcaatatgctgggacc

SEQ ID NO: 6361 - DNA, 20 bp, Artificial Sequence
  sgRNA
agagcgaagcttgcgctttg

SEQ ID NO: 6362 - DNA, 20 bp, Artificial Sequence
  sgRNA
cccaccgcgtatgcaaaggc

SEQ ID NO: 6363 - DNA, 20 bp, Artificial Sequence
  sgRNA
aagggttgctgacagatagg

SEQ ID NO: 6364 - DNA, 20 bp, Artificial Sequence
  sgRNA
agagccaaagggttaggaac

SEQ ID NO: 6365 - DNA, 20 bp, Artificial Sequence
  sgRNA
gcgtaatcttactgcatccc

SEQ ID NO: 6366 - DNA, 20 bp, Artificial Sequence
  sgRNA
agtgggttctctataggcgg

SEQ ID NO: 6367 - DNA, 20 bp, Artificial Sequence
  sgRNA
aaagatggcgactgcacacc

SEQ ID NO: 6368 - DNA, 20 bp, Artificial Sequence
  sgRNA
gcgagagaggagggagcctg

SEQ ID NO: 6369 - DNA, 20 bp, Artificial Sequence
  sgRNA
cgtcgctttacggccggagg

SEQ ID NO: 6370 - DNA, 20 bp, Artificial Sequence
  sgRNA
cgagtgacgcggcgccagcc

SEQ ID NO: 6371 - DNA, 20 bp, Artificial Sequence
  sgRNA
aacgggagataggcggagtc

SEQ ID NO: 6372 - DNA, 20 bp, Artificial Sequence
  sgRNA
aggtctgcacttgtccgctc

SEQ ID NO: 6373 - DNA, 20 bp, Artificial Sequence
  sgRNA
caatcgctgttgccctgccg

SEQ ID NO: 6374 - DNA, 20 bp, Artificial Sequence
  sgRNA
gggcgccaaattcaaatctg

SEQ ID NO: 6375 - DNA, 20 bp, Artificial Sequence
  sgRNA
tcgaccctgatacttgattg

SEQ ID NO: 6376 - DNA, 20 bp, Artificial Sequence
  sgRNA
ggatgtgtgggtcatgtggg

SEQ ID NO: 6377 - DNA, 20 bp, Artificial Sequence
  sgRNA
ctgagatgaaatcatctcgg

SEQ ID NO: 6378 - DNA, 20 bp, Artificial Sequence
  sgRNA
ccgcccatccgagccaacac

SEQ ID NO: 6379 - DNA, 20 bp, Artificial Sequence
  sgRNA
tgggtttgaaattctctatc

SEQ ID NO: 6380 - DNA, 20 bp, Artificial Sequence
  sgRNA
aaaggactgcggtttcccgc

SEQ ID NO: 6381 - DNA, 20 bp, Artificial Sequence
  sgRNA
cacatgtatacagtatttgt

SEQ ID NO: 6382 - DNA, 20 bp, Artificial Sequence
  sgRNA
gggctaagtggctacccgct

SEQ ID NO: 6383 - DNA, 20 bp, Artificial Sequence
  sgRNA
ccttagggaggcaaggcgtg

SEQ ID NO: 6384 - DNA, 20 bp, Artificial Sequence
  sgRNA
ctctctgataatcttaacaa

SEQ ID NO: 6385 - DNA, 20 bp, Artificial Sequence
  sgRNA
gaatctgagcgcgaccgaga

SEQ ID NO: 6386 - DNA, 20 bp, Artificial Sequence
  sgRNA
ggagggccgggcgtcagagc

SEQ ID NO: 6387 - DNA, 20 bp, Artificial Sequence
  sgRNA
gaatggaatctctctagagc

SEQ ID NO: 6388 - DNA, 20 bp, Artificial Sequence
  sgRNA
tcagcttctaataaccgcgc

SEQ ID NO: 6389 - DNA, 20 bp, Artificial Sequence
  sgRNA
ggtcactcggccaagacatc

SEQ ID NO: 6390 - DNA, 20 bp, Artificial Sequence
  sgRNA
gtctgcatggctatggcctc

SEQ ID NO: 6391 - DNA, 20 bp, Artificial Sequence
  sgRNA
ttcgactccatgcagtcgcc

SEQ ID NO: 6392 - DNA, 20 bp, Artificial Sequence
  sgRNA
aacgctaggagctctcttct

SEQ ID NO: 6393 - DNA, 20 bp, Artificial Sequence
  sgRNA
aagatcactcacaagtccac

SEQ ID NO: 6394 - DNA, 20 bp, Artificial Sequence
  sgRNA
ctgagaggcgtgacctgctc

SEQ ID NO: 6395 - DNA, 20 bp, Artificial Sequence
  sgRNA
tggttagaggtccagggccg

SEQ ID NO: 6396 - DNA, 20 bp, Artificial Sequence
  sgRNA
catcagagcatgcgcctcgc

SEQ ID NO: 6397 - DNA, 20 bp, Artificial Sequence
  sgRNA
cgcacgtgacccgcagtttg

SEQ ID NO: 6398 - DNA, 20 bp, Artificial Sequence
  sgRNA
cgccatggaggccaacgctg

SEQ ID NO: 6399 - DNA, 20 bp, Artificial Sequence
  sgRNA
gtctgctttccctcagtgtg

SEQ ID NO: 6400 - DNA, 20 bp, Artificial Sequence
  sgRNA
aatggctccgcgtcccaaag

SEQ ID NO: 6401 - DNA, 20 bp, Artificial Sequence
  sgRNA
acccggacggcggaaggctc

SEQ ID NO: 6402 - DNA, 20 bp, Artificial Sequence
  sgRNA
aactaggatgaagcctttga

SEQ ID NO: 6403 - DNA, 20 bp, Artificial Sequence
  sgRNA
ttactacgcgtagcttctgg

SEQ ID NO: 6404 - DNA, 20 bp, Artificial Sequence
  sgRNA
aagggagtgtgcggagtcta

SEQ ID NO: 6405 - DNA, 20 bp, Artificial Sequence
  sgRNA
tagaaggtaagggaaacgcc

SEQ ID NO: 6406 - DNA, 20 bp, Artificial Sequence
  sgRNA
tctctgtctctttgctactg

SEQ ID NO: 6407 - DNA, 20 bp, Artificial Sequence
  sgRNA
gtcaaagtaagtactttcca

SEQ ID NO: 6408 - DNA, 20 bp, Artificial Sequence
  sgRNA
ggatgggcctcctgaataag

SEQ ID NO: 6409 - DNA, 20 bp, Artificial Sequence
  sgRNA
tatcagagcttgagcgagcg

SEQ ID NO: 6410 - DNA, 20 bp, Artificial Sequence
  sgRNA
tgaggattctgatagcgcac

SEQ ID NO: 6411 - DNA, 20 bp, Artificial Sequence
  sgRNA
gacgcggcggactgaacgct

SEQ ID NO: 6412 - DNA, 20 bp, Artificial Sequence
  sgRNA
gttaaaggttggaggcggag

SEQ ID NO: 6413 - DNA, 20 bp, Artificial Sequence
  sgRNA
gggaggcctggcagcctgcc

SEQ ID NO: 6414 - DNA, 20 bp, Artificial Sequence
  sgRNA
ggtctgccacctgcatatgt

SEQ ID NO: 6415 - DNA, 20 bp, Artificial Sequence
  sgRNA
cccggctgcgggagcgggcc

SEQ ID NO: 6416 - DNA, 20 bp, Artificial Sequence
  sgRNA
cctctttctcctggatgacc

SEQ ID NO: 6417 - DNA, 20 bp, Artificial Sequence
  sgRNA
catcccaggtcaccctcgca

SEQ ID NO: 6418 - DNA, 20 bp, Artificial Sequence
  sgRNA
gaacatgacggctgtgggtg

SEQ ID NO: 6419 - DNA, 20 bp, Artificial Sequence
  sgRNA
ggttctaaggaacaagctga

SEQ ID NO: 6420 - DNA, 20 bp, Artificial Sequence
  sgRNA
tgtgtccgctaaccctaagc

SEQ ID NO: 6421 - DNA, 20 bp, Artificial Sequence
  sgRNA
ggacagagagggtgtcagac

SEQ ID NO: 6422 - DNA, 20 bp, Artificial Sequence
  sgRNA
aggaagcgcagctcagcgcc

SEQ ID NO: 6423 - DNA, 20 bp, Artificial Sequence
  sgRNA
tccgaagcttgttaagaacc

SEQ ID NO: 6424 - DNA, 20 bp, Artificial Sequence
  sgRNA
ggtcatagacagtggagcag

SEQ ID NO: 6425 - DNA, 20 bp, Artificial Sequence
  sgRNA
tcacgcggaggctgtgtcag

SEQ ID NO: 6426 - DNA, 20 bp, Artificial Sequence
  sgRNA
cccttgccaattagggcgcc

SEQ ID NO: 6427 - DNA, 20 bp, Artificial Sequence
  sgRNA
ggccaggcatagaaagtatg

SEQ ID NO: 6428 - DNA, 20 bp, Artificial Sequence
  sgRNA
cctggaaggtagacctagag

SEQ ID NO: 6429 - DNA, 20 bp, Artificial Sequence
  sgRNA
caacctagtcttagccattt

SEQ ID NO: 6430 - DNA, 20 bp, Artificial Sequence
  sgRNA
tgtggctgagttaggacact

SEQ ID NO: 6431 - DNA, 20 bp, Artificial Sequence
  sgRNA
ggaaacagacctcgcagcaa

SEQ ID NO: 6432 - DNA, 20 bp, Artificial Sequence
  sgRNA
agacaggcagtcataatcat

SEQ ID NO: 6433 - DNA, 20 bp, Artificial Sequence
  sgRNA
ctgggaggccctccgcgtcg

SEQ ID NO: 6434 - DNA, 20 bp, Artificial Sequence
  sgRNA
cttctagtcctagctctctc

SEQ ID NO: 6435 - DNA, 20 bp, Artificial Sequence
  sgRNA
tggtatgacttatccttact

SEQ ID NO: 6436 - DNA, 20 bp, Artificial Sequence
  sgRNA
ttctgccttcctcgtctaaa

SEQ ID NO: 6437 - DNA, 20 bp, Artificial Sequence
  sgRNA
atgtttaagaactgcagttg

SEQ ID NO: 6438 - DNA, 20 bp, Artificial Sequence
  sgRNA
ctcccgaatacatcataatt

SEQ ID NO: 6439 - DNA, 20 bp, Artificial Sequence
  sgRNA
ctgagccagtgcacagtgaa

SEQ ID NO: 6440 - DNA, 20 bp, Artificial Sequence
  sgRNA
tgtgagactgagtgagcttg

SEQ ID NO: 6441 - DNA, 20 bp, Artificial Sequence
  sgRNA
aacattcggaactggactga

SEQ ID NO: 6442 - DNA, 20 bp, Artificial Sequence
  sgRNA
gttcggcgtttcaaaggcag

SEQ ID NO: 6443 - DNA, 20 bp, Artificial Sequence
  sgRNA
aggacatgatgcagccgaaa

SEQ ID NO: 6444 - DNA, 20 bp, Artificial Sequence
  sgRNA
gttcatgatcattctattag

SEQ ID NO: 6445 - DNA, 20 bp, Artificial Sequence
  sgRNA
cagcaagcatttatactaac

SEQ ID NO: 6446 - DNA, 20 bp, Artificial Sequence
  sgRNA
gtttgcccgaagcactctgt

SEQ ID NO: 6447 - DNA, 20 bp, Artificial Sequence
  sgRNA
ccggcgcggacgtgcgcacc

SEQ ID NO: 6448 - DNA, 20 bp, Artificial Sequence
  sgRNA
agtttgttgacactaaacac

SEQ ID NO: 6449 - DNA, 20 bp, Artificial Sequence
  sgRNA
ctaagttgtgtggttcataa

SEQ ID NO: 6450 - DNA, 20 bp, Artificial Sequence
  sgRNA
aacacagaacagcctcttgc

SEQ ID NO: 6451 - DNA, 20 bp, Artificial Sequence
  sgRNA
gtgtgtgaagtgcttgtgtc

SEQ ID NO: 6452 - DNA, 20 bp, Artificial Sequence
  sgRNA
acaaatttggttgtatctgt

SEQ ID NO: 6453 - DNA, 20 bp, Artificial Sequence
  sgRNA
aactaaactggtgttctcta

SEQ ID NO: 6454 - DNA, 20 bp, Artificial Sequence
  sgRNA
ggagaagcccatggagctcc

SEQ ID NO: 6455 - DNA, 20 bp, Artificial Sequence
  sgRNA
tactcagaaattatcgctgc

SEQ ID NO: 6456 - DNA, 20 bp, Artificial Sequence
  sgRNA
gttctgaggctctcagttcc

SEQ ID NO: 6457 - DNA, 20 bp, Artificial Sequence
  sgRNA
ccttcatagctcctggccct

SEQ ID NO: 6458 - DNA, 20 bp, Artificial Sequence
  sgRNA
cagcggaccgggtttcgaaa

SEQ ID NO: 6459 - DNA, 20 bp, Artificial Sequence
  sgRNA
aagagacagcacaaagcgct

SEQ ID NO: 6460 - DNA, 20 bp, Artificial Sequence
  sgRNA
aaaggcattaacagcgtgag

SEQ ID NO: 6461 - DNA, 20 bp, Artificial Sequence
  sgRNA
ctctaagccctcaaagagac

SEQ ID NO: 6462 - DNA, 20 bp, Artificial Sequence
  sgRNA
cgagtgccctagccgcctgc

SEQ ID NO: 6463 - DNA, 20 bp, Artificial Sequence
  sgRNA
aatccgcacccggctagtct

SEQ ID NO: 6464 - DNA, 20 bp, Artificial Sequence
  sgRNA
ggcaggccgacgcgccatgg

SEQ ID NO: 6465 - DNA, 20 bp, Artificial Sequence
  sgRNA
acttgaggagtccgtgacgc

SEQ ID NO: 6466 - DNA, 20 bp, Artificial Sequence
  sgRNA
aggcgcgaaacccgcaacct

SEQ ID NO: 6467 - DNA, 20 bp, Artificial Sequence
  sgRNA
actggctcgcggaggtccgc

SEQ ID NO: 6468 - DNA, 20 bp, Artificial Sequence
  sgRNA
acccgcctaagaacctcaag

SEQ ID NO: 6469 - DNA, 20 bp, Artificial Sequence
  sgRNA
gtaaggctagtttacgctag

SEQ ID NO: 6470 - DNA, 20 bp, Artificial Sequence
  sgRNA
ggaggaggagaagggtagga

SEQ ID NO: 6471 - DNA, 20 bp, Artificial Sequence
  sgRNA
gcgggataagaagtggcctg

SEQ ID NO: 6472 - DNA, 20 bp, Artificial Sequence
  sgRNA
tggagtcctttagaagaggc

SEQ ID NO: 6473 - DNA, 20 bp, Artificial Sequence
  sgRNA
gcgtgcgctgtagcgcgcag

SEQ ID NO: 6474 - DNA, 20 bp, Artificial Sequence
  sgRNA
caactgtttgttgcttcttt

SEQ ID NO: 6475 - DNA, 20 bp, Artificial Sequence
  sgRNA
agtcgtctggatcagcttga

SEQ ID NO: 6476 - DNA, 20 bp, Artificial Sequence
  sgRNA
gcacgatctcctgggattct

SEQ ID NO: 6477 - DNA, 20 bp, Artificial Sequence
  sgRNA
tcgctaagcttcagttacag

SEQ ID NO: 6478 - DNA, 20 bp, Artificial Sequence
  sgRNA
ggaagatagttccgagggtg

SEQ ID NO: 6479 - DNA, 20 bp, Artificial Sequence
  sgRNA
cacactttaacattgaggag

SEQ ID NO: 6480 - DNA, 20 bp, Artificial Sequence
  sgRNA
tccgtttcatattcggaaag

SEQ ID NO: 6481 - DNA, 20 bp, Artificial Sequence
  sgRNA
ggccctttgtggcgcggctc

SEQ ID NO: 6482 - DNA, 20 bp, Artificial Sequence
  sgRNA
aggcggtgaggcgttggact

SEQ ID NO: 6483 - DNA, 20 bp, Artificial Sequence
  sgRNA
caccgagcaaccattacaag

SEQ ID NO: 6484 - DNA, 20 bp, Artificial Sequence
  sgRNA
cctagtctagagtggtaccg

SEQ ID NO: 6485 - DNA, 20 bp, Artificial Sequence
  sgRNA
cagtggttgccatagcgacc

SEQ ID NO: 6486 - DNA, 20 bp, Artificial Sequence
  sgRNA
ttgatggctttcaaagtgtc

SEQ ID NO: 6487 - DNA, 20 bp, Artificial Sequence
  sgRNA
atttgagaccttcccatagc

SEQ ID NO: 6488 - DNA, 20 bp, Artificial Sequence
  sgRNA
gtatggtaagtataatgccc

SEQ ID NO: 6489 - DNA, 20 bp, Artificial Sequence
  sgRNA
aatttgatttaaaggtgcca

SEQ ID NO: 6490 - DNA, 20 bp, Artificial Sequence
  sgRNA
cacaagtaatattgcagact

SEQ ID NO: 6491 - DNA, 20 bp, Artificial Sequence
  sgRNA
ctccaataatatcaattagg

SEQ ID NO: 6492 - DNA, 20 bp, Artificial Sequence
  sgRNA
agcgaaccctggatgctcca

SEQ ID NO: 6493 - DNA, 20 bp, Artificial Sequence
  sgRNA
agcagctcacagtgcgggtg

SEQ ID NO: 6494 - DNA, 20 bp, Artificial Sequence
  sgRNA
aatttacttcattgctccac

SEQ ID NO: 6495 - DNA, 20 bp, Artificial Sequence
  sgRNA
tggattacacaggtagcaag

SEQ ID NO: 6496 - DNA, 20 bp, Artificial Sequence
  sgRNA
aggccggttaagatcggagg

SEQ ID NO: 6497 - DNA, 20 bp, Artificial Sequence
  sgRNA
ctgtgagttcgagaccagtc

SEQ ID NO: 6498 - DNA, 20 bp, Artificial Sequence
  sgRNA
gtggagagaagacaagaaag

SEQ ID NO: 6499 - DNA, 20 bp, Artificial Sequence
  sgRNA
acaatgctgccgaaccggga

SEQ ID NO: 6500 - DNA, 20 bp, Artificial Sequence
  sgRNA
tggcagatgcatcccacagg

SEQ ID NO: 6501 - DNA, 20 bp, Artificial Sequence
  sgRNA
gaagagtcacgtttcggaga

SEQ ID NO: 6502 - DNA, 20 bp, Artificial Sequence
  sgRNA
ttagacttctagattctctt

SEQ ID NO: 6503 - DNA, 20 bp, Artificial Sequence
  sgRNA
aagagctcccgggaaccgcc

SEQ ID NO: 6504 - DNA, 20 bp, Artificial Sequence
  sgRNA
gggttgacactgggaaggtc

SEQ ID NO: 6505 - DNA, 20 bp, Artificial Sequence
  sgRNA
cgagccactgcgcacacgcc

SEQ ID NO: 6506 - DNA, 20 bp, Artificial Sequence
  sgRNA
ctccctaacgggaagggcct

SEQ ID NO: 6507 - DNA, 20 bp, Artificial Sequence
  sgRNA
gctctgccagaggcgggatg

SEQ ID NO: 6508 - DNA, 20 bp, Artificial Sequence
  sgRNA
ggaaagcaacttgagagaaa

SEQ ID NO: 6509 - DNA, 20 bp, Artificial Sequence
  sgRNA
tagcagacgcttacggactt

SEQ ID NO: 6510 - DNA, 20 bp, Artificial Sequence
  sgRNA
ccttccgattgggcggcggt

SEQ ID NO: 6511 - DNA, 20 bp, Artificial Sequence
  sgRNA
cccgcgtgtcaccgacgcct

SEQ ID NO: 6512 - DNA, 20 bp, Artificial Sequence
  sgRNA
gccgatagaggagtggccac

SEQ ID NO: 6513 - DNA, 20 bp, Artificial Sequence
  sgRNA
gtcctggcgtaagcgaatct

SEQ ID NO: 6514 - DNA, 20 bp, Artificial Sequence
  sgRNA
agatggctttgcataaatgc

SEQ ID NO: 6515 - DNA, 20 bp, Artificial Sequence
  sgRNA
caagatcgcgcgcaggcgtg

SEQ ID NO: 6516 - DNA, 20 bp, Artificial Sequence
  sgRNA
aaagcagcggcggcagcggt

SEQ ID NO: 6517 - DNA, 20 bp, Artificial Sequence
  sgRNA
tggtcgcgtttagtgatcac

SEQ ID NO: 6518 - DNA, 20 bp, Artificial Sequence
  sgRNA
aacacaagttgggcgcagcg

SEQ ID NO: 6519 - DNA, 20 bp, Artificial Sequence
  sgRNA
ccgatgccttgcagatgcct

SEQ ID NO: 6520 - DNA, 20 bp, Artificial Sequence
  sgRNA
acttcctgtggcgaccctgc

SEQ ID NO: 6521 - DNA, 20 bp, Artificial Sequence
  sgRNA
ttccttgggtttaagagtgt

SEQ ID NO: 6522 - DNA, 20 bp, Artificial Sequence
  sgRNA
taaacaagcccttccgctgc

SEQ ID NO: 6523 - DNA, 20 bp, Artificial Sequence
  sgRNA
gagctggaccgtatagggcg

SEQ ID NO: 6524 - DNA, 20 bp, Artificial Sequence
  sgRNA
gcaccaccggagaacctgtt

SEQ ID NO: 6525 - DNA, 20 bp, Artificial Sequence
  sgRNA
gctccaccacaggtcgcctt

SEQ ID NO: 6526 - DNA, 20 bp, Artificial Sequence
  sgRNA
tagcttcagcgcctgtattt

SEQ ID NO: 6527 - DNA, 20 bp, Artificial Sequence
  sgRNA
ccggcgcgtgtacgactagc

SEQ ID NO: 6528 - DNA, 20 bp, Artificial Sequence
  sgRNA
tacaggattccaggaagagt

SEQ ID NO: 6529 - DNA, 20 bp, Artificial Sequence
  sgRNA
acttgcttgtgcgcaggtcc

SEQ ID NO: 6530 - DNA, 20 bp, Artificial Sequence
  sgRNA
gcttccacggaccgaccact

SEQ ID NO: 6531 - DNA, 20 bp, Artificial Sequence
  sgRNA
gtcactagttgggagggatg

SEQ ID NO: 6532 - DNA, 20 bp, Artificial Sequence
  sgRNA
catatacccgtgcggaggac

SEQ ID NO: 6533 - DNA, 20 bp, Artificial Sequence
  sgRNA
tccggaccggaaagcggaag

SEQ ID NO: 6534 - DNA, 20 bp, Artificial Sequence
  sgRNA
aactcttagaaggctttaaa

SEQ ID NO: 6535 - DNA, 20 bp, Artificial Sequence
  sgRNA
aagctctcccttgaacccgg

SEQ ID NO: 6536 - DNA, 20 bp, Artificial Sequence
  sgRNA
ccactgcctttcgaagttgg

SEQ ID NO: 6537 - DNA, 20 bp, Artificial Sequence
  sgRNA
gcccacggcccgcgggacaa

SEQ ID NO: 6538 - DNA, 20 bp, Artificial Sequence
  sgRNA
ccgaatgcttgatcgacagc

SEQ ID NO: 6539 - DNA, 20 bp, Artificial Sequence
  sgRNA
cttgttggagccaagtaagg

SEQ ID NO: 6540 - DNA, 20 bp, Artificial Sequence
  sgRNA
gagtcttcaagagagctcct

SEQ ID NO: 6541 - DNA, 20 bp, Artificial Sequence
  sgRNA
gatagcactgtcccacaatg

SEQ ID NO: 6542 - DNA, 20 bp, Artificial Sequence
  sgRNA
gtgccgtgccagttccacct

SEQ ID NO: 6543 - DNA, 20 bp, Artificial Sequence
  sgRNA
ggtagattcactcaattccc

SEQ ID NO: 6544 - DNA, 20 bp, Artificial Sequence
  sgRNA
atcacaacccagtgcgcaat

SEQ ID NO: 6545 - DNA, 20 bp, Artificial Sequence
  sgRNA
catcttgtgagatcctgcca

SEQ ID NO: 6546 - DNA, 20 bp, Artificial Sequence
  sgRNA
tcaacaacgctgagcacttc

SEQ ID NO: 6547 - DNA, 20 bp, Artificial Sequence
  sgRNA
tagcaacaggacttcccagt

SEQ ID NO: 6548 - DNA, 20 bp, Artificial Sequence
  sgRNA
acagccaaccggctgcttta

SEQ ID NO: 6549 - DNA, 20 bp, Artificial Sequence
  sgRNA
gctaggcgccaatggccacc

SEQ ID NO: 6550 - DNA, 20 bp, Artificial Sequence
  sgRNA
agcagtgaggcgcctggcga

SEQ ID NO: 6551 - DNA, 20 bp, Artificial Sequence
  sgRNA
gagcccggcgatacggccaa

SEQ ID NO: 6552 - DNA, 20 bp, Artificial Sequence
  sgRNA
cgaccgcatctctaagtggg

SEQ ID NO: 6553 - DNA, 20 bp, Artificial Sequence
  sgRNA
gggagggtcctggcgcagat

SEQ ID NO: 6554 - DNA, 20 bp, Artificial Sequence
  sgRNA
ggtacacacagggcgcctgc

SEQ ID NO: 6555 - DNA, 20 bp, Artificial Sequence
  sgRNA
ggtccttagtgtcgctggat

SEQ ID NO: 6556 - DNA, 20 bp, Artificial Sequence
  sgRNA
tgcgcccgcccaatagcgca

SEQ ID NO: 6557 - DNA, 20 bp, Artificial Sequence
  sgRNA
tagcccattaacctagagcc

SEQ ID NO: 6558 - DNA, 20 bp, Artificial Sequence
  sgRNA
gggccagctaggaaagattt

SEQ ID NO: 6559 - DNA, 20 bp, Artificial Sequence
  sgRNA
actccgctagaattgcagtg

SEQ ID NO: 6560 - DNA, 20 bp, Artificial Sequence
  sgRNA
ggtctacagggcggagaccc

SEQ ID NO: 6561 - DNA, 20 bp, Artificial Sequence
  sgRNA
ccctgctttgggagtagctt

SEQ ID NO: 6562 - DNA, 20 bp, Artificial Sequence
  sgRNA
ctgagaaacatgccaaagac

SEQ ID NO: 6563 - DNA, 20 bp, Artificial Sequence
  sgRNA
acggccgtggcgttgcgacg

SEQ ID NO: 6564 - DNA, 20 bp, Artificial Sequence
  sgRNA
tgcacacgtttgatgcttga

SEQ ID NO: 6565 - DNA, 20 bp, Artificial Sequence
  sgRNA
ctcccaggtctccatcgccc

SEQ ID NO: 6566 - DNA, 20 bp, Artificial Sequence
  sgRNA
cctaaactcagaacccacca

SEQ ID NO: 6567 - DNA, 20 bp, Artificial Sequence
  sgRNA
ataaggcctagacgcgtggc

SEQ ID NO: 6568 - DNA, 20 bp, Artificial Sequence
  sgRNA
cgggccaagcggctaagttc

SEQ ID NO: 6569 - DNA, 20 bp, Artificial Sequence
  sgRNA
aacatcaagtgcttgaaaga

SEQ ID NO: 6570 - DNA, 20 bp, Artificial Sequence
  sgRNA
aaggaagccacgcgactagg

SEQ ID NO: 6571 - DNA, 20 bp, Artificial Sequence
  sgRNA
gcagccggacctcgccctcg

SEQ ID NO: 6572 - DNA, 20 bp, Artificial Sequence
  sgRNA
agtctcaccatatctgggct

SEQ ID NO: 6573 - DNA, 20 bp, Artificial Sequence
  sgRNA
aggcccaattcctctacctt

SEQ ID NO: 6574 - DNA, 20 bp, Artificial Sequence
  sgRNA
gttaagtgggcgggttcaag

SEQ ID NO: 6575 - DNA, 20 bp, Artificial Sequence
  sgRNA
ctttgcagaatagtgcgcca

SEQ ID NO: 6576 - DNA, 20 bp, Artificial Sequence
  sgRNA
gcccacctgagccgcagact

SEQ ID NO: 6577 - DNA, 20 bp, Artificial Sequence
  sgRNA
aggagcgcaaggagcgcgcg

SEQ ID NO: 6578 - DNA, 20 bp, Artificial Sequence
  sgRNA
tggcgacctctagaggcgtt

SEQ ID NO: 6579 - DNA, 20 bp, Artificial Sequence
  sgRNA
tggcggcgattgggcaggcg

SEQ ID NO: 6580 - DNA, 20 bp, Artificial Sequence
  sgRNA
gaggatttcatctcaggact

SEQ ID NO: 6581 - DNA, 20 bp, Artificial Sequence
  sgRNA
tctcaaagttccaagggtct

SEQ ID NO: 6582 - DNA, 20 bp, Artificial Sequence
  sgRNA
gacgcagggcgctaaattcc

SEQ ID NO: 6583 - DNA, 20 bp, Artificial Sequence
  sgRNA
aaagctgcttcaacaggcta

SEQ ID NO: 6584 - DNA, 20 bp, Artificial Sequence
  sgRNA
ctctccctccgcgtctcggc

SEQ ID NO: 6585 - DNA, 20 bp, Artificial Sequence
  sgRNA
tcctatgaccgtaaacgcca

SEQ ID NO: 6586 - DNA, 20 bp, Artificial Sequence
  sgRNA
atccgattggtctttattga

SEQ ID NO: 6587 - DNA, 20 bp, Artificial Sequence
  sgRNA
gccaaaggccaggtgttggg

SEQ ID NO: 6588 - DNA, 20 bp, Artificial Sequence
  sgRNA
tgcaggctgccactagctca

SEQ ID NO: 6589 - DNA, 20 bp, Artificial Sequence
  sgRNA
agggtgttaagctgcactgt

SEQ ID NO: 6590 - DNA, 20 bp, Artificial Sequence
  sgRNA
ggttggaatttgcctttcta

SEQ ID NO: 6591 - DNA, 20 bp, Artificial Sequence
  sgRNA
ctagtctgttcttgccttgt

SEQ ID NO: 6592 - DNA, 20 bp, Artificial Sequence
  sgRNA
gctgagcttatggtggcctc

SEQ ID NO: 6593 - DNA, 20 bp, Artificial Sequence
  sgRNA
cagacgcgagagctgggcgg

SEQ ID NO: 6594 - DNA, 20 bp, Artificial Sequence
  sgRNA
tcgtgacctgcagcggacct

SEQ ID NO: 6595 - DNA, 20 bp, Artificial Sequence
  sgRNA
cgagggacccgagggctctt

SEQ ID NO: 6596 - DNA, 20 bp, Artificial Sequence
  sgRNA
gttcgtcgggtcgtgcagcc

SEQ ID NO: 6597 - DNA, 20 bp, Artificial Sequence
  sgRNA
cagatcagcatcattcacca

SEQ ID NO: 6598 - DNA, 20 bp, Artificial Sequence
  sgRNA
ccacagcccttctcgttgcc

SEQ ID NO: 6599 - DNA, 20 bp, Artificial Sequence
  sgRNA
agtaagttatccgggaccct

SEQ ID NO: 6600 - DNA, 20 bp, Artificial Sequence
  sgRNA
gacagtgagaagcgcaaacc

SEQ ID NO: 6601 - DNA, 20 bp, Artificial Sequence
  sgRNA
ggagctctcttgccagtggg

SEQ ID NO: 6602 - DNA, 20 bp, Artificial Sequence
  sgRNA
tggcaaggaaatatatagct

SEQ ID NO: 6603 - DNA, 20 bp, Artificial Sequence
  sgRNA
gggcaggaggacaatgctag

SEQ ID NO: 6604 - DNA, 20 bp, Artificial Sequence
  sgRNA
tataagagtcttgatagaac

SEQ ID NO: 6605 - DNA, 20 bp, Artificial Sequence
  sgRNA
taattcacactccggtgaag

SEQ ID NO: 6606 - DNA, 20 bp, Artificial Sequence
  sgRNA
atggttggaagctgggttga

SEQ ID NO: 6607 - DNA, 20 bp, Artificial Sequence
  sgRNA
aatctacagcaagagtggct

SEQ ID NO: 6608 - DNA, 20 bp, Artificial Sequence
  sgRNA
agcccaggacacagcaaagg

SEQ ID NO: 6609 - DNA, 20 bp, Artificial Sequence
  sgRNA
aactgaagataaggattccc

SEQ ID NO: 6610 - DNA, 20 bp, Artificial Sequence
  sgRNA
ccttctctcctaccaatcag

SEQ ID NO: 6611 - DNA, 20 bp, Artificial Sequence
  sgRNA
ttgtcgccgtcaggcacagc

SEQ ID NO: 6612 - DNA, 20 bp, Artificial Sequence
  sgRNA
aaccattctagaatgtctgg

SEQ ID NO: 6613 - DNA, 20 bp, Artificial Sequence
  sgRNA
gtacagggagaacattagca

SEQ ID NO: 6614 - DNA, 20 bp, Artificial Sequence
  sgRNA
agtcccgctgtacctaaagg

SEQ ID NO: 6615 - DNA, 20 bp, Artificial Sequence
  sgRNA
tcggtctgagggccgcggcc

SEQ ID NO: 6616 - DNA, 20 bp, Artificial Sequence
  sgRNA
ccagtccaggcgcgcaactc

SEQ ID NO: 6617 - DNA, 20 bp, Artificial Sequence
  sgRNA
acctagtttactgtggttgg

SEQ ID NO: 6618 - DNA, 20 bp, Artificial Sequence
  sgRNA
ggtgacccgcaaggcatagg

SEQ ID NO: 6619 - DNA, 20 bp, Artificial Sequence
  sgRNA
gttattaggaccaattaaga

SEQ ID NO: 6620 - DNA, 20 bp, Artificial Sequence
  sgRNA
aaagaaaggcaagagaagag

SEQ ID NO: 6621 - DNA, 20 bp, Artificial Sequence
  sgRNA
atttaggtctcaggtgggac

SEQ ID NO: 6622 - DNA, 20 bp, Artificial Sequence
  sgRNA
tgcgctcgaggccttgaggc

SEQ ID NO: 6623 - DNA, 20 bp, Artificial Sequence
  sgRNA
tctgtaggtgacaaagagga

SEQ ID NO: 6624 - DNA, 20 bp, Artificial Sequence
  sgRNA
agtagcgtcgtagctctctc

SEQ ID NO: 6625 - DNA, 20 bp, Artificial Sequence
  sgRNA
agatatttcatcttactgca

SEQ ID NO: 6626 - DNA, 20 bp, Artificial Sequence
  sgRNA
ccctcggctttacgactttc

SEQ ID NO: 6627 - DNA, 20 bp, Artificial Sequence
  sgRNA
gggcacttccgaggccgctc

SEQ ID NO: 6628 - DNA, 20 bp, Artificial Sequence
  sgRNA
gcgcgcggagggatccgccg

SEQ ID NO: 6629 - DNA, 20 bp, Artificial Sequence
  sgRNA
tgtgggcgggaggccgagtg

SEQ ID NO: 6630 - DNA, 20 bp, Artificial Sequence
  sgRNA
aaagagtgtcacttgctgga

SEQ ID NO: 6631 - DNA, 20 bp, Artificial Sequence
  sgRNA
tgcccgggtcgaggtcgggt

SEQ ID NO: 6632 - DNA, 20 bp, Artificial Sequence
  sgRNA
tagcattgctgcatcttctc

SEQ ID NO: 6633 - DNA, 20 bp, Artificial Sequence
  sgRNA
tgtttggtgcccttgtcaca

SEQ ID NO: 6634 - DNA, 20 bp, Artificial Sequence
  sgRNA
gtcattagttgtcagggagc

SEQ ID NO: 6635 - DNA, 20 bp, Artificial Sequence
  sgRNA
caaatcagacgcatgcgctt

SEQ ID NO: 6636 - DNA, 20 bp, Artificial Sequence
  sgRNA
agaatctggaagtttacagc

SEQ ID NO: 6637 - DNA, 20 bp, Artificial Sequence
  sgRNA
ccgcctcctgctcttgtgat

SEQ ID NO: 6638 - DNA, 20 bp, Artificial Sequence
  sgRNA
gcaaagacgctgcggcttgc

SEQ ID NO: 6639 - DNA, 20 bp, Artificial Sequence
  sgRNA
aggaagctcgggcgacgatt

SEQ ID NO: 6640 - DNA, 20 bp, Artificial Sequence
  sgRNA
gaatgaatcagctacatata

SEQ ID NO: 6641 - DNA, 20 bp, Artificial Sequence
  sgRNA
tagcggatgggcgggctcta

SEQ ID NO: 6642 - DNA, 20 bp, Artificial Sequence
  sgRNA
tcatttcaaaggctgaccct

SEQ ID NO: 6643 - DNA, 20 bp, Artificial Sequence
  sgRNA
ccctgcactatattcccgcc

SEQ ID NO: 6644 - DNA, 20 bp, Artificial Sequence
  sgRNA
ggtttactagaactagaccc

SEQ ID NO: 6645 - DNA, 20 bp, Artificial Sequence
  sgRNA
aaactgctgttgctcgccgc

SEQ ID NO: 6646 - DNA, 20 bp, Artificial Sequence
  sgRNA
ggtcgcgagctgcccggccc

SEQ ID NO: 6647 - DNA, 20 bp, Artificial Sequence
  sgRNA
ccctgcacagtgcctaggac

SEQ ID NO: 6648 - DNA, 20 bp, Artificial Sequence
  sgRNA
ggaggaaataggagggaggg

SEQ ID NO: 6649 - DNA, 20 bp, Artificial Sequence
  sgRNA
ataaggacattaaagaagga

SEQ ID NO: 6650 - DNA, 20 bp, Artificial Sequence
  sgRNA
ggagcttgggcgaagctttg

SEQ ID NO: 6651 - DNA, 20 bp, Artificial Sequence
  sgRNA
gctggaaagtgctgcgtccc

SEQ ID NO: 6652 - DNA, 20 bp, Artificial Sequence
  sgRNA
ggatgaaccaattagtccaa

SEQ ID NO: 6653 - DNA, 20 bp, Artificial Sequence
  sgRNA
cgtcagcagtgatcgtgccg

SEQ ID NO: 6654 - DNA, 20 bp, Artificial Sequence
  sgRNA
gttaagggcggcaatgtggg

SEQ ID NO: 6655 - DNA, 20 bp, Artificial Sequence
  sgRNA
gagatatggtgtaagcacgc

SEQ ID NO: 6656 - DNA, 20 bp, Artificial Sequence
  sgRNA
cacccgggtggacagatgtc

SEQ ID NO: 6657 - DNA, 20 bp, Artificial Sequence
  sgRNA
cctagaaggaatgctaacag

SEQ ID NO: 6658 - DNA, 20 bp, Artificial Sequence
  sgRNA
gggtttgggagatactgagt

SEQ ID NO: 6659 - DNA, 20 bp, Artificial Sequence
  sgRNA
ggccaattccttcttagctg

SEQ ID NO: 6660 - DNA, 20 bp, Artificial Sequence
  sgRNA
tcttggtgatatttcaggag

SEQ ID NO: 6661 - DNA, 20 bp, Artificial Sequence
  sgRNA
ggtcacagggagcccgactg

SEQ ID NO: 6662 - DNA, 20 bp, Artificial Sequence
  sgRNA
ttgccggagccgcctcgagg

SEQ ID NO: 6663 - DNA, 20 bp, Artificial Sequence
  sgRNA
aagaacaaggaggagagtaa

SEQ ID NO: 6664 - DNA, 20 bp, Artificial Sequence
  sgRNA
ggaattgtgatataaggcat

SEQ ID NO: 6665 - DNA, 20 bp, Artificial Sequence
  sgRNA
aaacacttgaaggtgtggcc

SEQ ID NO: 6666 - DNA, 20 bp, Artificial Sequence
  sgRNA
actggacgcgcctgtacgtg

SEQ ID NO: 6667 - DNA, 20 bp, Artificial Sequence
  sgRNA
tggctcttagttatgctaat

SEQ ID NO: 6668 - DNA, 20 bp, Artificial Sequence
  sgRNA
ttaagcgcctcagcggtctg

SEQ ID NO: 6669 - DNA, 20 bp, Artificial Sequence
  sgRNA
gctgacgctgctattagtct

SEQ ID NO: 6670 - DNA, 20 bp, Artificial Sequence
  sgRNA
gcagatagcgcaggcggctt

SEQ ID NO: 6671 - DNA, 20 bp, Artificial Sequence
  sgRNA
ggcgcagaccgtgtcttacc

SEQ ID NO: 6672 - DNA, 20 bp, Artificial Sequence
  sgRNA
gtagtgcagagcccatgctc

SEQ ID NO: 6673 - DNA, 20 bp, Artificial Sequence
  sgRNA
cgggcccagctgacacttat

SEQ ID NO: 6674 - DNA, 20 bp, Artificial Sequence
  sgRNA
ggcaagcgctggcagccgag

SEQ ID NO: 6675 - DNA, 20 bp, Artificial Sequence
  sgRNA
tttgaacagctggtacccag

SEQ ID NO: 6676 - DNA, 20 bp, Artificial Sequence
  sgRNA
agaccaacgcacgcggaaga

SEQ ID NO: 6677 - DNA, 20 bp, Artificial Sequence
  sgRNA
aggaatgcggagccgggaag

SEQ ID NO: 6678 - DNA, 20 bp, Artificial Sequence
  sgRNA
ggcacctcccatgcagtggg

SEQ ID NO: 6679 - DNA, 20 bp, Artificial Sequence
  sgRNA
tagaaagacttgctccaccc

SEQ ID NO: 6680 - DNA, 20 bp, Artificial Sequence
  sgRNA
gtgacgtttaagactctgat

SEQ ID NO: 6681 - DNA, 20 bp, Artificial Sequence
  sgRNA
gggacgtgggtgcgggtttg

SEQ ID NO: 6682 - DNA, 20 bp, Artificial Sequence
  sgRNA
cgggagagcatttatcagcc

SEQ ID NO: 6683 - DNA, 20 bp, Artificial Sequence
  sgRNA
tctgcggagcgggctgtgct

SEQ ID NO: 6684 - DNA, 20 bp, Artificial Sequence
  sgRNA
ccaagacgggaggaaagcct

SEQ ID NO: 6685 - DNA, 20 bp, Artificial Sequence
  sgRNA
ggtggatgaaactagccttg

SEQ ID NO: 6686 - DNA, 20 bp, Artificial Sequence
  sgRNA
ccctctataccaggttgtga

SEQ ID NO: 6687 - DNA, 20 bp, Artificial Sequence
  sgRNA
gctccctctcgcgaggagag

SEQ ID NO: 6688 - DNA, 20 bp, Artificial Sequence
  sgRNA
tcagaaagttgcaccgcagg

SEQ ID NO: 6689 - DNA, 20 bp, Artificial Sequence
  sgRNA
agcaaagcatggcagggcat

SEQ ID NO: 6690 - DNA, 20 bp, Artificial Sequence
  sgRNA
ggtcctgcaggaagccctgt

SEQ ID NO: 6691 - DNA, 20 bp, Artificial Sequence
  sgRNA
atattgtcacctacagtcaa

SEQ ID NO: 6692 - DNA, 20 bp, Artificial Sequence
  sgRNA
gcagggcgaccgcccatccg

SEQ ID NO: 6693 - DNA, 20 bp, Artificial Sequence
  sgRNA
ggagacgcgatcgtgagaag

SEQ ID NO: 6694 - DNA, 20 bp, Artificial Sequence
  sgRNA
gatggccgcagatttgaatt

SEQ ID NO: 6695 - DNA, 20 bp, Artificial Sequence
  sgRNA
tttagtctcgcagaggtcaa

SEQ ID NO: 6696 - DNA, 20 bp, Artificial Sequence
  sgRNA
gagtagtttaaggaatgagg

SEQ ID NO: 6697 - DNA, 20 bp, Artificial Sequence
  sgRNA
ccgtgcctttctcgggcctt

SEQ ID NO: 6698 - DNA, 20 bp, Artificial Sequence
  sgRNA
tgggaggactgccgaggcgg

SEQ ID NO: 6699 - DNA, 20 bp, Artificial Sequence
  sgRNA
caaagccgaaggtcggcctc

SEQ ID NO: 6700 - DNA, 20 bp, Artificial Sequence
  sgRNA
ccggctcctctccggacttc

SEQ ID NO: 6701 - DNA, 20 bp, Artificial Sequence
  sgRNA
ggcgcagagactgacagctg

SEQ ID NO: 6702 - DNA, 20 bp, Artificial Sequence
  sgRNA
agtctcttgaactctataaa

SEQ ID NO: 6703 - DNA, 20 bp, Artificial Sequence
  sgRNA
ttcagatttgcctcgcttcc

SEQ ID NO: 6704 - DNA, 20 bp, Artificial Sequence
  sgRNA
ttgctgagacctccgcttcc

SEQ ID NO: 6705 - DNA, 20 bp, Artificial Sequence
  sgRNA
ccacgtgaccgccgatcttc

SEQ ID NO: 6706 - DNA, 20 bp, Artificial Sequence
  sgRNA
tgccattccgagtgagaagc

SEQ ID NO: 6707 - DNA, 20 bp, Artificial Sequence
  sgRNA
tgtacagctaggcatgcttg

SEQ ID NO: 6708 - DNA, 20 bp, Artificial Sequence
  sgRNA
gcacttcctgtagttggagc

SEQ ID NO: 6709 - DNA, 20 bp, Artificial Sequence
  sgRNA
gcccaatgcgtgtgcttggg

SEQ ID NO: 6710 - DNA, 20 bp, Artificial Sequence
  sgRNA
aagacatttacaagtctaag

SEQ ID NO: 6711 - DNA, 20 bp, Artificial Sequence
  sgRNA
agctcaggaatgtggcggcg

SEQ ID NO: 6712 - DNA, 20 bp, Artificial Sequence
  sgRNA
atgccggagcttctggcccg

SEQ ID NO: 6713 - DNA, 20 bp, Artificial Sequence
  sgRNA
tttaaggtctaatgcagaag

SEQ ID NO: 6714 - DNA, 20 bp, Artificial Sequence
  sgRNA
agccgagcgtgggtactccc

SEQ ID NO: 6715 - DNA, 20 bp, Artificial Sequence
  sgRNA
aaactcctgacgtcactcca

SEQ ID NO: 6716 - DNA, 20 bp, Artificial Sequence
  sgRNA
ctctggctcagggatgttca

SEQ ID NO: 6717 - DNA, 20 bp, Artificial Sequence
  sgRNA
ctttaaagaaccttgggata

SEQ ID NO: 6718 - DNA, 20 bp, Artificial Sequence
  sgRNA
gcgtcactcaacaggtctgt

SEQ ID NO: 6719 - DNA, 20 bp, Artificial Sequence
  sgRNA
aataggacagtgatagttaa

SEQ ID NO: 6720 - DNA, 20 bp, Artificial Sequence
  sgRNA
gggcaaagattgcctgagcc

SEQ ID NO: 6721 - DNA, 20 bp, Artificial Sequence
  sgRNA
cccgttccgacagaacccag

SEQ ID NO: 6722 - DNA, 20 bp, Artificial Sequence
  sgRNA
atactccagctcataacatt

SEQ ID NO: 6723 - DNA, 20 bp, Artificial Sequence
  sgRNA
tgacttgatgttactaacgc

SEQ ID NO: 6724 - DNA, 20 bp, Artificial Sequence
  sgRNA
tgtcgacttgtagagctggg

SEQ ID NO: 6725 - DNA, 20 bp, Artificial Sequence
  sgRNA
gccaacagacctcggtttag

SEQ ID NO: 6726 - DNA, 20 bp, Artificial Sequence
  sgRNA
ggtcccaggcaaatgtcggg

SEQ ID NO: 6727 - DNA, 20 bp, Artificial Sequence
  sgRNA
aattacaacagtctcaggaa

SEQ ID NO: 6728 - DNA, 20 bp, Artificial Sequence
  sgRNA
gcgcatcactggcctgcagg

SEQ ID NO: 6729 - DNA, 20 bp, Artificial Sequence
  sgRNA
ggcgagcgagggaacgaaat

SEQ ID NO: 6730 - DNA, 20 bp, Artificial Sequence
  sgRNA
cgcccatgacgcaccctctc

SEQ ID NO: 6731 - DNA, 20 bp, Artificial Sequence
  sgRNA
ctagcattgtgtcttctctt

SEQ ID NO: 6732 - DNA, 20 bp, Artificial Sequence
  sgRNA
ctcaacatcagaacctcgcg

SEQ ID NO: 6733 - DNA, 20 bp, Artificial Sequence
  sgRNA
taattatagacgcatttgcg

SEQ ID NO: 6734 - DNA, 20 bp, Artificial Sequence
  sgRNA
acacaaacatctcagtggtg

SEQ ID NO: 6735 - DNA, 20 bp, Artificial Sequence
  sgRNA
gggaaagtccagcaacgaca

SEQ ID NO: 6736 - DNA, 20 bp, Artificial Sequence
  sgRNA
gaacttgggcgccacgttcc

SEQ ID NO: 6737 - DNA, 20 bp, Artificial Sequence
  sgRNA
atccaggagccacagaagtg

SEQ ID NO: 6738 - DNA, 20 bp, Artificial Sequence
  sgRNA
gacacgatgagtggaggcgt

SEQ ID NO: 6739 - DNA, 20 bp, Artificial Sequence
  sgRNA
gtttactttcactgcccatc

SEQ ID NO: 6740 - DNA, 20 bp, Artificial Sequence
  sgRNA
ataactgtggaggaggcttc

SEQ ID NO: 6741 - DNA, 20 bp, Artificial Sequence
  sgRNA
ctaggcattagacaacctcc

SEQ ID NO: 6742 - DNA, 20 bp, Artificial Sequence
  sgRNA
cgagagtctgcgattctggc

SEQ ID NO: 6743 - DNA, 20 bp, Artificial Sequence
  sgRNA
acaggcattactgggaagtt

SEQ ID NO: 6744 - DNA, 20 bp, Artificial Sequence
  sgRNA
atacatgacacagcagagtt

SEQ ID NO: 6745 - DNA, 20 bp, Artificial Sequence
  sgRNA
agtactttatatttagccac

SEQ ID NO: 6746 - DNA, 20 bp, Artificial Sequence
  sgRNA
gcactccgctgcgggcgtcg

SEQ ID NO: 6747 - DNA, 20 bp, Artificial Sequence
  sgRNA
gggacttgcggtaggacgca

SEQ ID NO: 6748 - DNA, 20 bp, Artificial Sequence
  sgRNA
ctctgttgggcgtgttgcct

SEQ ID NO: 6749 - DNA, 20 bp, Artificial Sequence
  sgRNA
ggtgtttcttccctatcgtg

SEQ ID NO: 6750 - DNA, 20 bp, Artificial Sequence
  sgRNA
ctgtcttcatcctccaatcg

SEQ ID NO: 6751 - DNA, 20 bp, Artificial Sequence
  sgRNA
tggagactttgaggttatct

SEQ ID NO: 6752 - DNA, 20 bp, Artificial Sequence
  sgRNA
ggaaacaaggtttcttctcc

SEQ ID NO: 6753 - DNA, 20 bp, Artificial Sequence
  sgRNA
ggcgcgtgacgcaaagcggc

SEQ ID NO: 6754 - DNA, 20 bp, Artificial Sequence
  sgRNA
tgtcaggccatgaaatgccc

SEQ ID NO: 6755 - DNA, 20 bp, Artificial Sequence
  sgRNA
accgcggaactcgcgcccgg

SEQ ID NO: 6756 - DNA, 20 bp, Artificial Sequence
  sgRNA
aagatgttgcggagacttaa

SEQ ID NO: 6757 - DNA, 20 bp, Artificial Sequence
  sgRNA
atgcggtgcgggacagcctc

SEQ ID NO: 6758 - DNA, 20 bp, Artificial Sequence
  sgRNA
ggtgatttagacggattgcc

SEQ ID NO: 6759 - DNA, 20 bp, Artificial Sequence
  sgRNA
gtggccaatcagctgttcgc

SEQ ID NO: 6760 - DNA, 20 bp, Artificial Sequence
  sgRNA
cggcgggaaagcgccgctca

SEQ ID NO: 6761 - DNA, 20 bp, Artificial Sequence
  sgRNA
cgggcaccacctcgtaacaa

SEQ ID NO: 6762 - DNA, 20 bp, Artificial Sequence
  sgRNA
ttcaggtggagccagatgtc

SEQ ID NO: 6763 - DNA, 20 bp, Artificial Sequence
  sgRNA
tgtggagctggaaggtgcgg

SEQ ID NO: 6764 - DNA, 20 bp, Artificial Sequence
  sgRNA
cgtagagggacgggtgatct

SEQ ID NO: 6765 - DNA, 20 bp, Artificial Sequence
  sgRNA
gccacgcccaagctgtccac

SEQ ID NO: 6766 - DNA, 20 bp, Artificial Sequence
  sgRNA
gaatggagcggcacgtgacc

SEQ ID NO: 6767 - DNA, 20 bp, Artificial Sequence
  sgRNA
aggattacaagggatagcct

SEQ ID NO: 6768 - DNA, 20 bp, Artificial Sequence
  sgRNA
catgcgcaggccgcccggct

SEQ ID NO: 6769 - DNA, 20 bp, Artificial Sequence
  sgRNA
cacagttcacagtgctgttc

SEQ ID NO: 6770 - DNA, 20 bp, Artificial Sequence
  sgRNA
tctagtttaccttctcctct

SEQ ID NO: 6771 - DNA, 20 bp, Artificial Sequence
  sgRNA
cctccaggcgcagctaaaga

SEQ ID NO: 6772 - DNA, 20 bp, Artificial Sequence
  sgRNA
tggtcaggcagcagaatgtc

SEQ ID NO: 6773 - DNA, 20 bp, Artificial Sequence
  sgRNA
ccgcatgcaaagaatagctg

SEQ ID NO: 6774 - DNA, 20 bp, Artificial Sequence
  sgRNA
tcagcctcacctcaatatgg

SEQ ID NO: 6775 - DNA, 20 bp, Artificial Sequence
  sgRNA
tagtgttgctgtctctttaa

SEQ ID NO: 6776 - DNA, 20 bp, Artificial Sequence
  sgRNA
aagcagtctgggcatctgca

SEQ ID NO: 6777 - DNA, 20 bp, Artificial Sequence
  sgRNA
aggaatgaatggccatcagg

SEQ ID NO: 6778 - DNA, 20 bp, Artificial Sequence
  sgRNA
tgccaactgctgagagaccc

SEQ ID NO: 6779 - DNA, 20 bp, Artificial Sequence
  sgRNA
taagaatgtgccacattaaa

SEQ ID NO: 6780 - DNA, 20 bp, Artificial Sequence
  sgRNA
gtgaccatttctccaagtaa

SEQ ID NO: 6781 - DNA, 20 bp, Artificial Sequence
  sgRNA
ggcaccagctctgagctgga

SEQ ID NO: 6782 - DNA, 20 bp, Artificial Sequence
  sgRNA
tccagtagttacagttacga

SEQ ID NO: 6783 - DNA, 20 bp, Artificial Sequence
  sgRNA
tgcagaactggagtaaaccg

SEQ ID NO: 6784 - DNA, 20 bp, Artificial Sequence
  sgRNA
ggaggaggagggccaggaga

SEQ ID NO: 6785 - DNA, 20 bp, Artificial Sequence
  sgRNA
atgtattgaactgtcgtcta

SEQ ID NO: 6786 - DNA, 20 bp, Artificial Sequence
  sgRNA
ggacacaaagagagcaccgg

SEQ ID NO: 6787 - DNA, 20 bp, Artificial Sequence
  sgRNA
tcaggataagagttgtagct

SEQ ID NO: 6788 - DNA, 20 bp, Artificial Sequence
  sgRNA
tgtcaccagagccttagact

SEQ ID NO: 6789 - DNA, 20 bp, Artificial Sequence
  sgRNA
ctccggcgcgctgtccgctg

SEQ ID NO: 6790 - DNA, 20 bp, Artificial Sequence
  sgRNA
ttcacttgagttcaaactcc

SEQ ID NO: 6791 - DNA, 20 bp, Artificial Sequence
  sgRNA
ggtgctcgcgcgttgccttt

SEQ ID NO: 6792 - DNA, 20 bp, Artificial Sequence
  sgRNA
acgatctgtgggcgggcacg

SEQ ID NO: 6793 - DNA, 20 bp, Artificial Sequence
  sgRNA
acacacacacacgcgtcctt

SEQ ID NO: 6794 - DNA, 20 bp, Artificial Sequence
  sgRNA
ctacactggagtgcgttgcc

SEQ ID NO: 6795 - DNA, 20 bp, Artificial Sequence
  sgRNA
cagcagggaaggactcgggt

SEQ ID NO: 6796 - DNA, 20 bp, Artificial Sequence
  sgRNA
tgtggtgctacaccttctgc

SEQ ID NO: 6797 - DNA, 20 bp, Artificial Sequence
  sgRNA
acatttgccgggcaggcagg

SEQ ID NO: 6798 - DNA, 20 bp, Artificial Sequence
  sgRNA
tctggtctctgttgttgtag

SEQ ID NO: 6799 - DNA, 20 bp, Artificial Sequence
  sgRNA
attccactaggtgggaatgc

SEQ ID NO: 6800 - DNA, 20 bp, Artificial Sequence
  sgRNA
ctgccacggttggtcgcgcc

SEQ ID NO: 6801 - DNA, 20 bp, Artificial Sequence
  sgRNA
caacagggctccaccgcttc

SEQ ID NO: 6802 - DNA, 20 bp, Artificial Sequence
  sgRNA
tgatcacctgctccagcacc

SEQ ID NO: 6803 - DNA, 20 bp, Artificial Sequence
  sgRNA
cactccttccacactcagat

SEQ ID NO: 6804 - DNA, 20 bp, Artificial Sequence
  sgRNA
gtcagcatgatctccagacc

SEQ ID NO: 6805 - DNA, 20 bp, Artificial Sequence
  sgRNA
aggtatgtcagtgtggatgt

SEQ ID NO: 6806 - DNA, 20 bp, Artificial Sequence
  sgRNA
ggaagcggtccgacgcgaag

SEQ ID NO: 6807 - DNA, 20 bp, Artificial Sequence
  sgRNA
cagggcgcgcgtgtgagtcc

SEQ ID NO: 6808 - DNA, 20 bp, Artificial Sequence
  sgRNA
ggatgatccaatgagaattc

SEQ ID NO: 6809 - DNA, 20 bp, Artificial Sequence
  sgRNA
gtgaatagtggcagaggaga

SEQ ID NO: 6810 - DNA, 20 bp, Artificial Sequence
  sgRNA
tgttggacaccgacatcgaa

SEQ ID NO: 6811 - DNA, 20 bp, Artificial Sequence
  sgRNA
ttggctcattgaccatccag

SEQ ID NO: 6812 - DNA, 20 bp, Artificial Sequence
  sgRNA
taatgcaggctgcaatcact

SEQ ID NO: 6813 - DNA, 20 bp, Artificial Sequence
  sgRNA
gtaggacaaggagttaagaa

SEQ ID NO: 6814 - DNA, 20 bp, Artificial Sequence
  sgRNA
aggtccacgtcaatccctcc

SEQ ID NO: 6815 - DNA, 20 bp, Artificial Sequence
  sgRNA
ggcggacacaaagcctcccg

SEQ ID NO: 6816 - DNA, 20 bp, Artificial Sequence
  sgRNA
tgagcgggtgagtctcaaga

SEQ ID NO: 6817 - DNA, 20 bp, Artificial Sequence
  sgRNA
agcggaataacggcagaagg

SEQ ID NO: 6818 - DNA, 20 bp, Artificial Sequence
  sgRNA
gcgctccgagcgctcagccc

SEQ ID NO: 6819 - DNA, 20 bp, Artificial Sequence
  sgRNA
cccaacaaagcagagaccag

SEQ ID NO: 6820 - DNA, 20 bp, Artificial Sequence
  sgRNA
cgactggcaattcgctccgg

SEQ ID NO: 6821 - DNA, 20 bp, Artificial Sequence
  sgRNA
acgtcacttccggcaacaat

SEQ ID NO: 6822 - DNA, 20 bp, Artificial Sequence
  sgRNA
tgacgcgagcgggcttccgg

SEQ ID NO: 6823 - DNA, 20 bp, Artificial Sequence
  sgRNA
aaggacagaggtagttcagt

SEQ ID NO: 6824 - DNA, 20 bp, Artificial Sequence
  sgRNA
gaggatgaagcgtgcggaag

SEQ ID NO: 6825 - DNA, 20 bp, Artificial Sequence
  sgRNA
tttgcacagcaagacactgg

SEQ ID NO: 6826 - DNA, 20 bp, Artificial Sequence
  sgRNA
gaacccactgacgtagtctc

SEQ ID NO: 6827 - DNA, 20 bp, Artificial Sequence
  sgRNA
ctgctgtactgggaagtggg

SEQ ID NO: 6828 - DNA, 20 bp, Artificial Sequence
  sgRNA
atcaaatcagtttagtagag

SEQ ID NO: 6829 - DNA, 20 bp, Artificial Sequence
  sgRNA
gcagggcatgacctagtacc

SEQ ID NO: 6830 - DNA, 20 bp, Artificial Sequence
  sgRNA
tcaggcgcgtggaacgttta

SEQ ID NO: 6831 - DNA, 20 bp, Artificial Sequence
  sgRNA
gggcctgaggcaggagtgcg

SEQ ID NO: 6832 - DNA, 20 bp, Artificial Sequence
  sgRNA
gcggtgccgcgggctctcta

SEQ ID NO: 6833 - DNA, 20 bp, Artificial Sequence
  sgRNA
ggcagcaggcgggcctgcgc

SEQ ID NO: 6834 - DNA, 20 bp, Artificial Sequence
  sgRNA
gggacagagctgctcgctag

SEQ ID NO: 6835 - DNA, 20 bp, Artificial Sequence
  sgRNA
cgcagtagtcccttcggctg

SEQ ID NO: 6836 - DNA, 20 bp, Artificial Sequence
  sgRNA
cgcctagtggcgcggtctgc

SEQ ID NO: 6837 - DNA, 20 bp, Artificial Sequence
  sgRNA
cagcgccacggttcggacta

SEQ ID NO: 6838 - DNA, 20 bp, Artificial Sequence
  sgRNA
tgaaggaaggcagtccgcac

SEQ ID NO: 6839 - DNA, 20 bp, Artificial Sequence
  sgRNA
ggtctgagttgggcccgaga

SEQ ID NO: 6840 - DNA, 20 bp, Artificial Sequence
  sgRNA
gtgctacgcgggtccggcgg

SEQ ID NO: 6841 - DNA, 20 bp, Artificial Sequence
  sgRNA
atcatgttcgaagtggcgtg

SEQ ID NO: 6842 - DNA, 20 bp, Artificial Sequence
  sgRNA
ggatgggctgaaataattgc

SEQ ID NO: 6843 - DNA, 20 bp, Artificial Sequence
  sgRNA
agccgttccctcggagctaa

SEQ ID NO: 6844 - DNA, 20 bp, Artificial Sequence
  sgRNA
cggcataacacggcacacac

SEQ ID NO: 6845 - DNA, 20 bp, Artificial Sequence
  sgRNA
actcaagacatcatgcagta

SEQ ID NO: 6846 - DNA, 20 bp, Artificial Sequence
  sgRNA
gtgtcacatgactctggcac

SEQ ID NO: 6847 - DNA, 20 bp, Artificial Sequence
  sgRNA
cctcagtataaagtccagcc

SEQ ID NO: 6848 - DNA, 20 bp, Artificial Sequence
  sgRNA
ctcctttcacttcgggcgag

SEQ ID NO: 6849 - DNA, 20 bp, Artificial Sequence
  sgRNA
catgttaagaattacagtac

SEQ ID NO: 6850 - DNA, 20 bp, Artificial Sequence
  sgRNA
tcagagtttccctgtgaccc

SEQ ID NO: 6851 - DNA, 20 bp, Artificial Sequence
  sgRNA
tgagatcagctgaagcccta

SEQ ID NO: 6852 - DNA, 20 bp, Artificial Sequence
  sgRNA
tgcttcgcgtgagcgccctc

SEQ ID NO: 6853 - DNA, 20 bp, Artificial Sequence
  sgRNA
tggatttattgagaagggtc

SEQ ID NO: 6854 - DNA, 20 bp, Artificial Sequence
  sgRNA
ttgagagctgggtggaagcc

SEQ ID NO: 6855 - DNA, 20 bp, Artificial Sequence
  sgRNA
tgcgcctctcgtagttaccg

SEQ ID NO: 6856 - DNA, 20 bp, Artificial Sequence
  sgRNA
cctggagaccggtacctctg

SEQ ID NO: 6857 - DNA, 20 bp, Artificial Sequence
  sgRNA
atctcaacggccagcccggc

SEQ ID NO: 6858 - DNA, 20 bp, Artificial Sequence
  sgRNA
ccaggcaacatatcaggaca

SEQ ID NO: 6859 - DNA, 20 bp, Artificial Sequence
  sgRNA
gttcgcgacgacgtcatcac

SEQ ID NO: 6860 - DNA, 20 bp, Artificial Sequence
  sgRNA
gctgtgccgcgggcaactcc

SEQ ID NO: 6861 - DNA, 20 bp, Artificial Sequence
  sgRNA
ctctcaaacttcaggatttc

SEQ ID NO: 6862 - DNA, 20 bp, Artificial Sequence
  sgRNA
tatggatgtttgtcatgcca

SEQ ID NO: 6863 - DNA, 20 bp, Artificial Sequence
  sgRNA
gtctaggagaagccaatgtg

SEQ ID NO: 6864 - DNA, 20 bp, Artificial Sequence
  sgRNA
tgggcagcccgagaccggcc

SEQ ID NO: 6865 - DNA, 20 bp, Artificial Sequence
  sgRNA
ctgaaaccaccaatcgcgac

SEQ ID NO: 6866 - DNA, 20 bp, Artificial Sequence
  sgRNA
gggctctgaaagactaagaa

SEQ ID NO: 6867 - DNA, 20 bp, Artificial Sequence
  sgRNA
tcagagcccgcgtccattcc

SEQ ID NO: 6868 - DNA, 20 bp, Artificial Sequence
  sgRNA
gggttcttcggacgggacag

SEQ ID NO: 6869 - DNA, 20 bp, Artificial Sequence
  sgRNA
tctagctcttctgacttccc

SEQ ID NO: 6870 - DNA, 20 bp, Artificial Sequence
  sgRNA
tccagctgcctggcgctctc

SEQ ID NO: 6871 - DNA, 20 bp, Artificial Sequence
  sgRNA
ctgttctctctcccgggagg

SEQ ID NO: 6872 - DNA, 20 bp, Artificial Sequence
  sgRNA
tgtgtgggacagcccatgag

SEQ ID NO: 6873 - DNA, 20 bp, Artificial Sequence
  sgRNA
cccttgcaacctctttcgct

SEQ ID NO: 6874 - DNA, 20 bp, Artificial Sequence
  sgRNA
tggttcgttagagagcctct

SEQ ID NO: 6875 - DNA, 20 bp, Artificial Sequence
  sgRNA
ttcttcgcgagactccgcct

SEQ ID NO: 6876 - DNA, 20 bp, Artificial Sequence
  sgRNA
cggccggtagctggaagagc

SEQ ID NO: 6877 - DNA, 20 bp, Artificial Sequence
  sgRNA
ctccgagccactggagcctt

SEQ ID NO: 6878 - DNA, 20 bp, Artificial Sequence
  sgRNA
actcatcacctaattcgctg

SEQ ID NO: 6879 - DNA, 20 bp, Artificial Sequence
  sgRNA
agttagggcgccgcgggagc

SEQ ID NO: 6880 - DNA, 20 bp, Artificial Sequence
  sgRNA
gtattccctggaaggtgaca

SEQ ID NO: 6881 - DNA, 20 bp, Artificial Sequence
  sgRNA
agcgcgcggcaccgcatccg

SEQ ID NO: 6882 - DNA, 20 bp, Artificial Sequence
  sgRNA
caaagtaggaaagtcagctt

SEQ ID NO: 6883 - DNA, 20 bp, Artificial Sequence
  sgRNA
ctacgaagcctccactcttc

SEQ ID NO: 6884 - DNA, 20 bp, Artificial Sequence
  sgRNA
gggtcgagacgtcggcccga

SEQ ID NO: 6885 - DNA, 20 bp, Artificial Sequence
  sgRNA
tggaaacaagttcacatttc

SEQ ID NO: 6886 - DNA, 20 bp, Artificial Sequence
  sgRNA
cgccggcctctaggtctggc

SEQ ID NO: 6887 - DNA, 20 bp, Artificial Sequence
  sgRNA
ggcgtgtcagtgccatttcc

SEQ ID NO: 6888 - DNA, 20 bp, Artificial Sequence
  sgRNA
cccggcggcggcgacggtgg

SEQ ID NO: 6889 - DNA, 20 bp, Artificial Sequence
  sgRNA
cgaagacgcttccgggagct

SEQ ID NO: 6890 - DNA, 20 bp, Artificial Sequence
  sgRNA
ggctggagcgtgagtgcgag

SEQ ID NO: 6891 - DNA, 20 bp, Artificial Sequence
  sgRNA
atgtatgaggaagaatgaca

SEQ ID NO: 6892 - DNA, 20 bp, Artificial Sequence
  sgRNA
ccacgaagaatagccctagg

SEQ ID NO: 6893 - DNA, 20 bp, Artificial Sequence
  sgRNA
actcgagggacctcccagtc

SEQ ID NO: 6894 - DNA, 20 bp, Artificial Sequence
  sgRNA
atgccctgtcagtgacctgc

SEQ ID NO: 6895 - DNA, 20 bp, Artificial Sequence
  sgRNA
agcctgaagcaagtcccgcg

SEQ ID NO: 6896 - DNA, 20 bp, Artificial Sequence
  sgRNA
attgcacgagcgtctcccgc

SEQ ID NO: 6897 - DNA, 20 bp, Artificial Sequence
  sgRNA
agaagcctggaggagagaag

SEQ ID NO: 6898 - DNA, 20 bp, Artificial Sequence
  sgRNA
tggagttaggtaacagtcac

SEQ ID NO: 6899 - DNA, 20 bp, Artificial Sequence
  sgRNA
acagttgctgctaactgccc

SEQ ID NO: 6900 - DNA, 20 bp, Artificial Sequence
  sgRNA
ggagaaaggaggatccaagc

SEQ ID NO: 6901 - DNA, 20 bp, Artificial Sequence
  sgRNA
acaagatctgttctgcctcg

SEQ ID NO: 6902 - DNA, 20 bp, Artificial Sequence
  sgRNA
gctgtacttacaaaggagag

SEQ ID NO: 6903 - DNA, 20 bp, Artificial Sequence
  sgRNA
acttgtcgctctgccgcgac

SEQ ID NO: 6904 - DNA, 20 bp, Artificial Sequence
  sgRNA
aaacattcttcgcgacacaa

SEQ ID NO: 6905 - DNA, 20 bp, Artificial Sequence
  sgRNA
cacgtaaagaactggatatg

SEQ ID NO: 6906 - DNA, 20 bp, Artificial Sequence
  sgRNA
aacagacagaagacacacaa

SEQ ID NO: 6907 - DNA, 20 bp, Artificial Sequence
  sgRNA
tatgtcaaatgtgtgtaagg

SEQ ID NO: 6908 - DNA, 20 bp, Artificial Sequence
  sgRNA
aggagcatgtcgggaataac

SEQ ID NO: 6909 - DNA, 20 bp, Artificial Sequence
  sgRNA
taagaagagggaaagggttc

SEQ ID NO: 6910 - DNA, 20 bp, Artificial Sequence
  sgRNA
ggaacaatgtttcaagactg

SEQ ID NO: 6911 - DNA, 20 bp, Artificial Sequence
  sgRNA
ctgcaagcgtttcgaagacc

SEQ ID NO: 6912 - DNA, 20 bp, Artificial Sequence
  sgRNA
aagaggccgcctgcctggca

SEQ ID NO: 6913 - DNA, 20 bp, Artificial Sequence
  sgRNA
gcactagaaacccgagaacg

SEQ ID NO: 6914 - DNA, 20 bp, Artificial Sequence
  sgRNA
gtttcctgcagagcaagcaa

SEQ ID NO: 6915 - DNA, 20 bp, Artificial Sequence
  sgRNA
attatctcccacaggcatgg

SEQ ID NO: 6916 - DNA, 20 bp, Artificial Sequence
  sgRNA
ccgaggagccaatcagaggg

SEQ ID NO: 6917 - DNA, 20 bp, Artificial Sequence
  sgRNA
ggagctagagaaagaaccca

SEQ ID NO: 6918 - DNA, 20 bp, Artificial Sequence
  sgRNA
ctgccaggagcttccggcgc

SEQ ID NO: 6919 - DNA, 20 bp, Artificial Sequence
  sgRNA
agcccggatcgcatagaccc

SEQ ID NO: 6920 - DNA, 20 bp, Artificial Sequence
  sgRNA
ggaggtcctgggtaggacag

SEQ ID NO: 6921 - DNA, 20 bp, Artificial Sequence
  sgRNA
tcaggatgaccaatgtcaac

SEQ ID NO: 6922 - DNA, 20 bp, Artificial Sequence
  sgRNA
gagtctagatatttattccc

SEQ ID NO: 6923 - DNA, 20 bp, Artificial Sequence
  sgRNA
tggaagaatcgctcactcgg

SEQ ID NO: 6924 - DNA, 20 bp, Artificial Sequence
  sgRNA
gataggtgtcggtctataaa

SEQ ID NO: 6925 - DNA, 20 bp, Artificial Sequence
  sgRNA
gttctcccgcggctcgcaca

SEQ ID NO: 6926 - DNA, 20 bp, Artificial Sequence
  sgRNA
agcttaagaggtgaatatag

SEQ ID NO: 6927 - DNA, 20 bp, Artificial Sequence
  sgRNA
ctggtatgtagtggatgccc

SEQ ID NO: 6928 - DNA, 20 bp, Artificial Sequence
  sgRNA
gaaatggtgcagggagtcta

SEQ ID NO: 6929 - DNA, 20 bp, Artificial Sequence
  sgRNA
agagtgcgagggcgaccagg

SEQ ID NO: 6930 - DNA, 20 bp, Artificial Sequence
  sgRNA
gagtaaggactgcacatttg

SEQ ID NO: 6931 - DNA, 20 bp, Artificial Sequence
  sgRNA
ggaaattcagtcattgagtg

SEQ ID NO: 6932 - DNA, 20 bp, Artificial Sequence
  sgRNA
gcggaatgatgctcaaagct

SEQ ID NO: 6933 - DNA, 20 bp, Artificial Sequence
  sgRNA
gatatccaaatagttgtttg

SEQ ID NO: 6934 - DNA, 20 bp, Artificial Sequence
  sgRNA
tatcatcgacgaccatctgg

SEQ ID NO: 6935 - DNA, 20 bp, Artificial Sequence
  sgRNA
ccaggccacggagcagggcg

SEQ ID NO: 6936 - DNA, 20 bp, Artificial Sequence
  sgRNA
aggagcttatgcctgcttgt

SEQ ID NO: 6937 - DNA, 20 bp, Artificial Sequence
  sgRNA
ggaacgatgatgaggagctg

SEQ ID NO: 6938 - DNA, 20 bp, Artificial Sequence
  sgRNA
taatgctcagatctgataag

SEQ ID NO: 6939 - DNA, 20 bp, Artificial Sequence
  sgRNA
agaactagccctggtgaagt

SEQ ID NO: 6940 - DNA, 20 bp, Artificial Sequence
  sgRNA
gggcgggacctgacaggctt

SEQ ID NO: 6941 - DNA, 20 bp, Artificial Sequence
  sgRNA
gcgcaggaaggaggtgccgc

SEQ ID NO: 6942 - DNA, 20 bp, Artificial Sequence
  sgRNA
ttgggacatggattggacaa

SEQ ID NO: 6943 - DNA, 20 bp, Artificial Sequence
  sgRNA
cttcctccggtgactgtgcc

SEQ ID NO: 6944 - DNA, 20 bp, Artificial Sequence
  sgRNA
acgagcatccttgcatctgc

SEQ ID NO: 6945 - DNA, 20 bp, Artificial Sequence
  sgRNA
ggcacgtcaccagtgagatc

SEQ ID NO: 6946 - DNA, 20 bp, Artificial Sequence
  sgRNA
aggctgctagagtgggccgc

SEQ ID NO: 6947 - DNA, 20 bp, Artificial Sequence
  sgRNA
cggaatcacggtcgtgggcg

SEQ ID NO: 6948 - DNA, 20 bp, Artificial Sequence
  sgRNA
atgctgactttctcggagcc

SEQ ID NO: 6949 - DNA, 20 bp, Artificial Sequence
  sgRNA
ggctaatctcacaaattcac

SEQ ID NO: 6950 - DNA, 20 bp, Artificial Sequence
  sgRNA
gggaatcacttgtgtagctc

SEQ ID NO: 6951 - DNA, 20 bp, Artificial Sequence
  sgRNA
aagtccaataatccctctat

SEQ ID NO: 6952 - DNA, 20 bp, Artificial Sequence
  sgRNA
tcacccatctgagtccttca

SEQ ID NO: 6953 - DNA, 20 bp, Artificial Sequence
  sgRNA
cgaggaggcccggcagcgtg

SEQ ID NO: 6954 - DNA, 20 bp, Artificial Sequence
  sgRNA
tacccatgaacacaggccac

SEQ ID NO: 6955 - DNA, 20 bp, Artificial Sequence
  sgRNA
gttaacgattggcgagatct

SEQ ID NO: 6956 - DNA, 20 bp, Artificial Sequence
  sgRNA
tagaaactctaacggatgtc

SEQ ID NO: 6957 - DNA, 20 bp, Artificial Sequence
  sgRNA
gaatgggtcgggagacacgg

SEQ ID NO: 6958 - DNA, 20 bp, Artificial Sequence
  sgRNA
gcgcctggcttacgaataat

SEQ ID NO: 6959 - DNA, 20 bp, Artificial Sequence
  sgRNA
agggagggaagagagcaagg

SEQ ID NO: 6960 - DNA, 20 bp, Artificial Sequence
  sgRNA
ctgacccacgtgggccggtt

SEQ ID NO: 6961 - DNA, 20 bp, Artificial Sequence
  sgRNA
aatgagccaagagagagtgc

SEQ ID NO: 6962 - DNA, 20 bp, Artificial Sequence
  sgRNA
ctgtgagtaagcgaacaagc

SEQ ID NO: 6963 - DNA, 20 bp, Artificial Sequence
  sgRNA
gggacgtctccttctgtttg

SEQ ID NO: 6964 - DNA, 20 bp, Artificial Sequence
  sgRNA
actcgtggagctgagccgcc

SEQ ID NO: 6965 - DNA, 20 bp, Artificial Sequence
  sgRNA
atagagagatcctaggaggg

SEQ ID NO: 6966 - DNA, 20 bp, Artificial Sequence
  sgRNA
gtcagaacatcaaaggatgg

SEQ ID NO: 6967 - DNA, 20 bp, Artificial Sequence
  sgRNA
gactccttcagagttgagaa

SEQ ID NO: 6968 - DNA, 20 bp, Artificial Sequence
  sgRNA
gtcaaagagactggtaatct

SEQ ID NO: 6969 - DNA, 20 bp, Artificial Sequence
  sgRNA
tcagccctctcacgctccgg

SEQ ID NO: 6970 - DNA, 20 bp, Artificial Sequence
  sgRNA
cagccacaatgaagtaccca

SEQ ID NO: 6971 - DNA, 20 bp, Artificial Sequence
  sgRNA
gctgtgactcatggcgttcc

SEQ ID NO: 6972 - DNA, 20 bp, Artificial Sequence
  sgRNA
cctggcccgctgtgccttgc

SEQ ID NO: 6973 - DNA, 20 bp, Artificial Sequence
  sgRNA
gttgctaagcaacatttaga

SEQ ID NO: 6974 - DNA, 20 bp, Artificial Sequence
  sgRNA
atacggtctcgtgggccgat

SEQ ID NO: 6975 - DNA, 20 bp, Artificial Sequence
  sgRNA
cttgttaaggttacaagtcc

SEQ ID NO: 6976 - DNA, 20 bp, Artificial Sequence
  sgRNA
tgcttcctgagtgtgagcgc

SEQ ID NO: 6977 - DNA, 20 bp, Artificial Sequence
  sgRNA
gacttcacgttctctaggct

SEQ ID NO: 6978 - DNA, 20 bp, Artificial Sequence
  sgRNA
tgggatagaaatcacaacgc

SEQ ID NO: 6979 - DNA, 20 bp, Artificial Sequence
  sgRNA
agtttcactctggcgtacaa

SEQ ID NO: 6980 - DNA, 20 bp, Artificial Sequence
  sgRNA
gttgtaaggagcaagattta

SEQ ID NO: 6981 - DNA, 20 bp, Artificial Sequence
  sgRNA
tgacggcccgccggcccaac

SEQ ID NO: 6982 - DNA, 20 bp, Artificial Sequence
  sgRNA
cctttcacaccggaacctga

SEQ ID NO: 6983 - DNA, 20 bp, Artificial Sequence
  sgRNA
tacagcaagctatggctgag

SEQ ID NO: 6984 - DNA, 20 bp, Artificial Sequence
  sgRNA
agcatgcgcagaacagccgg

SEQ ID NO: 6985 - DNA, 20 bp, Artificial Sequence
  sgRNA
ttcagattgtactctgtacg

SEQ ID NO: 6986 - DNA, 20 bp, Artificial Sequence
  sgRNA
tgtgccgaccttgagcgccc

SEQ ID NO: 6987 - DNA, 20 bp, Artificial Sequence
  sgRNA
gacgtcatgctcagtgcccg

SEQ ID NO: 6988 - DNA, 20 bp, Artificial Sequence
  sgRNA
aaagattatggtaagcatgc

SEQ ID NO: 6989 - DNA, 20 bp, Artificial Sequence
  sgRNA
gttaaaggtcaatctaagca

SEQ ID NO: 6990 - DNA, 20 bp, Artificial Sequence
  sgRNA
cagaagccagaacccgtgtc

SEQ ID NO: 6991 - DNA, 20 bp, Artificial Sequence
  sgRNA
gcatacttcgagcattcctt

SEQ ID NO: 6992 - DNA, 20 bp, Artificial Sequence
  sgRNA
aaccacatgctttctgcctc

SEQ ID NO: 6993 - DNA, 20 bp, Artificial Sequence
  sgRNA
attggtcgagagcgatgcgg

SEQ ID NO: 6994 - DNA, 20 bp, Artificial Sequence
  sgRNA
tgtgattggacggagcgcgg

SEQ ID NO: 6995 - DNA, 20 bp, Artificial Sequence
  sgRNA
tggctggctgtacgtgagaa

SEQ ID NO: 6996 - DNA, 20 bp, Artificial Sequence
  sgRNA
actccgaggaccaatcggtg

SEQ ID NO: 6997 - DNA, 20 bp, Artificial Sequence
  sgRNA
actagtgctatctttaagac

SEQ ID NO: 6998 - DNA, 20 bp, Artificial Sequence
  sgRNA
gacgagcgctgcgccagcga

SEQ ID NO: 6999 - DNA, 20 bp, Artificial Sequence
  sgRNA
ctagggtagagcgggagctg

SEQ ID NO: 7000 - DNA, 20 bp, Artificial Sequence
  sgRNA
ctctgaagccaggcagattg

SEQ ID NO: 7001 - DNA, 20 bp, Artificial Sequence
  sgRNA
cctgacggcagtcgaaacac

SEQ ID NO: 7002 - DNA, 20 bp, Artificial Sequence
  sgRNA
atagagttcgagaggacgtc

SEQ ID NO: 7003 - DNA, 20 bp, Artificial Sequence
  sgRNA
caaactgctggcgagtcaag

SEQ ID NO: 7004 - DNA, 20 bp, Artificial Sequence
  sgRNA
agacagtaacacccatcttc

SEQ ID NO: 7005 - DNA, 20 bp, Artificial Sequence
  sgRNA
ggcgcgcaaagagtgaccgc

SEQ ID NO: 7006 - DNA, 20 bp, Artificial Sequence
  sgRNA
taagggcaggccacagagtg

SEQ ID NO: 7007 - DNA, 20 bp, Artificial Sequence
  sgRNA
gggaggacagcatttagctc

SEQ ID NO: 7008 - DNA, 20 bp, Artificial Sequence
  sgRNA
gtccctgacacttcctttcc

SEQ ID NO: 7009 - DNA, 20 bp, Artificial Sequence
  sgRNA
atgaaagggcgagcccacgc

SEQ ID NO: 7010 - DNA, 20 bp, Artificial Sequence
  sgRNA
tcctaggatgttacacttgg

SEQ ID NO: 7011 - DNA, 20 bp, Artificial Sequence
  sgRNA
gctgactcccggcgcgttgg

SEQ ID NO: 7012 - DNA, 20 bp, Artificial Sequence
  sgRNA
agcggtgtaattaaacaagc

SEQ ID NO: 7013 - DNA, 20 bp, Artificial Sequence
  sgRNA
ctggtgatgagtcagtgccc

SEQ ID NO: 7014 - DNA, 20 bp, Artificial Sequence
  sgRNA
aaccacagaaccacaaggcc

SEQ ID NO: 7015 - DNA, 20 bp, Artificial Sequence
  sgRNA
gtacatctattacgttcgtc

SEQ ID NO: 7016 - DNA, 20 bp, Artificial Sequence
  sgRNA
agtggagtgtaaacgcgggc

SEQ ID NO: 7017 - DNA, 20 bp, Artificial Sequence
  sgRNA
gtgggacaaagaactacttc

SEQ ID NO: 7018 - DNA, 20 bp, Artificial Sequence
  sgRNA
ctcacacttatgccctggtc

SEQ ID NO: 7019 - DNA, 20 bp, Artificial Sequence
  sgRNA
gtaactagagtgtcagaaca

SEQ ID NO: 7020 - DNA, 20 bp, Artificial Sequence
  sgRNA
ccaatgcagaactttgcatc

SEQ ID NO: 7021 - DNA, 20 bp, Artificial Sequence
  sgRNA
aggagtggaaggtggcgaca

SEQ ID NO: 7022 - DNA, 20 bp, Artificial Sequence
  sgRNA
gcgccgtagtcgccgtgagt

SEQ ID NO: 7023 - DNA, 20 bp, Artificial Sequence
  sgRNA
tattagcgtgcacttcacaa

SEQ ID NO: 7024 - DNA, 20 bp, Artificial Sequence
  sgRNA
gtttccaggcaggctgcggg

SEQ ID NO: 7025 - DNA, 20 bp, Artificial Sequence
  sgRNA
tgcacgatggcaggagaaag

SEQ ID NO: 7026 - DNA, 20 bp, Artificial Sequence
  sgRNA
ggagtcgctgtggaaataca

SEQ ID NO: 7027 - DNA, 20 bp, Artificial Sequence
  sgRNA
attgctactttgcactgcaa

SEQ ID NO: 7028 - DNA, 20 bp, Artificial Sequence
  sgRNA
ccgcaaaggttggccacgtg

SEQ ID NO: 7029 - DNA, 20 bp, Artificial Sequence
  sgRNA
gattgaacaatgacagcttt

SEQ ID NO: 7030 - DNA, 20 bp, Artificial Sequence
  sgRNA
acgaggcccaactcattccc

SEQ ID NO: 7031 - DNA, 20 bp, Artificial Sequence
  sgRNA
ggatgttctgagaggctcag

SEQ ID NO: 7032 - DNA, 20 bp, Artificial Sequence
  sgRNA
cccggcgccggagcgagaag

SEQ ID NO: 7033 - DNA, 20 bp, Artificial Sequence
  sgRNA
tggctggccgctcgaggtgg

SEQ ID NO: 7034 - DNA, 20 bp, Artificial Sequence
  sgRNA
gtactagctgcgggtgctgc

SEQ ID NO: 7035 - DNA, 20 bp, Artificial Sequence
  sgRNA
gcatctgtgtgactgtgttg

SEQ ID NO: 7036 - DNA, 20 bp, Artificial Sequence
  sgRNA
ggctgcaagtcaccagactg

SEQ ID NO: 7037 - DNA, 20 bp, Artificial Sequence
  sgRNA
agtcaaagttcagcaggaaa

SEQ ID NO: 7038 - DNA, 20 bp, Artificial Sequence
  sgRNA
gaaacagtacttccggcctc

SEQ ID NO: 7039 - DNA, 20 bp, Artificial Sequence
  sgRNA
ggtggaggaggcccacctgt

SEQ ID NO: 7040 - DNA, 20 bp, Artificial Sequence
  sgRNA
cttagcactctcagtataag

SEQ ID NO: 7041 - DNA, 20 bp, Artificial Sequence
  sgRNA
tgtgagggtggattaagtac

SEQ ID NO: 7042 - DNA, 20 bp, Artificial Sequence
  sgRNA
aggaactgggtgttgagata

SEQ ID NO: 7043 - DNA, 20 bp, Artificial Sequence
  sgRNA
agtcgggcgtggctcgaaag

SEQ ID NO: 7044 - DNA, 20 bp, Artificial Sequence
  sgRNA
ccagacccggagttaaaggg

SEQ ID NO: 7045 - DNA, 20 bp, Artificial Sequence
  sgRNA
gcaaggtaaatgcaaacaac

SEQ ID NO: 7046 - DNA, 20 bp, Artificial Sequence
  sgRNA
gggacgacccaggagtgaag

SEQ ID NO: 7047 - DNA, 20 bp, Artificial Sequence
  sgRNA
attaggagtgagtgctgcgc

SEQ ID NO: 7048 - DNA, 20 bp, Artificial Sequence
  sgRNA
ctaggtaagtggatggtgag

SEQ ID NO: 7049 - DNA, 20 bp, Artificial Sequence
  sgRNA
aggacagcagaagcaggagc

SEQ ID NO: 7050 - DNA, 20 bp, Artificial Sequence
  sgRNA
tgacactatagtgagctgca

SEQ ID NO: 7051 - DNA, 20 bp, Artificial Sequence
  sgRNA
gagcgctgggcaggtgatgg

SEQ ID NO: 7052 - DNA, 20 bp, Artificial Sequence
  sgRNA
attctagagaagctttaggg

SEQ ID NO: 7053 - DNA, 20 bp, Artificial Sequence
  sgRNA
tttcctgtaacagctctgat

SEQ ID NO: 7054 - DNA, 20 bp, Artificial Sequence
  sgRNA
tttatggtaaggcgcgcgcg

SEQ ID NO: 7055 - DNA, 20 bp, Artificial Sequence
  sgRNA
tgaattcggagtgctcgtgg

SEQ ID NO: 7056 - DNA, 20 bp, Artificial Sequence
  sgRNA
gggaggagctgaagtcgccg

SEQ ID NO: 7057 - DNA, 20 bp, Artificial Sequence
  sgRNA
gagagtgaggtgagtgttgc

SEQ ID NO: 7058 - DNA, 20 bp, Artificial Sequence
  sgRNA
cttcctgtggcgaccctgcg

SEQ ID NO: 7059 - DNA, 20 bp, Artificial Sequence
  sgRNA
aaggaaccagattagtgtgc

SEQ ID NO: 7060 - DNA, 20 bp, Artificial Sequence
  sgRNA
gggattccgcaagggttcgt

SEQ ID NO: 7061 - DNA, 20 bp, Artificial Sequence
  sgRNA
cagtgtatcacaggcagagg

SEQ ID NO: 7062 - DNA, 20 bp, Artificial Sequence
  sgRNA
agagagcactgtgcaatcaa

SEQ ID NO: 7063 - DNA, 20 bp, Artificial Sequence
  sgRNA
ttgttggtcctgagcgagcc

SEQ ID NO: 7064 - DNA, 20 bp, Artificial Sequence
  sgRNA
aaatgtctataaccgatacc

SEQ ID NO: 7065 - DNA, 20 bp, Artificial Sequence
  sgRNA
cgctccaggtgtctgttccg

SEQ ID NO: 7066 - DNA, 20 bp, Artificial Sequence
  sgRNA
ctactcctaacctgaaagtc

SEQ ID NO: 7067 - DNA, 20 bp, Artificial Sequence
  sgRNA
gagctcggtttcgaggtcct

SEQ ID NO: 7068 - DNA, 20 bp, Artificial Sequence
  sgRNA
tccagtcagcatgtgggcgg

SEQ ID NO: 7069 - DNA, 20 bp, Artificial Sequence
  sgRNA
tgtgcccgcctgccaccgcc

SEQ ID NO: 7070 - DNA, 20 bp, Artificial Sequence
  sgRNA
tagagcacccacaccacaga

SEQ ID NO: 7071 - DNA, 20 bp, Artificial Sequence
  sgRNA
gaatgtgcgtatgttataaa

SEQ ID NO: 7072 - DNA, 20 bp, Artificial Sequence
  sgRNA
gctttatgcctgggcatagt

SEQ ID NO: 7073 - DNA, 20 bp, Artificial Sequence
  sgRNA
tgctctggcttggacgaagg

SEQ ID NO: 7074 - DNA, 20 bp, Artificial Sequence
  sgRNA
ggcggctgcggcgctgacac

SEQ ID NO: 7075 - DNA, 20 bp, Artificial Sequence
  sgRNA
aagagctagtcaaaccttca

SEQ ID NO: 7076 - DNA, 20 bp, Artificial Sequence
  sgRNA
cctcggctctgaacaaggcc

SEQ ID NO: 7077 - DNA, 20 bp, Artificial Sequence
  sgRNA
acgagattcagcgttcagta

SEQ ID NO: 7078 - DNA, 20 bp, Artificial Sequence
  sgRNA
gctggcgtaacgatgggatg

SEQ ID NO: 7079 - DNA, 20 bp, Artificial Sequence
  sgRNA
agagccgagacgcttaagaa

SEQ ID NO: 7080 - DNA, 20 bp, Artificial Sequence
  sgRNA
ccagatcacccagcaggtat

SEQ ID NO: 7081 - DNA, 20 bp, Artificial Sequence
  sgRNA
ttaacattaagatcaaaggc

SEQ ID NO: 7082 - DNA, 20 bp, Artificial Sequence
  sgRNA
gtctccctggtctctcggag

SEQ ID NO: 7083 - DNA, 20 bp, Artificial Sequence
  sgRNA
ggctgccgggaagctacact

SEQ ID NO: 7084 - DNA, 20 bp, Artificial Sequence
  sgRNA
caaacgttctgtatagggat

SEQ ID NO: 7085 - DNA, 20 bp, Artificial Sequence
  sgRNA
cggaagaccgctcggaaagg

SEQ ID NO: 7086 - DNA, 20 bp, Artificial Sequence
  sgRNA
ggctccttcctcccgcccat

SEQ ID NO: 7087 - DNA, 20 bp, Artificial Sequence
  sgRNA
ctagattaacagtactaacg

SEQ ID NO: 7088 - DNA, 20 bp, Artificial Sequence
  sgRNA
caaatgtcatggctcttcat

SEQ ID NO: 7089 - DNA, 20 bp, Artificial Sequence
  sgRNA
gctagcgtctcgaatggcac

SEQ ID NO: 7090 - DNA, 20 bp, Artificial Sequence
  sgRNA
ggataggatagacagatggc

SEQ ID NO: 7091 - DNA, 20 bp, Artificial Sequence
  sgRNA
gtaaatctcaaagtcaatcg

SEQ ID NO: 7092 - DNA, 20 bp, Artificial Sequence
  sgRNA
atgaggattgcctagttgag

SEQ ID NO: 7093 - DNA, 20 bp, Artificial Sequence
  sgRNA
actcgcccacctttcacctt

SEQ ID NO: 7094 - DNA, 20 bp, Artificial Sequence
  sgRNA
cctctggatcgcttgctccc

SEQ ID NO: 7095 - DNA, 20 bp, Artificial Sequence
  sgRNA
gtgacaaagagaatcattgc

SEQ ID NO: 7096 - DNA, 20 bp, Artificial Sequence
  sgRNA
gggcgcgcgcaggctttgtc

SEQ ID NO: 7097 - DNA, 20 bp, Artificial Sequence
  sgRNA
cagtgacaattccggccagt

SEQ ID NO: 7098 - DNA, 20 bp, Artificial Sequence
  sgRNA
ctctgttagtgatcactatt

SEQ ID NO: 7099 - DNA, 20 bp, Artificial Sequence
  sgRNA
catacacctgaggagctact

SEQ ID NO: 7100 - DNA, 20 bp, Artificial Sequence
  sgRNA
gagagagatggaaactaaga

SEQ ID NO: 7101 - DNA, 20 bp, Artificial Sequence
  sgRNA
cggagcctagctaccagtgg

SEQ ID NO: 7102 - DNA, 20 bp, Artificial Sequence
  sgRNA
ggagccagcagcgcgctgtc

SEQ ID NO: 7103 - DNA, 20 bp, Artificial Sequence
  sgRNA
cggtgaaggaggtctacttt

SEQ ID NO: 7104 - DNA, 20 bp, Artificial Sequence
  sgRNA
gcggcattcctaaggtgggt

SEQ ID NO: 7105 - DNA, 20 bp, Artificial Sequence
  sgRNA
actagggtcgatcgtattgt

SEQ ID NO: 7106 - DNA, 20 bp, Artificial Sequence
  sgRNA
agcagggtattctgggaggc

SEQ ID NO: 7107 - DNA, 20 bp, Artificial Sequence
  sgRNA
gggactcttaaatcggcgcc

SEQ ID NO: 7108 - DNA, 20 bp, Artificial Sequence
  sgRNA
aactaacattggtctgtctg

SEQ ID NO: 7109 - DNA, 20 bp, Artificial Sequence
  sgRNA
cgcgcaatgctcaccgtccg

SEQ ID NO: 7110 - DNA, 20 bp, Artificial Sequence
  sgRNA
gtgcttcgtgtgcatatgtt

SEQ ID NO: 7111 - DNA, 20 bp, Artificial Sequence
  sgRNA
tagaatgtctgggtggaaca

SEQ ID NO: 7112 - DNA, 20 bp, Artificial Sequence
  sgRNA
ggcggtcctggagtcgctcg

SEQ ID NO: 7113 - DNA, 20 bp, Artificial Sequence
  sgRNA
gaagggcaggccggtggccg

SEQ ID NO: 7114 - DNA, 20 bp, Artificial Sequence
  sgRNA
ctgcgcgcgcgctctagatc

SEQ ID NO: 7115 - DNA, 20 bp, Artificial Sequence
  sgRNA
agaggacccgcatatatacc

SEQ ID NO: 7116 - DNA, 20 bp, Artificial Sequence
  sgRNA
tgtttgcggctgggcctcat

SEQ ID NO: 7117 - DNA, 20 bp, Artificial Sequence
  sgRNA
aaactggaggaagtaaaggg

SEQ ID NO: 7118 - DNA, 20 bp, Artificial Sequence
  sgRNA
gcgggaccatagagagcccg

SEQ ID NO: 7119 - DNA, 20 bp, Artificial Sequence
  sgRNA
aagcaagatggccgcaccgg

SEQ ID NO: 7120 - DNA, 20 bp, Artificial Sequence
  sgRNA
attggtccctgcatgcgacc

SEQ ID NO: 7121 - DNA, 20 bp, Artificial Sequence
  sgRNA
tcgaaagttactagtgggaa

SEQ ID NO: 7122 - DNA, 20 bp, Artificial Sequence
  sgRNA
aggatgtgttacctagtgcg

SEQ ID NO: 7123 - DNA, 20 bp, Artificial Sequence
  sgRNA
agactctcccgcttgattgg

SEQ ID NO: 7124 - DNA, 20 bp, Artificial Sequence
  sgRNA
gcttagctgctggaactagg

SEQ ID NO: 7125 - DNA, 20 bp, Artificial Sequence
  sgRNA
gggtgtaccggacgaattgc

SEQ ID NO: 7126 - DNA, 20 bp, Artificial Sequence
  sgRNA
aaaccttgcctgagcactag

SEQ ID NO: 7127 - DNA, 20 bp, Artificial Sequence
  sgRNA
gcgaggccagcacggctctg

SEQ ID NO: 7128 - DNA, 20 bp, Artificial Sequence
  sgRNA
tttgctgatcaaagagcaac

SEQ ID NO: 7129 - DNA, 20 bp, Artificial Sequence
  sgRNA
aagaacgtgactgatagctg

SEQ ID NO: 7130 - DNA, 20 bp, Artificial Sequence
  sgRNA
tgtttgaagacccagggcac

SEQ ID NO: 7131 - DNA, 20 bp, Artificial Sequence
  sgRNA
caaacagcagtaggacgcta

SEQ ID NO: 7132 - DNA, 20 bp, Artificial Sequence
  sgRNA
actgtcaagagctgtcatga

SEQ ID NO: 7133 - DNA, 20 bp, Artificial Sequence
  sgRNA
aggagtatatgtttaagcag

SEQ ID NO: 7134 - DNA, 20 bp, Artificial Sequence
  sgRNA
caactgtgctcctgtaccca

SEQ ID NO: 7135 - DNA, 20 bp, Artificial Sequence
  sgRNA
ttgttgagagaccatatgaa

SEQ ID NO: 7136 - DNA, 20 bp, Artificial Sequence
  sgRNA
ttaacccatgctggatttgc

SEQ ID NO: 7137 - DNA, 20 bp, Artificial Sequence
  sgRNA
agagcaaggcgtcgcacaaa

SEQ ID NO: 7138 - DNA, 20 bp, Artificial Sequence
  sgRNA
ggagctgtcggccgcatttg

SEQ ID NO: 7139 - DNA, 20 bp, Artificial Sequence
  sgRNA
gcagtgtgagatgtgtcagg

SEQ ID NO: 7140 - DNA, 20 bp, Artificial Sequence
  sgRNA
gagctgcggagggtcagtct

SEQ ID NO: 7141 - DNA, 20 bp, Artificial Sequence
  sgRNA
tgagtcctaaatccctgaga

SEQ ID NO: 7142 - DNA, 20 bp, Artificial Sequence
  sgRNA
ggcaccttgaaacgcgaggg

SEQ ID NO: 7143 - DNA, 20 bp, Artificial Sequence
  sgRNA
gggcggtagaaaggacgcgg

SEQ ID NO: 7144 - DNA, 20 bp, Artificial Sequence
  sgRNA
ggacacggccgcctcgcgga

SEQ ID NO: 7145 - DNA, 20 bp, Artificial Sequence
  sgRNA
acgtcaggcggcgtcacgcg

SEQ ID NO: 7146 - DNA, 20 bp, Artificial Sequence
  sgRNA
cgcactggccggcccggccg

SEQ ID NO: 7147 - DNA, 20 bp, Artificial Sequence
  sgRNA
cttctggagtcaaggttgtt

SEQ ID NO: 7148 - DNA, 20 bp, Artificial Sequence
  sgRNA
gagagggctcgccacagttc

SEQ ID NO: 7149 - DNA, 20 bp, Artificial Sequence
  sgRNA
gttatgcaagctcagactgc

SEQ ID NO: 7150 - DNA, 20 bp, Artificial Sequence
  sgRNA
gaagcctctgcgcaggcgag

SEQ ID NO: 7151 - DNA, 20 bp, Artificial Sequence
  sgRNA
ggccatattgcgcagggagg

SEQ ID NO: 7152 - DNA, 20 bp, Artificial Sequence
  sgRNA
gtgtgtgctctggctttctt

SEQ ID NO: 7153 - DNA, 20 bp, Artificial Sequence
  sgRNA
ggcgcacaaaggaagcgcgc

SEQ ID NO: 7154 - DNA, 20 bp, Artificial Sequence
  sgRNA
gtaatttcatccttatctcc

SEQ ID NO: 7155 - DNA, 20 bp, Artificial Sequence
  sgRNA
aactgccttgcaatccaatc

SEQ ID NO: 7156 - DNA, 20 bp, Artificial Sequence
  sgRNA
gaggccaggactaggagcac

SEQ ID NO: 7157 - DNA, 20 bp, Artificial Sequence
  sgRNA
aatgagctacctggatgttg

SEQ ID NO: 7158 - DNA, 20 bp, Artificial Sequence
  sgRNA
cccgccgggaacgcgtcctg

SEQ ID NO: 7159 - DNA, 20 bp, Artificial Sequence
  sgRNA
accggtttaaagagatagag

SEQ ID NO: 7160 - DNA, 20 bp, Artificial Sequence
  sgRNA
tgtaagccgtgctagcactg

SEQ ID NO: 7161 - DNA, 20 bp, Artificial Sequence
  sgRNA
ggttctcaagaacctggcat

SEQ ID NO: 7162 - DNA, 20 bp, Artificial Sequence
  sgRNA
gagatagtcctctctcatgg

SEQ ID NO: 7163 - DNA, 20 bp, Artificial Sequence
  sgRNA
acacacagaaccagttgttc

SEQ ID NO: 7164 - DNA, 20 bp, Artificial Sequence
  sgRNA
tttattgggcctccgaagcg

SEQ ID NO: 7165 - DNA, 20 bp, Artificial Sequence
  sgRNA
acccatttatatcctgacaa

SEQ ID NO: 7166 - DNA, 20 bp, Artificial Sequence
  sgRNA
ctaaggaaggagagcctcga

SEQ ID NO: 7167 - DNA, 20 bp, Artificial Sequence
  sgRNA
aagaaactgataatgtgcac

SEQ ID NO: 7168 - DNA, 20 bp, Artificial Sequence
  sgRNA
ggagtatcccaaaggaggtg

SEQ ID NO: 7169 - DNA, 20 bp, Artificial Sequence
  sgRNA
ctcacgtgagcgacagagat

SEQ ID NO: 7170 - DNA, 20 bp, Artificial Sequence
  sgRNA
gcttggagacctgccgcgcc

SEQ ID NO: 7171 - DNA, 20 bp, Artificial Sequence
  sgRNA
tgtatggttgccttatctcg

SEQ ID NO: 7172 - DNA, 20 bp, Artificial Sequence
  sgRNA
ctggtcacgcaatgctttgt

SEQ ID NO: 7173 - DNA, 20 bp, Artificial Sequence
  sgRNA
ttggccactggtttggcttg

SEQ ID NO: 7174 - DNA, 20 bp, Artificial Sequence
  sgRNA
ggataatgaatggaatgccc

SEQ ID NO: 7175 - DNA, 20 bp, Artificial Sequence
  sgRNA
cagagtcaagaaaggaagtg

SEQ ID NO: 7176 - DNA, 20 bp, Artificial Sequence
  sgRNA
tgcaggaagcttcactgtgc

SEQ ID NO: 7177 - DNA, 20 bp, Artificial Sequence
  sgRNA
gggcgggacaaccgtcacca

SEQ ID NO: 7178 - DNA, 20 bp, Artificial Sequence
  sgRNA
acagacagtgcggaacagag

SEQ ID NO: 7179 - DNA, 20 bp, Artificial Sequence
  sgRNA
accaaggagtaaaggacttc

SEQ ID NO: 7180 - DNA, 20 bp, Artificial Sequence
  sgRNA
gcggccagcctctgggcaga

SEQ ID NO: 7181 - DNA, 20 bp, Artificial Sequence
  sgRNA
cagaggtgtgtgctgatgta

SEQ ID NO: 7182 - DNA, 20 bp, Artificial Sequence
  sgRNA
gcgggagaatttcatcccgt

SEQ ID NO: 7183 - DNA, 20 bp, Artificial Sequence
  sgRNA
gcagaatttgtaccgatagc

SEQ ID NO: 7184 - DNA, 20 bp, Artificial Sequence
  sgRNA
atgttggcacagtaaagagg

SEQ ID NO: 7185 - DNA, 20 bp, Artificial Sequence
  sgRNA
gggctctggctgaatgggat

SEQ ID NO: 7186 - DNA, 20 bp, Artificial Sequence
  sgRNA
ctcagtcacgttgtctagct

SEQ ID NO: 7187 - DNA, 20 bp, Artificial Sequence
  sgRNA
gagggtggcagaagggcttc

SEQ ID NO: 7188 - DNA, 20 bp, Artificial Sequence
  sgRNA
agtgtgcggctgtgcagagg

SEQ ID NO: 7189 - DNA, 20 bp, Artificial Sequence
  sgRNA
gcactggtggtactgggagg

SEQ ID NO: 7190 - DNA, 20 bp, Artificial Sequence
  sgRNA
ttggtaggaaggaagccagc

SEQ ID NO: 7191 - DNA, 20 bp, Artificial Sequence
  sgRNA
ccctgtcctctgcagctact

SEQ ID NO: 7192 - DNA, 20 bp, Artificial Sequence
  sgRNA
gcagccaaagcagatcgtga

SEQ ID NO: 7193 - DNA, 20 bp, Artificial Sequence
  sgRNA
aacttcccaactgggtttgt

SEQ ID NO: 7194 - DNA, 20 bp, Artificial Sequence
  sgRNA
tgcgggctcgggcgctgagg

SEQ ID NO: 7195 - DNA, 20 bp, Artificial Sequence
  sgRNA
tggtgatgctggtggtgcgc

SEQ ID NO: 7196 - DNA, 20 bp, Artificial Sequence
  sgRNA
ctgttctccttccgtccact

SEQ ID NO: 7197 - DNA, 20 bp, Artificial Sequence
  sgRNA
gcccttcccgcagaaactgg

SEQ ID NO: 7198 - DNA, 20 bp, Artificial Sequence
  sgRNA
atgactggctgcgaaccggg

SEQ ID NO: 7199 - DNA, 20 bp, Artificial Sequence
  sgRNA
tggttattgattgacttgtg

SEQ ID NO: 7200 - DNA, 20 bp, Artificial Sequence
  sgRNA
attatgcagtgtaaatgagc

SEQ ID NO: 7201 - DNA, 20 bp, Artificial Sequence
  sgRNA
aggaagaggaggcaggaagc

SEQ ID NO: 7202 - DNA, 20 bp, Artificial Sequence
  sgRNA
aacagggagggagctaacct

SEQ ID NO: 7203 - DNA, 20 bp, Artificial Sequence
  sgRNA
aagcattctggctccaatcc

SEQ ID NO: 7204 - DNA, 20 bp, Artificial Sequence
  sgRNA
ggcctggtgcgcaggccctt

SEQ ID NO: 7205 - DNA, 20 bp, Artificial Sequence
  sgRNA
aaccgaagatctcaccggag

SEQ ID NO: 7206 - DNA, 20 bp, Artificial Sequence
  sgRNA
ggttctctaacagctgttgt

SEQ ID NO: 7207 - DNA, 20 bp, Artificial Sequence
  sgRNA
ccagactcctaccaagcctc

SEQ ID NO: 7208 - DNA, 20 bp, Artificial Sequence
  sgRNA
agcatactctgaacagataa

SEQ ID NO: 7209 - DNA, 20 bp, Artificial Sequence
  sgRNA
ggtataagtcacaggaggcc

SEQ ID NO: 7210 - DNA, 20 bp, Artificial Sequence
  sgRNA
agtcctgcccaatcacaaga

SEQ ID NO: 7211 - DNA, 20 bp, Artificial Sequence
  sgRNA
ccacacttgcttgtattcag

SEQ ID NO: 7212 - DNA, 20 bp, Artificial Sequence
  sgRNA
ccgtggaactcgagcgatcc

SEQ ID NO: 7213 - DNA, 20 bp, Artificial Sequence
  sgRNA
ggaggcagctccgggcccgg

SEQ ID NO: 7214 - DNA, 20 bp, Artificial Sequence
  sgRNA
tctgggcaagagcgcggcac

SEQ ID NO: 7215 - DNA, 20 bp, Artificial Sequence
  sgRNA
gtgaggatctttgctgcaga

SEQ ID NO: 7216 - DNA, 20 bp, Artificial Sequence
  sgRNA
agcttgtttgggctccgtac

SEQ ID NO: 7217 - DNA, 20 bp, Artificial Sequence
  sgRNA
acgcgggagcgcacagtcag

SEQ ID NO: 7218 - DNA, 20 bp, Artificial Sequence
  sgRNA
cgcgcactgcgaaagtgaga

SEQ ID NO: 7219 - DNA, 20 bp, Artificial Sequence
  sgRNA
gtcggtgaggaggtgcaagg

SEQ ID NO: 7220 - DNA, 20 bp, Artificial Sequence
  sgRNA
gtggaccttgctgaacttat

SEQ ID NO: 7221 - DNA, 20 bp, Artificial Sequence
  sgRNA
aagtgagggacttcgaggcc

SEQ ID NO: 7222 - DNA, 20 bp, Artificial Sequence
  sgRNA
tggttgtaagggattgggcc

SEQ ID NO: 7223 - DNA, 20 bp, Artificial Sequence
  sgRNA
gagaggcgttagataccgtt

SEQ ID NO: 7224 - DNA, 20 bp, Artificial Sequence
  sgRNA
tcacagtactcaaagtaaag

SEQ ID NO: 7225 - DNA, 20 bp, Artificial Sequence
  sgRNA
ggatccctggctgggcggac

SEQ ID NO: 7226 - DNA, 20 bp, Artificial Sequence
  sgRNA
gagcgggcaggccttgcgcc

SEQ ID NO: 7227 - DNA, 20 bp, Artificial Sequence
  sgRNA
cgttccctgtagagttctag

SEQ ID NO: 7228 - DNA, 20 bp, Artificial Sequence
  sgRNA
ggaatgcaatgttaattctg

SEQ ID NO: 7229 - DNA, 20 bp, Artificial Sequence
  sgRNA
tctgtgtggctgacgtggca

SEQ ID NO: 7230 - DNA, 20 bp, Artificial Sequence
  sgRNA
cagaacctggattgacgttt

SEQ ID NO: 7231 - DNA, 20 bp, Artificial Sequence
  sgRNA
ccacccgcacttccggacct

SEQ ID NO: 7232 - DNA, 20 bp, Artificial Sequence
  sgRNA
catgtcactcagagagaagc

SEQ ID NO: 7233 - DNA, 20 bp, Artificial Sequence
  sgRNA
tcccggacgcctcccgctaa

SEQ ID NO: 7234 - DNA, 20 bp, Artificial Sequence
  sgRNA
gggcggaaatagcttcgtgc

SEQ ID NO: 7235 - DNA, 20 bp, Artificial Sequence
  sgRNA
tttgtgacaaggtgtggtta

SEQ ID NO: 7236 - DNA, 20 bp, Artificial Sequence
  sgRNA
ccaagtttgtgaagtcatga

SEQ ID NO: 7237 - DNA, 20 bp, Artificial Sequence
  sgRNA
gaggagggaggtggaggagg

SEQ ID NO: 7238 - DNA, 20 bp, Artificial Sequence
  sgRNA
ctgctgctgcgaaagagagc

SEQ ID NO: 7239 - DNA, 20 bp, Artificial Sequence
  sgRNA
tagggagagacacccgccaa

SEQ ID NO: 7240 - DNA, 20 bp, Artificial Sequence
  sgRNA
tgaccagggtgattcagttt

SEQ ID NO: 7241 - DNA, 20 bp, Artificial Sequence
  sgRNA
gtgactctggagtactgtat

SEQ ID NO: 7242 - DNA, 20 bp, Artificial Sequence
  sgRNA
tcacctgctgtcctctgcga

SEQ ID NO: 7243 - DNA, 20 bp, Artificial Sequence
  sgRNA
gggaacagttagacatgaaa

SEQ ID NO: 7244 - DNA, 20 bp, Artificial Sequence
  sgRNA
ggcggaggaagaaaggtggc

SEQ ID NO: 7245 - DNA, 20 bp, Artificial Sequence
  sgRNA
gccaattgtagttaggctaa

SEQ ID NO: 7246 - DNA, 20 bp, Artificial Sequence
  sgRNA
ccgcggcgcgctgaggacgg

SEQ ID NO: 7247 - DNA, 20 bp, Artificial Sequence
  sgRNA
aagtgcagtccgggtgcttg

SEQ ID NO: 7248 - DNA, 20 bp, Artificial Sequence
  sgRNA
gcgcggccgcttcttgagcc

SEQ ID NO: 7249 - DNA, 20 bp, Artificial Sequence
  sgRNA
tgcgttggtttggcgggttg

SEQ ID NO: 7250 - DNA, 20 bp, Artificial Sequence
  sgRNA
cactatgtcagaaacaagga

SEQ ID NO: 7251 - DNA, 20 bp, Artificial Sequence
  sgRNA
aacacacgagagtggagaga

SEQ ID NO: 7252 - DNA, 20 bp, Artificial Sequence
  sgRNA
aatcagtcatctaaacttct

SEQ ID NO: 7253 - DNA, 20 bp, Artificial Sequence
  sgRNA
gaacttcctcctcagccgag

SEQ ID NO: 7254 - DNA, 20 bp, Artificial Sequence
  sgRNA
cttggctgcagttgtgcggc

SEQ ID NO: 7255 - DNA, 20 bp, Artificial Sequence
  sgRNA
tagtctagttaatctacgcc

SEQ ID NO: 7256 - DNA, 20 bp, Artificial Sequence
  sgRNA
ccgctctgctgtgcgattta

SEQ ID NO: 7257 - DNA, 20 bp, Artificial Sequence
  sgRNA
gacagtagctgcgtaggaga

SEQ ID NO: 7258 - DNA, 20 bp, Artificial Sequence
  sgRNA
ggagactcgcagcctgggag

SEQ ID NO: 7259 - DNA, 20 bp, Artificial Sequence
  sgRNA
gaaaggctggaaaggtgtgg

SEQ ID NO: 7260 - DNA, 20 bp, Artificial Sequence
  sgRNA
caacttacatttgcagccgg

SEQ ID NO: 7261 - DNA, 20 bp, Artificial Sequence
  sgRNA
gacgcggttgctaaggaagt

SEQ ID NO: 7262 - DNA, 20 bp, Artificial Sequence
  sgRNA
gaactgagtgcgccagagag

SEQ ID NO: 7263 - DNA, 20 bp, Artificial Sequence
  sgRNA
tctgggtaacctcacgtgac

SEQ ID NO: 7264 - DNA, 20 bp, Artificial Sequence
  sgRNA
gtgacagcgcggagcgggag

SEQ ID NO: 7265 - DNA, 20 bp, Artificial Sequence
  sgRNA
aaagaaaggttccagtagag

SEQ ID NO: 7266 - DNA, 20 bp, Artificial Sequence
  sgRNA
tacataactgagattaagtg

SEQ ID NO: 7267 - DNA, 20 bp, Artificial Sequence
  sgRNA
gggcttcagagtccaccttg

SEQ ID NO: 7268 - DNA, 20 bp, Artificial Sequence
  sgRNA
ctttgaccgcctcaccagtc

SEQ ID NO: 7269 - DNA, 20 bp, Artificial Sequence
  sgRNA
gggcttgatcagccacactg

SEQ ID NO: 7270 - DNA, 20 bp, Artificial Sequence
  sgRNA
cacactcctcggaggaggga

SEQ ID NO: 7271 - DNA, 20 bp, Artificial Sequence
  sgRNA
cgcgcggagcccgcgtggag

SEQ ID NO: 7272 - DNA, 20 bp, Artificial Sequence
  sgRNA
ttctactcaccatctaatcc

SEQ ID NO: 7273 - DNA, 20 bp, Artificial Sequence
  sgRNA
ggagtctgccagcgatctct

SEQ ID NO: 7274 - DNA, 20 bp, Artificial Sequence
  sgRNA
ctgcgcagccgagaggcggg

SEQ ID NO: 7275 - DNA, 20 bp, Artificial Sequence
  sgRNA
cgcccgcggattgcgagcag

SEQ ID NO: 7276 - DNA, 20 bp, Artificial Sequence
  sgRNA
tgggcagaacgagacactta

SEQ ID NO: 7277 - DNA, 20 bp, Artificial Sequence
  sgRNA
ttgaaatattctgtagggtt

SEQ ID NO: 7278 - DNA, 20 bp, Artificial Sequence
  sgRNA
cctgagcaccagggtagggt

SEQ ID NO: 7279 - DNA, 20 bp, Artificial Sequence
  sgRNA
aaacatttgcagtggcatgt

SEQ ID NO: 7280 - DNA, 20 bp, Artificial Sequence
  sgRNA
catctactctctgggtgcac

SEQ ID NO: 7281 - DNA, 20 bp, Artificial Sequence
  sgRNA
caactaatattggttccttt

SEQ ID NO: 7282 - DNA, 20 bp, Artificial Sequence
  sgRNA
cgcaagcattgtgagaaccg

SEQ ID NO: 7283 - DNA, 20 bp, Artificial Sequence
  sgRNA
ttcaccttgccactgggtct

SEQ ID NO: 7284 - DNA, 20 bp, Artificial Sequence
  sgRNA
acagggcgagggagcgaccc

SEQ ID NO: 7285 - DNA, 20 bp, Artificial Sequence
  sgRNA
agaggacattgtgccttagg

SEQ ID NO: 7286 - DNA, 20 bp, Artificial Sequence
  sgRNA
cagaactctaagcttcccat

SEQ ID NO: 7287 - DNA, 20 bp, Artificial Sequence
  sgRNA
ggcggcccgctctcaggtca

SEQ ID NO: 7288 - DNA, 20 bp, Artificial Sequence
  sgRNA
cttagactaagcctttccgg

SEQ ID NO: 7289 - DNA, 20 bp, Artificial Sequence
  sgRNA
cagtgctgacgcagtccagc

SEQ ID NO: 7290 - DNA, 20 bp, Artificial Sequence
  sgRNA
agaatgagatgtcaattcag

SEQ ID NO: 7291 - DNA, 20 bp, Artificial Sequence
  sgRNA
cgagtctagttctattaagt

SEQ ID NO: 7292 - DNA, 20 bp, Artificial Sequence
  sgRNA
ctgcgctagatccagcgccc

SEQ ID NO: 7293 - DNA, 20 bp, Artificial Sequence
  sgRNA
gctacaatgttgagcccttt

SEQ ID NO: 7294 - DNA, 20 bp, Artificial Sequence
  sgRNA
ctttaatcttgtcgtcgcac

SEQ ID NO: 7295 - DNA, 20 bp, Artificial Sequence
  sgRNA
cacatccaatcgatgagtgc

SEQ ID NO: 7296 - DNA, 20 bp, Artificial Sequence
  sgRNA
atatagtaacctttgactgt

SEQ ID NO: 7297 - DNA, 20 bp, Artificial Sequence
  sgRNA
agagggagaagctcgtcacc

SEQ ID NO: 7298 - DNA, 20 bp, Artificial Sequence
  sgRNA
cgaggacagtccactagagg

SEQ ID NO: 7299 - DNA, 20 bp, Artificial Sequence
  sgRNA
ggaccaccacttagttatga

SEQ ID NO: 7300 - DNA, 20 bp, Artificial Sequence
  sgRNA
aagaggtgtgtcagcaaccc

SEQ ID NO: 7301 - DNA, 20 bp, Artificial Sequence
  sgRNA
tgcccagatcggcagagtag

SEQ ID NO: 7302 - DNA, 20 bp, Artificial Sequence
  sgRNA
cccttgtggtgagatcacag

SEQ ID NO: 7303 - DNA, 20 bp, Artificial Sequence
  sgRNA
cttggcgattggacgagagt

SEQ ID NO: 7304 - DNA, 20 bp, Artificial Sequence
  sgRNA
gaggaggagccacagggaag

SEQ ID NO: 7305 - DNA, 20 bp, Artificial Sequence
  sgRNA
gtcagttggatcagggtgga

SEQ ID NO: 7306 - DNA, 20 bp, Artificial Sequence
  sgRNA
gctgcgtgcgcacgtcatca

SEQ ID NO: 7307 - DNA, 20 bp, Artificial Sequence
  sgRNA
agttgtgagtcagtggagta

SEQ ID NO: 7308 - DNA, 20 bp, Artificial Sequence
  sgRNA
gctgggctatgacggcagag

SEQ ID NO: 7309 - DNA, 20 bp, Artificial Sequence
  sgRNA
cgacagcgatctgacagcga

SEQ ID NO: 7310 - DNA, 20 bp, Artificial Sequence
  sgRNA
cagggcgaagtccacgtcgc

SEQ ID NO: 7311 - DNA, 20 bp, Artificial Sequence
  sgRNA
catggactacattcagcctt

SEQ ID NO: 7312 - DNA, 20 bp, Artificial Sequence
  sgRNA
acacgcctacttctcccaca

SEQ ID NO: 7313 - DNA, 20 bp, Artificial Sequence
  sgRNA
tttggattaacaagtagatg

SEQ ID NO: 7314 - DNA, 20 bp, Artificial Sequence
  sgRNA
cgcattaaagagacaagcta

SEQ ID NO: 7315 - DNA, 20 bp, Artificial Sequence
  sgRNA
ccgcctgcgtggcagtgcct

SEQ ID NO: 7316 - DNA, 20 bp, Artificial Sequence
  sgRNA
tacacgactgggtgcagccg

SEQ ID NO: 7317 - DNA, 20 bp, Artificial Sequence
  sgRNA
gcgtgtgcgagatgaggtgt

SEQ ID NO: 7318 - DNA, 20 bp, Artificial Sequence
  sgRNA
tgcccaatgggtgtgcggtg

SEQ ID NO: 7319 - DNA, 20 bp, Artificial Sequence
  sgRNA
ggtcagctgcctagagcgat

SEQ ID NO: 7320 - DNA, 20 bp, Artificial Sequence
  sgRNA
cgaggtccgagtttgccttc

SEQ ID NO: 7321 - DNA, 20 bp, Artificial Sequence
  sgRNA
ttgcctagagttgctaagtt

SEQ ID NO: 7322 - DNA, 20 bp, Artificial Sequence
  sgRNA
cgctctttgaaagaggctag

SEQ ID NO: 7323 - DNA, 20 bp, Artificial Sequence
  sgRNA
gggccggaagagccacgcca

SEQ ID NO: 7324 - DNA, 20 bp, Artificial Sequence
  sgRNA
tctccctgagtcctaacgtg

SEQ ID NO: 7325 - DNA, 20 bp, Artificial Sequence
  sgRNA
tgcgccgagtaggaagtgac

SEQ ID NO: 7326 - DNA, 20 bp, Artificial Sequence
  sgRNA
gtcgcgagggaacggctgcc

SEQ ID NO: 7327 - DNA, 20 bp, Artificial Sequence
  sgRNA
gccgatatgcaggcggcgcg

SEQ ID NO: 7328 - DNA, 20 bp, Artificial Sequence
  sgRNA
ggccaatgaagtcagcattc

SEQ ID NO: 7329 - DNA, 20 bp, Artificial Sequence
  sgRNA
tggccgcggcccatgtgacc

SEQ ID NO: 7330 - DNA, 20 bp, Artificial Sequence
  sgRNA
gctgccgtaggtagtgctct

SEQ ID NO: 7331 - DNA, 20 bp, Artificial Sequence
  sgRNA
ggatccgcaggcaagactta

SEQ ID NO: 7332 - DNA, 20 bp, Artificial Sequence
  sgRNA
gaagactggccgtcacggga

SEQ ID NO: 7333 - DNA, 20 bp, Artificial Sequence
  sgRNA
attccagaaatttctaccag

SEQ ID NO: 7334 - DNA, 20 bp, Artificial Sequence
  sgRNA
atgaataatgtgagcgttgg

SEQ ID NO: 7335 - DNA, 20 bp, Artificial Sequence
  sgRNA
agtcaggagtggccaacttg

SEQ ID NO: 7336 - DNA, 20 bp, Artificial Sequence
  sgRNA
aggcggccgacctgtggact

SEQ ID NO: 7337 - DNA, 20 bp, Artificial Sequence
  sgRNA
ggagcgcagccctggtcacg

SEQ ID NO: 7338 - DNA, 20 bp, Artificial Sequence
  sgRNA
gggtttctgacagtcgcaga

SEQ ID NO: 7339 - DNA, 20 bp, Artificial Sequence
  sgRNA
gaagtcaggtgtacagtgcc

SEQ ID NO: 7340 - DNA, 20 bp, Artificial Sequence
  sgRNA
cccagcaaagaagagcatgc

SEQ ID NO: 7341 - DNA, 20 bp, Artificial Sequence
  sgRNA
cccttgatgggacccttgaa

SEQ ID NO: 7342 - DNA, 20 bp, Artificial Sequence
  sgRNA
tctctgggttagagtggtgc

SEQ ID NO: 7343 - DNA, 20 bp, Artificial Sequence
  sgRNA
ggacattgccttcccttccc

SEQ ID NO: 7344 - DNA, 20 bp, Artificial Sequence
  sgRNA
tccgctgggtccaggagcag

SEQ ID NO: 7345 - DNA, 20 bp, Artificial Sequence
  sgRNA
gtgtcatctcctaaccaccc

SEQ ID NO: 7346 - DNA, 20 bp, Artificial Sequence
  sgRNA
gcacacctccttgcgccgcg

SEQ ID NO: 7347 - DNA, 20 bp, Artificial Sequence
  sgRNA
cagcgcctctgtgtgagctc

SEQ ID NO: 7348 - DNA, 20 bp, Artificial Sequence
  sgRNA
agtcccgggcaggactgcat

SEQ ID NO: 7349 - DNA, 20 bp, Artificial Sequence
  sgRNA
ggcagcggccgcgtccacgt

SEQ ID NO: 7350 - DNA, 20 bp, Artificial Sequence
  sgRNA
ctaccagcccgcctactggg

SEQ ID NO: 7351 - DNA, 20 bp, Artificial Sequence
  sgRNA
gagaccggagggaaacgaac

SEQ ID NO: 7352 - DNA, 20 bp, Artificial Sequence
  sgRNA
acgaaactcctgacagttat

SEQ ID NO: 7353 - DNA, 20 bp, Artificial Sequence
  sgRNA
ttcagatgaagcaaattctg

SEQ ID NO: 7354 - DNA, 20 bp, Artificial Sequence
  sgRNA
gtggctaatgggtgtggcag

SEQ ID NO: 7355 - DNA, 20 bp, Artificial Sequence
  sgRNA
agtcagagaattgtatatcc

SEQ ID NO: 7356 - DNA, 20 bp, Artificial Sequence
  sgRNA
tgttctagagtgtaggcctg

SEQ ID NO: 7357 - DNA, 20 bp, Artificial Sequence
  sgRNA
gtccatttccctcccttcaa

SEQ ID NO: 7358 - DNA, 20 bp, Artificial Sequence
  sgRNA
tatgcctcccgtctgtacta

SEQ ID NO: 7359 - DNA, 20 bp, Artificial Sequence
  sgRNA
cgaggttctgtccgcttgtc

SEQ ID NO: 7360 - DNA, 20 bp, Artificial Sequence
  sgRNA
tctcgccatgtctctcctct

SEQ ID NO: 7361 - DNA, 20 bp, Artificial Sequence
  sgRNA
actcccagagagctcccttc

SEQ ID NO: 7362 - DNA, 20 bp, Artificial Sequence
  sgRNA
ctgtgactcactcagctttg

SEQ ID NO: 7363 - DNA, 20 bp, Artificial Sequence
  sgRNA
ctcctggctgacttcacatg

SEQ ID NO: 7364 - DNA, 20 bp, Artificial Sequence
  sgRNA
acaaagactggtctgtagcc

SEQ ID NO: 7365 - DNA, 20 bp, Artificial Sequence
  sgRNA
gtaaggttattaaatggctt

SEQ ID NO: 7366 - DNA, 20 bp, Artificial Sequence
  sgRNA
tccgatttaaacgtgatagt

SEQ ID NO: 7367 - DNA, 20 bp, Artificial Sequence
  sgRNA
gcgggacatcctgaaataat

SEQ ID NO: 7368 - DNA, 20 bp, Artificial Sequence
  sgRNA
ccggacagaggtagatgaac

SEQ ID NO: 7369 - DNA, 20 bp, Artificial Sequence
  sgRNA
cgtcgcggtgtaagcttgtc

SEQ ID NO: 7370 - DNA, 20 bp, Artificial Sequence
  sgRNA
agactgcgggtcctgccctt

SEQ ID NO: 7371 - DNA, 20 bp, Artificial Sequence
  sgRNA
aatcatggagtgggcatgat

SEQ ID NO: 7372 - DNA, 20 bp, Artificial Sequence
  sgRNA
cgaggcaatgggcacccgtc

SEQ ID NO: 7373 - DNA, 20 bp, Artificial Sequence
  sgRNA
gcacccactggacttctgtg

SEQ ID NO: 7374 - DNA, 20 bp, Artificial Sequence
  sgRNA
cgtggtgtgtgtgggtcttc

SEQ ID NO: 7375 - DNA, 20 bp, Artificial Sequence
  sgRNA
actctgtccgcccaggatcg

SEQ ID NO: 7376 - DNA, 20 bp, Artificial Sequence
  sgRNA
ggcttctgctccaaatagtg

SEQ ID NO: 7377 - DNA, 20 bp, Artificial Sequence
  sgRNA
aggacttctgggttggaccg

SEQ ID NO: 7378 - DNA, 20 bp, Artificial Sequence
  sgRNA
aaagcctctcacaggagttt

SEQ ID NO: 7379 - DNA, 20 bp, Artificial Sequence
  sgRNA
gaactgttgctgaagcggaa

SEQ ID NO: 7380 - DNA, 20 bp, Artificial Sequence
  sgRNA
gccaggactccacatcacaa

SEQ ID NO: 7381 - DNA, 20 bp, Artificial Sequence
  sgRNA
gctgatatggaagatgatta

SEQ ID NO: 7382 - DNA, 20 bp, Artificial Sequence
  sgRNA
tggcagtgctttgaaccaat

SEQ ID NO: 7383 - DNA, 20 bp, Artificial Sequence
  sgRNA
tgccagcgcattcgctcctc

SEQ ID NO: 7384 - DNA, 20 bp, Artificial Sequence
  sgRNA
gtgctggttcttggtcccgt

SEQ ID NO: 7385 - DNA, 20 bp, Artificial Sequence
  sgRNA
gttgttcgtttgaacctcgg

SEQ ID NO: 7386 - DNA, 20 bp, Artificial Sequence
  sgRNA
cgcatgccggcacgtggtgc

SEQ ID NO: 7387 - DNA, 20 bp, Artificial Sequence
  sgRNA
ctgggtgggcccttagagga

SEQ ID NO: 7388 - DNA, 20 bp, Artificial Sequence
  sgRNA
gtctccaacatttcctcctg

SEQ ID NO: 7389 - DNA, 20 bp, Artificial Sequence
  sgRNA
aaacttggaccgcgctttag

SEQ ID NO: 7390 - DNA, 20 bp, Artificial Sequence
  sgRNA
agcctgagagcttaggcctt

SEQ ID NO: 7391 - DNA, 20 bp, Artificial Sequence
  sgRNA
acgggcgggaccggccggag

SEQ ID NO: 7392 - DNA, 20 bp, Artificial Sequence
  sgRNA
ggacgattacccgcgggagg

SEQ ID NO: 7393 - DNA, 20 bp, Artificial Sequence
  sgRNA
tctgccttcctggccataaa

SEQ ID NO: 7394 - DNA, 20 bp, Artificial Sequence
  sgRNA
gaagacagagcgcactaagc

SEQ ID NO: 7395 - DNA, 20 bp, Artificial Sequence
  sgRNA
tgatactgtcagctagtcct

SEQ ID NO: 7396 - DNA, 20 bp, Artificial Sequence
  sgRNA
gacaaagtttcaggagactt

SEQ ID NO: 7397 - DNA, 20 bp, Artificial Sequence
  sgRNA
atctctgcttgacaagatca

SEQ ID NO: 7398 - DNA, 20 bp, Artificial Sequence
  sgRNA
ttcccaataagaacgaacaa

SEQ ID NO: 7399 - DNA, 20 bp, Artificial Sequence
  sgRNA
cccagatttaacttgcctgc

SEQ ID NO: 7400 - DNA, 20 bp, Artificial Sequence
  sgRNA
ggtcacaggccacgggtccc

SEQ ID NO: 7401 - DNA, 20 bp, Artificial Sequence
  sgRNA
catgcgcaggcgcagtcttt

SEQ ID NO: 7402 - DNA, 20 bp, Artificial Sequence
  sgRNA
gctggatccataagggagtc

SEQ ID NO: 7403 - DNA, 20 bp, Artificial Sequence
  sgRNA
gttagagactccctctgccc

SEQ ID NO: 7404 - DNA, 20 bp, Artificial Sequence
  sgRNA
attaggttaatatgttcagc

SEQ ID NO: 7405 - DNA, 20 bp, Artificial Sequence
  sgRNA
aattggacttcagtgtttcg

SEQ ID NO: 7406 - DNA, 20 bp, Artificial Sequence
  sgRNA
ttctgccacgcaacctagtt

SEQ ID NO: 7407 - DNA, 20 bp, Artificial Sequence
  sgRNA
gaaggagcgcgcgaaagggt

SEQ ID NO: 7408 - DNA, 20 bp, Artificial Sequence
  sgRNA
ttggctgtgcatcttcaaac

SEQ ID NO: 7409 - DNA, 20 bp, Artificial Sequence
  sgRNA
agacttgtcctgaatgtggg

SEQ ID NO: 7410 - DNA, 20 bp, Artificial Sequence
  sgRNA
ccagggctgacgcgcctctc

SEQ ID NO: 7411 - DNA, 20 bp, Artificial Sequence
  sgRNA
gtaatgagaagtgacgggct

SEQ ID NO: 7412 - DNA, 20 bp, Artificial Sequence
  sgRNA
ggtagcaacgtcggacaccc

SEQ ID NO: 7413 - DNA, 20 bp, Artificial Sequence
  sgRNA
ttcagcgtcggaaaccatcg

SEQ ID NO: 7414 - DNA, 20 bp, Artificial Sequence
  sgRNA
cactgatctcactgttgcta

SEQ ID NO: 7415 - DNA, 20 bp, Artificial Sequence
  sgRNA
agtaagccagctcgacccgc

SEQ ID NO: 7416 - DNA, 20 bp, Artificial Sequence
  sgRNA
gcgccgtcggcgtagagcgc

SEQ ID NO: 7417 - DNA, 20 bp, Artificial Sequence
  sgRNA
aggcgggcccttcagccagc

SEQ ID NO: 7418 - DNA, 20 bp, Artificial Sequence
  sgRNA
ggacgtcctccttactccgc

SEQ ID NO: 7419 - DNA, 20 bp, Artificial Sequence
  sgRNA
aactaagggctagatctgca

SEQ ID NO: 7420 - DNA, 20 bp, Artificial Sequence
  sgRNA
ttcgctgcctagccgcacgg

SEQ ID NO: 7421 - DNA, 20 bp, Artificial Sequence
  sgRNA
cactgggtcaaggatgtgcc

SEQ ID NO: 7422 - DNA, 20 bp, Artificial Sequence
  sgRNA
ggtggtgcaacttccgtccc

SEQ ID NO: 7423 - DNA, 20 bp, Artificial Sequence
  sgRNA
gtgctaggcaagccagcgtg

SEQ ID NO: 7424 - DNA, 20 bp, Artificial Sequence
  sgRNA
atcagtttcatgttgaaagt

SEQ ID NO: 7425 - DNA, 20 bp, Artificial Sequence
  sgRNA
ttcgggagtagtgttgacag

SEQ ID NO: 7426 - DNA, 20 bp, Artificial Sequence
  sgRNA
cttgggtctccagccacgtt

SEQ ID NO: 7427 - DNA, 20 bp, Artificial Sequence
  sgRNA
ctcagaggcagaatctgctg

SEQ ID NO: 7428 - DNA, 20 bp, Artificial Sequence
  sgRNA
ggagcgcagcgcgtgctgcg

SEQ ID NO: 7429 - DNA, 20 bp, Artificial Sequence
  sgRNA
cttatttgacgctgcccact

SEQ ID NO: 7430 - DNA, 20 bp, Artificial Sequence
  sgRNA
tcaagtcctttcatgcgcgc

SEQ ID NO: 7431 - DNA, 20 bp, Artificial Sequence
  sgRNA
gggtattgattacatcctgg

SEQ ID NO: 7432 - DNA, 20 bp, Artificial Sequence
  sgRNA
gatcacgtgacggagctctc

SEQ ID NO: 7433 - DNA, 20 bp, Artificial Sequence
  sgRNA
gttcagcacgttactgtgat

SEQ ID NO: 7434 - DNA, 20 bp, Artificial Sequence
  sgRNA
ctcctgtatcaggagagcaa

SEQ ID NO: 7435 - DNA, 20 bp, Artificial Sequence
  sgRNA
ggcggtggctggcgtctcat

SEQ ID NO: 7436 - DNA, 20 bp, Artificial Sequence
  sgRNA
aatggaacaccttcctaaca

SEQ ID NO: 7437 - DNA, 20 bp, Artificial Sequence
  sgRNA
gggagacagggaagggattc

SEQ ID NO: 7438 - DNA, 20 bp, Artificial Sequence
  sgRNA
acgcgcccgccttctggcac

SEQ ID NO: 7439 - DNA, 20 bp, Artificial Sequence
  sgRNA
gcagacgcccgcgcgtcctc

SEQ ID NO: 7440 - DNA, 20 bp, Artificial Sequence
  sgRNA
tgaggagccaatggagcagc

SEQ ID NO: 7441 - DNA, 20 bp, Artificial Sequence
  sgRNA
aagactggcggagataatct

SEQ ID NO: 7442 - DNA, 20 bp, Artificial Sequence
  sgRNA
aagaagctccttgcggtttg

SEQ ID NO: 7443 - DNA, 20 bp, Artificial Sequence
  sgRNA
tgtagcagccaatcgaggcg

SEQ ID NO: 7444 - DNA, 20 bp, Artificial Sequence
  sgRNA
cccagaagccagggcgaacc

SEQ ID NO: 7445 - DNA, 20 bp, Artificial Sequence
  sgRNA
cccgaaagtgctaccaagtt

SEQ ID NO: 7446 - DNA, 20 bp, Artificial Sequence
  sgRNA
gatggcgcagcaccaactga

SEQ ID NO: 7447 - DNA, 20 bp, Artificial Sequence
  sgRNA
cgcctaagacacccattccc

SEQ ID NO: 7448 - DNA, 20 bp, Artificial Sequence
  sgRNA
gggcgacgccctgggacgct

SEQ ID NO: 7449 - DNA, 20 bp, Artificial Sequence
  sgRNA
gggcggcccgagctcaacgg

SEQ ID NO: 7450 - DNA, 20 bp, Artificial Sequence
  sgRNA
gacagacacgtcccatagtg

SEQ ID NO: 7451 - DNA, 20 bp, Artificial Sequence
  sgRNA
catagagtctggcctaggtt

SEQ ID NO: 7452 - DNA, 20 bp, Artificial Sequence
  sgRNA
gacgcggaagaagagacctg

SEQ ID NO: 7453 - DNA, 20 bp, Artificial Sequence
  sgRNA
agagagctcccgtgtgcgct

SEQ ID NO: 7454 - DNA, 20 bp, Artificial Sequence
  sgRNA
cgtgaccacagcctatgccg

SEQ ID NO: 7455 - DNA, 20 bp, Artificial Sequence
  sgRNA
cgcacgcccagagatctcgc

SEQ ID NO: 7456 - DNA, 20 bp, Artificial Sequence
  sgRNA
tgtgtgctccaacagtgagt

SEQ ID NO: 7457 - DNA, 20 bp, Artificial Sequence
  sgRNA
atgtcataggacagacacta

SEQ ID NO: 7458 - DNA, 20 bp, Artificial Sequence
  sgRNA
tctattcccgatatgcactc

SEQ ID NO: 7459 - DNA, 20 bp, Artificial Sequence
  sgRNA
ggttgggcgggctcatcggc

SEQ ID NO: 7460 - DNA, 20 bp, Artificial Sequence
  sgRNA
aggtgtgcggcttctaggaa

SEQ ID NO: 7461 - DNA, 20 bp, Artificial Sequence
  sgRNA
aacaaactagataccggaac

SEQ ID NO: 7462 - DNA, 20 bp, Artificial Sequence
  sgRNA
ggctactcctttgagaccct

SEQ ID NO: 7463 - DNA, 20 bp, Artificial Sequence
  sgRNA
tctaatcatagtgagcatgc

SEQ ID NO: 7464 - DNA, 20 bp, Artificial Sequence
  sgRNA
tggtcttaataggtgtgggc

SEQ ID NO: 7465 - DNA, 20 bp, Artificial Sequence
  sgRNA
agggcagttgtctcttcaaa

SEQ ID NO: 7466 - DNA, 20 bp, Artificial Sequence
  sgRNA
gaccatcctataaggaagca

SEQ ID NO: 7467 - DNA, 20 bp, Artificial Sequence
  sgRNA
tcaccagccgggtcggtccg

SEQ ID NO: 7468 - DNA, 20 bp, Artificial Sequence
  sgRNA
cggtgcccgctgaggcaaca

SEQ ID NO: 7469 - DNA, 20 bp, Artificial Sequence
  sgRNA
cccggagtcagctccagggc

SEQ ID NO: 7470 - DNA, 20 bp, Artificial Sequence
  sgRNA
gttgaatcccatgccagttc

SEQ ID NO: 7471 - DNA, 20 bp, Artificial Sequence
  sgRNA
tccgcgctgagattgcggag

SEQ ID NO: 7472 - DNA, 20 bp, Artificial Sequence
  sgRNA
gtggagcaagaacgaaaggc

SEQ ID NO: 7473 - DNA, 20 bp, Artificial Sequence
  sgRNA
cgatggcggcgacggtttct

SEQ ID NO: 7474 - DNA, 20 bp, Artificial Sequence
  sgRNA
gctgtgagctgcagatggta

SEQ ID NO: 7475 - DNA, 20 bp, Artificial Sequence
  sgRNA
gcgcggcgtcaagtgcagct

SEQ ID NO: 7476 - DNA, 20 bp, Artificial Sequence
  sgRNA
ggatagtctgattgtataaa

SEQ ID NO: 7477 - DNA, 20 bp, Artificial Sequence
  sgRNA
aacgggaagtgtgcgctgat

SEQ ID NO: 7478 - DNA, 20 bp, Artificial Sequence
  sgRNA
tgcaggccggtcaccgagtg

SEQ ID NO: 7479 - DNA, 20 bp, Artificial Sequence
  sgRNA
aaagtgcccgtcaagttcgg

SEQ ID NO: 7480 - DNA, 20 bp, Artificial Sequence
  sgRNA
ggtcatcgctcggctgcctg

SEQ ID NO: 7481 - DNA, 20 bp, Artificial Sequence
  sgRNA
actggtctgggcgctgtccg

SEQ ID NO: 7482 - DNA, 20 bp, Artificial Sequence
  sgRNA
aggtttagatttctttccta

SEQ ID NO: 7483 - DNA, 20 bp, Artificial Sequence
  sgRNA
gtctcagccggcccatgtag

SEQ ID NO: 7484 - DNA, 20 bp, Artificial Sequence
  sgRNA
ccgacgcaaccaatcatcgc

SEQ ID NO: 7485 - DNA, 20 bp, Artificial Sequence
  sgRNA
tagggttgcggactccgccc

SEQ ID NO: 7486 - DNA, 20 bp, Artificial Sequence
  sgRNA
ggcacgtgactagcccacgc

SEQ ID NO: 7487 - DNA, 20 bp, Artificial Sequence
  sgRNA
ctgctgacgcgtcgctgctt

SEQ ID NO: 7488 - DNA, 20 bp, Artificial Sequence
  sgRNA
aatcaggctcctgaatataa

SEQ ID NO: 7489 - DNA, 20 bp, Artificial Sequence
  sgRNA
actctagggcatcccagtcc

SEQ ID NO: 7490 - DNA, 20 bp, Artificial Sequence
  sgRNA
cgtagggctgctcccacggg

SEQ ID NO: 7491 - DNA, 20 bp, Artificial Sequence
  sgRNA
ctaggcgtcccagagcacta

SEQ ID NO: 7492 - DNA, 20 bp, Artificial Sequence
  sgRNA
cctttcacggttcctgtgcc

SEQ ID NO: 7493 - DNA, 20 bp, Artificial Sequence
  sgRNA
cacatcgctcttgcacacac

SEQ ID NO: 7494 - DNA, 20 bp, Artificial Sequence
  sgRNA
gattgagtgaggagtcgagg

SEQ ID NO: 7495 - DNA, 20 bp, Artificial Sequence
  sgRNA
ttggattcttcggagaatcc

SEQ ID NO: 7496 - DNA, 20 bp, Artificial Sequence
  sgRNA
cttctgctaatacagaacag

SEQ ID NO: 7497 - DNA, 20 bp, Artificial Sequence
  sgRNA
gcacacgtgcagagaacata

SEQ ID NO: 7498 - DNA, 20 bp, Artificial Sequence
  sgRNA
gcgcgctctgaaatcaaact

SEQ ID NO: 7499 - DNA, 20 bp, Artificial Sequence
  sgRNA
aagccacctcataaagactg

SEQ ID NO: 7500 - DNA, 20 bp, Artificial Sequence
  sgRNA
ctgcaccatacagggtgggt

SEQ ID NO: 7501 - DNA, 20 bp, Artificial Sequence
  sgRNA
ccggattgtgacgtccagtc

SEQ ID NO: 7502 - DNA, 20 bp, Artificial Sequence
  sgRNA
agtgcagtaagcgtccttgg

SEQ ID NO: 7503 - DNA, 20 bp, Artificial Sequence
  sgRNA
ggaggacccaagctattgtg

SEQ ID NO: 7504 - DNA, 20 bp, Artificial Sequence
  sgRNA
tgtcagtagtaacctccaag

SEQ ID NO: 7505 - DNA, 20 bp, Artificial Sequence
  sgRNA
taagttagaagtggtctgtt

SEQ ID NO: 7506 - DNA, 20 bp, Artificial Sequence
  sgRNA
gtcgcgcgctacaaattcat

SEQ ID NO: 7507 - DNA, 20 bp, Artificial Sequence
  sgRNA
taaagcatttcgcggagtgc

SEQ ID NO: 7508 - DNA, 20 bp, Artificial Sequence
  sgRNA
tatttgtctccgatgggcca

SEQ ID NO: 7509 - DNA, 20 bp, Artificial Sequence
  sgRNA
accagctgtccagcgcaccg

SEQ ID NO: 7510 - DNA, 20 bp, Artificial Sequence
  sgRNA
cccgagtttaggaagaggag

SEQ ID NO: 7511 - DNA, 20 bp, Artificial Sequence
  sgRNA
ccgcctctcagagtaacgat

SEQ ID NO: 7512 - DNA, 20 bp, Artificial Sequence
  sgRNA
gcccaggccctttgtctgcc

SEQ ID NO: 7513 - DNA, 20 bp, Artificial Sequence
  sgRNA
aacagacttctctcctaaca

SEQ ID NO: 7514 - DNA, 20 bp, Artificial Sequence
  sgRNA
ccagggctgatctagtttga

SEQ ID NO: 7515 - DNA, 20 bp, Artificial Sequence
  sgRNA
cattgacagctttagtcatg

SEQ ID NO: 7516 - DNA, 20 bp, Artificial Sequence
  sgRNA
cccaccctagcctcggcggg

SEQ ID NO: 7517 - DNA, 20 bp, Artificial Sequence
  sgRNA
aatgtagttgcttaggacag

SEQ ID NO: 7518 - DNA, 20 bp, Artificial Sequence
  sgRNA
aaagacagggcagagctcat

SEQ ID NO: 7519 - DNA, 20 bp, Artificial Sequence
  sgRNA
cgcggttggctggccgctcg

SEQ ID NO: 7520 - DNA, 20 bp, Artificial Sequence
  sgRNA
ctgcggccctgctgctgctc

SEQ ID NO: 7521 - DNA, 20 bp, Artificial Sequence
  sgRNA
tggcgggcgggagtagacgc

SEQ ID NO: 7522 - DNA, 20 bp, Artificial Sequence
  sgRNA
gccttgcagtccgtgttctc

SEQ ID NO: 7523 - DNA, 20 bp, Artificial Sequence
  sgRNA
tggcattccacccaaacact

SEQ ID NO: 7524 - DNA, 20 bp, Artificial Sequence
  sgRNA
ccacactcccgagcatccaa

SEQ ID NO: 7525 - DNA, 20 bp, Artificial Sequence
  sgRNA
ggcgctgcggagcgagccgg

SEQ ID NO: 7526 - DNA, 20 bp, Artificial Sequence
  sgRNA
gtggatcgggacacctcctt

SEQ ID NO: 7527 - DNA, 20 bp, Artificial Sequence
  sgRNA
caggtgtcaccacgccggga

SEQ ID NO: 7528 - DNA, 20 bp, Artificial Sequence
  sgRNA
cacctgtctcttctctagac

SEQ ID NO: 7529 - DNA, 20 bp, Artificial Sequence
  sgRNA
cgcgtctgcaaccgggtggg

SEQ ID NO: 7530 - DNA, 20 bp, Artificial Sequence
  sgRNA
cggcgttctcgagcctcgcg

SEQ ID NO: 7531 - DNA, 20 bp, Artificial Sequence
  sgRNA
ctcactgatataaacattac

SEQ ID NO: 7532 - DNA, 20 bp, Artificial Sequence
  sgRNA
gttgtgattgatccaggtcc

SEQ ID NO: 7533 - DNA, 20 bp, Artificial Sequence
  sgRNA
cttctcattctgaactgctt

SEQ ID NO: 7534 - DNA, 20 bp, Artificial Sequence
  sgRNA
gggcagctccagctggatgc

SEQ ID NO: 7535 - DNA, 20 bp, Artificial Sequence
  sgRNA
gagcttgcccaaaggcctcc

SEQ ID NO: 7536 - DNA, 20 bp, Artificial Sequence
  sgRNA
gcgcctctcgcgacttgccc

SEQ ID NO: 7537 - DNA, 20 bp, Artificial Sequence
  sgRNA
atcagagggcggcgttcgtc

SEQ ID NO: 7538 - DNA, 20 bp, Artificial Sequence
  sgRNA
ggtcgtgggttgtccgatgc

SEQ ID NO: 7539 - DNA, 20 bp, Artificial Sequence
  sgRNA
cctttgtgcagccggaacta

SEQ ID NO: 7540 - DNA, 20 bp, Artificial Sequence
  sgRNA
tttggaggtgaatttagagc

SEQ ID NO: 7541 - DNA, 20 bp, Artificial Sequence
  sgRNA
tcgccctcctcgacctctcc

SEQ ID NO: 7542 - DNA, 20 bp, Artificial Sequence
  sgRNA
ctagcctgtagcttatgccc

SEQ ID NO: 7543 - DNA, 20 bp, Artificial Sequence
  sgRNA
cggttgagcgcagtctttct

SEQ ID NO: 7544 - DNA, 20 bp, Artificial Sequence
  sgRNA
agggatagataattatctag

SEQ ID NO: 7545 - DNA, 20 bp, Artificial Sequence
  sgRNA
gcaggacggagcaaaggtcc

SEQ ID NO: 7546 - DNA, 20 bp, Artificial Sequence
  sgRNA
ctgaggtccctactctggtg

SEQ ID NO: 7547 - DNA, 20 bp, Artificial Sequence
  sgRNA
gtagtgggcgggcggtctat

SEQ ID NO: 7548 - DNA, 20 bp, Artificial Sequence
  sgRNA
agtgcgcgccagaaagggac

SEQ ID NO: 7549 - DNA, 20 bp, Artificial Sequence
  sgRNA
gcgactgtatttgtctggag

SEQ ID NO: 7550 - DNA, 20 bp, Artificial Sequence
  sgRNA
cgccagagccttcgcgccag

SEQ ID NO: 7551 - DNA, 20 bp, Artificial Sequence
  sgRNA
accaaataagaattcatgag

SEQ ID NO: 7552 - DNA, 20 bp, Artificial Sequence
  sgRNA
gggatagtagtagaggtccc

SEQ ID NO: 7553 - DNA, 20 bp, Artificial Sequence
  sgRNA
acaaagccctgggagggccc

SEQ ID NO: 7554 - DNA, 20 bp, Artificial Sequence
  sgRNA
cggcagcaactaaacttggg

SEQ ID NO: 7555 - DNA, 20 bp, Artificial Sequence
  sgRNA
cttgccctaacattaccaaa

SEQ ID NO: 7556 - DNA, 20 bp, Artificial Sequence
  sgRNA
ccacagccactccagtaatg

SEQ ID NO: 7557 - DNA, 20 bp, Artificial Sequence
  sgRNA
aggatgcaagatataaggct

SEQ ID NO: 7558 - DNA, 20 bp, Artificial Sequence
  sgRNA
agaaggacagattggtggat

SEQ ID NO: 7559 - DNA, 20 bp, Artificial Sequence
  sgRNA
ccctcctttgcagagggcat

SEQ ID NO: 7560 - DNA, 20 bp, Artificial Sequence
  sgRNA
gtgaagtttaccatatttca

SEQ ID NO: 7561 - DNA, 20 bp, Artificial Sequence
  sgRNA
cctgggagggacagactccc

SEQ ID NO: 7562 - DNA, 20 bp, Artificial Sequence
  sgRNA
ttacctccagctagagatgc

SEQ ID NO: 7563 - DNA, 20 bp, Artificial Sequence
  sgRNA
tatgattattgctgctcact

SEQ ID NO: 7564 - DNA, 20 bp, Artificial Sequence
  sgRNA
caatgtttcctggtatggtt

SEQ ID NO: 7565 - DNA, 20 bp, Artificial Sequence
  sgRNA
aacccgttctattccaggac

SEQ ID NO: 7566 - DNA, 20 bp, Artificial Sequence
  sgRNA
ggacattcggcgattcccac

SEQ ID NO: 7567 - DNA, 20 bp, Artificial Sequence
  sgRNA
agtgcaggccgctccaggat

SEQ ID NO: 7568 - DNA, 20 bp, Artificial Sequence
  sgRNA
ccctaagggacccgcccgca

SEQ ID NO: 7569 - DNA, 20 bp, Artificial Sequence
  sgRNA
cgcaccctttacacaaaccg

SEQ ID NO: 7570 - DNA, 20 bp, Artificial Sequence
  sgRNA
catcgggaccatctgcctag

SEQ ID NO: 7571 - DNA, 20 bp, Artificial Sequence
  sgRNA
tgcagcgttctattggtcgg

SEQ ID NO: 7572 - DNA, 20 bp, Artificial Sequence
  sgRNA
gcttctgcttgaatacttct

SEQ ID NO: 7573 - DNA, 20 bp, Artificial Sequence
  sgRNA
gagcacttgcgtggttgccc

SEQ ID NO: 7574 - DNA, 20 bp, Artificial Sequence
  sgRNA
aaggactagtctccaccttt

SEQ ID NO: 7575 - DNA, 20 bp, Artificial Sequence
  sgRNA
gagtgtgaataggatctatg

SEQ ID NO: 7576 - DNA, 20 bp, Artificial Sequence
  sgRNA
aaaggttctgcgaaagaggc

SEQ ID NO: 7577 - DNA, 20 bp, Artificial Sequence
  sgRNA
aaggtaggcttgatgacctg

SEQ ID NO: 7578 - DNA, 20 bp, Artificial Sequence
  sgRNA
tcaatgcccagctcatgaga

SEQ ID NO: 7579 - DNA, 20 bp, Artificial Sequence
  sgRNA
ggtctaggtctgaaagaatg

SEQ ID NO: 7580 - DNA, 20 bp, Artificial Sequence
  sgRNA
tgaggaaacacgttctctat

SEQ ID NO: 7581 - DNA, 20 bp, Artificial Sequence
  sgRNA
acactcctaggcagtgaagt

SEQ ID NO: 7582 - DNA, 20 bp, Artificial Sequence
  sgRNA
gacttgccttggtgtgactc

SEQ ID NO: 7583 - DNA, 20 bp, Artificial Sequence
  sgRNA
gcaagcaagcagtgattggc

SEQ ID NO: 7584 - DNA, 20 bp, Artificial Sequence
  sgRNA
tttgctgtgaggatgtgaac

SEQ ID NO: 7585 - DNA, 20 bp, Artificial Sequence
  sgRNA
gagaccagagagaattagcc

SEQ ID NO: 7586 - DNA, 20 bp, Artificial Sequence
  sgRNA
gtggagccatagaaagaagg

SEQ ID NO: 7587 - DNA, 20 bp, Artificial Sequence
  sgRNA
gatctgctaagctcgcgaca

SEQ ID NO: 7588 - DNA, 20 bp, Artificial Sequence
  sgRNA
cctgagtgctcgagctaagg

SEQ ID NO: 7589 - DNA, 20 bp, Artificial Sequence
  sgRNA
gcgggcacagaggttccgtg

SEQ ID NO: 7590 - DNA, 20 bp, Artificial Sequence
  sgRNA
tgaactcctcttataattct

SEQ ID NO: 7591 - DNA, 20 bp, Artificial Sequence
  sgRNA
ctcacaaactgtaaccctgt

SEQ ID NO: 7592 - DNA, 20 bp, Artificial Sequence
  sgRNA
ggagatgcttccgttctcgc

SEQ ID NO: 7593 - DNA, 20 bp, Artificial Sequence
  sgRNA
taatcagatctttgacgaag

SEQ ID NO: 7594 - DNA, 20 bp, Artificial Sequence
  sgRNA
caatgaagcagagaggtcct

SEQ ID NO: 7595 - DNA, 20 bp, Artificial Sequence
  sgRNA
tgaggtgtggctctaggcct

SEQ ID NO: 7596 - DNA, 20 bp, Artificial Sequence
  sgRNA
ctactgctgttgcgcaaggg

SEQ ID NO: 7597 - DNA, 20 bp, Artificial Sequence
  sgRNA
ctgtagcaagggacacagtg

SEQ ID NO: 7598 - DNA, 20 bp, Artificial Sequence
  sgRNA
cagcgcttcggaaatcctgc

SEQ ID NO: 7599 - DNA, 20 bp, Artificial Sequence
  sgRNA
cacacaagcagggcctctcg

SEQ ID NO: 7600 - DNA, 20 bp, Artificial Sequence
  sgRNA
ccgcggcgctcggacgggcc

SEQ ID NO: 7601 - DNA, 20 bp, Artificial Sequence
  sgRNA
catttcctgaatgggatgag

SEQ ID NO: 7602 - DNA, 20 bp, Artificial Sequence
  sgRNA
ggaccggcacatcgacatcc

SEQ ID NO: 7603 - DNA, 20 bp, Artificial Sequence
  sgRNA
ggccagtccgtctctataaa

SEQ ID NO: 7604 - DNA, 20 bp, Artificial Sequence
  sgRNA
gggtgtctgaccgctctgac

SEQ ID NO: 7605 - DNA, 20 bp, Artificial Sequence
  sgRNA
ggcgcttgacgtggagtcgg

SEQ ID NO: 7606 - DNA, 20 bp, Artificial Sequence
  sgRNA
ggagcccggcacgaccagga

SEQ ID NO: 7607 - DNA, 20 bp, Artificial Sequence
  sgRNA
acgatggcttcatgtttatg

SEQ ID NO: 7608 - DNA, 20 bp, Artificial Sequence
  sgRNA
ccacacgcagggccaaggag

SEQ ID NO: 7609 - DNA, 20 bp, Artificial Sequence
  sgRNA
cgaggctcggccctgccgtc

SEQ ID NO: 7610 - DNA, 20 bp, Artificial Sequence
  sgRNA
ttgggtaaccataaacataa

SEQ ID NO: 7611 - DNA, 20 bp, Artificial Sequence
  sgRNA
tccacctcggtggcgacaac

SEQ ID NO: 7612 - DNA, 20 bp, Artificial Sequence
  sgRNA
gtgacagaaggctagggagc

SEQ ID NO: 7613 - DNA, 20 bp, Artificial Sequence
  sgRNA
ctctgctggcctcctaatcc

SEQ ID NO: 7614 - DNA, 20 bp, Artificial Sequence
  sgRNA
ggagtagccagtgatgtcac

SEQ ID NO: 7615 - DNA, 20 bp, Artificial Sequence
  sgRNA
tcaagtactgtacttgctat

SEQ ID NO: 7616 - DNA, 20 bp, Artificial Sequence
  sgRNA
agctaaccatggaggagact

SEQ ID NO: 7617 - DNA, 20 bp, Artificial Sequence
  sgRNA
catcgggaaggcttgagtct

SEQ ID NO: 7618 - DNA, 20 bp, Artificial Sequence
  sgRNA
ataccacagcaaccttgacg

SEQ ID NO: 7619 - DNA, 20 bp, Artificial Sequence
  sgRNA
ctaggccaccttcagagccc

SEQ ID NO: 7620 - DNA, 20 bp, Artificial Sequence
  sgRNA
cgagcttagcacttgaaggg

SEQ ID NO: 7621 - DNA, 20 bp, Artificial Sequence
  sgRNA
ccaaatcctgctgctgagtc

SEQ ID NO: 7622 - DNA, 20 bp, Artificial Sequence
  sgRNA
gccggaaggcatcaagtcgc

SEQ ID NO: 7623 - DNA, 20 bp, Artificial Sequence
  sgRNA
tgggagggcgggtcaaacct

SEQ ID NO: 7624 - DNA, 20 bp, Artificial Sequence
  sgRNA
gattggaagtttcttccgcc

SEQ ID NO: 7625 - DNA, 20 bp, Artificial Sequence
  sgRNA
gaaaccgggagtagcgtccc

SEQ ID NO: 7626 - DNA, 20 bp, Artificial Sequence
  sgRNA
acagtttcacaacttgtgca

SEQ ID NO: 7627 - DNA, 20 bp, Artificial Sequence
  sgRNA
atgaagacgcccagagagaa

SEQ ID NO: 7628 - DNA, 20 bp, Artificial Sequence
  sgRNA
cacctgaatttctttgggaa

SEQ ID NO: 7629 - DNA, 20 bp, Artificial Sequence
  sgRNA
ttgggcgttgctaggagacg

SEQ ID NO: 7630 - DNA, 20 bp, Artificial Sequence
  sgRNA
ggagtcgccgagtggtgggc

SEQ ID NO: 7631 - DNA, 20 bp, Artificial Sequence
  sgRNA
tttcacgttattccgcccag

SEQ ID NO: 7632 - DNA, 20 bp, Artificial Sequence
  sgRNA
gaggctgggctaggcagcgc

SEQ ID NO: 7633 - DNA, 20 bp, Artificial Sequence
  sgRNA
ggaaacgtgagattagatga

SEQ ID NO: 7634 - DNA, 20 bp, Artificial Sequence
  sgRNA
gtccgtacggcgaagtgatg

SEQ ID NO: 7635 - DNA, 20 bp, Artificial Sequence
  sgRNA
gaggaactacatttcccaga

SEQ ID NO: 7636 - DNA, 20 bp, Artificial Sequence
  sgRNA
cacccggtttccggaccttg

SEQ ID NO: 7637 - DNA, 20 bp, Artificial Sequence
  sgRNA
ctcgtctgcagtccctgacc

SEQ ID NO: 7638 - DNA, 20 bp, Artificial Sequence
  sgRNA
caatagagaaacctccaccg

SEQ ID NO: 7639 - DNA, 20 bp, Artificial Sequence
  sgRNA
caaattcctgcgcctccagg

SEQ ID NO: 7640 - DNA, 20 bp, Artificial Sequence
  sgRNA
ggaagggcagatatatgaac

SEQ ID NO: 7641 - DNA, 20 bp, Artificial Sequence
  sgRNA
ggaaagtacaattatcagac

SEQ ID NO: 7642 - DNA, 20 bp, Artificial Sequence
  sgRNA
ccacagcaggcctgcaagaa

SEQ ID NO: 7643 - DNA, 20 bp, Artificial Sequence
  sgRNA
cgcccaggaccctcaccaaa

SEQ ID NO: 7644 - DNA, 20 bp, Artificial Sequence
  sgRNA
cccaattctgggatgcttga

SEQ ID NO: 7645 - DNA, 20 bp, Artificial Sequence
  sgRNA
acagtagtgtcagatagaag

SEQ ID NO: 7646 - DNA, 20 bp, Artificial Sequence
  sgRNA
gtgacaggagactagccagt

SEQ ID NO: 7647 - DNA, 20 bp, Artificial Sequence
  sgRNA
ggaaacacgagaggaccgcg

SEQ ID NO: 7648 - DNA, 20 bp, Artificial Sequence
  sgRNA
ggaccacgagctgagatggt

SEQ ID NO: 7649 - DNA, 20 bp, Artificial Sequence
  sgRNA
tcacttacctccttctcact

SEQ ID NO: 7650 - DNA, 20 bp, Artificial Sequence
  sgRNA
cttgctcccagcagaactgg

SEQ ID NO: 7651 - DNA, 20 bp, Artificial Sequence
  sgRNA
tcccggccgcttcaaaccgc

SEQ ID NO: 7652 - DNA, 20 bp, Artificial Sequence
  sgRNA
gcttctcagcttgcctcagt

SEQ ID NO: 7653 - DNA, 20 bp, Artificial Sequence
  sgRNA
ccagcctctaggaactagcg

SEQ ID NO: 7654 - DNA, 20 bp, Artificial Sequence
  sgRNA
cttcgagtctgaacccgccc

SEQ ID NO: 7655 - DNA, 20 bp, Artificial Sequence
  sgRNA
gtaaagtaaacacactctgt

SEQ ID NO: 7656 - DNA, 20 bp, Artificial Sequence
  sgRNA
ggctggctgcttagtgacat

SEQ ID NO: 7657 - DNA, 20 bp, Artificial Sequence
  sgRNA
gcatttaataaactgccttt

SEQ ID NO: 7658 - DNA, 20 bp, Artificial Sequence
  sgRNA
ggcaataacagcttcagcag

SEQ ID NO: 7659 - DNA, 20 bp, Artificial Sequence
  sgRNA
tcgcttgcacaggacccttc

SEQ ID NO: 7660 - DNA, 20 bp, Artificial Sequence
  sgRNA
cccgcgtcgcctgccgtggg

SEQ ID NO: 7661 - DNA, 20 bp, Artificial Sequence
  sgRNA
taggctgggcatccttgcag

SEQ ID NO: 7662 - DNA, 20 bp, Artificial Sequence
  sgRNA
ggtaaataactctagttagc

SEQ ID NO: 7663 - DNA, 20 bp, Artificial Sequence
  sgRNA
ttctgagaaggcccgcccta

SEQ ID NO: 7664 - DNA, 20 bp, Artificial Sequence
  sgRNA
tataacgcacaggaaattgc

SEQ ID NO: 7665 - DNA, 20 bp, Artificial Sequence
  sgRNA
aaggacacaagtagcccgag

SEQ ID NO: 7666 - DNA, 20 bp, Artificial Sequence
  sgRNA
ggccctctcagatcacatgc

SEQ ID NO: 7667 - DNA, 20 bp, Artificial Sequence
  sgRNA
tcaggaagagcacgcatgct

SEQ ID NO: 7668 - DNA, 20 bp, Artificial Sequence
  sgRNA
ttccaccggaagtgctccct

SEQ ID NO: 7669 - DNA, 20 bp, Artificial Sequence
  sgRNA
tttagattgacgagcaaatg

SEQ ID NO: 7670 - DNA, 20 bp, Artificial Sequence
  sgRNA
gtcattcagcatgggtttcc

SEQ ID NO: 7671 - DNA, 20 bp, Artificial Sequence
  sgRNA
aaagaagcaccgcccgctac

SEQ ID NO: 7672 - DNA, 20 bp, Artificial Sequence
  sgRNA
gtttagggaactataaagac

SEQ ID NO: 7673 - DNA, 20 bp, Artificial Sequence
  sgRNA
tggttaaagttggcttgcaa

SEQ ID NO: 7674 - DNA, 20 bp, Artificial Sequence
  sgRNA
tccacctgctgttcatcagc

SEQ ID NO: 7675 - DNA, 20 bp, Artificial Sequence
  sgRNA
agtcgccgcggcgccgacga

SEQ ID NO: 7676 - DNA, 20 bp, Artificial Sequence
  sgRNA
tctgaaaggaatcccaagag

SEQ ID NO: 7677 - DNA, 20 bp, Artificial Sequence
  sgRNA
attgtatttgaatcgtgatc

SEQ ID NO: 7678 - DNA, 20 bp, Artificial Sequence
  sgRNA
ctgaggactgcgtggaggag

SEQ ID NO: 7679 - DNA, 20 bp, Artificial Sequence
  sgRNA
tatgtggagatattggttca

SEQ ID NO: 7680 - DNA, 20 bp, Artificial Sequence
  sgRNA
atggtttcatttacatgttg

SEQ ID NO: 7681 - DNA, 20 bp, Artificial Sequence
  sgRNA
tgctaatgcctgccagaggg

SEQ ID NO: 7682 - DNA, 20 bp, Artificial Sequence
  sgRNA
ggctgttctctctcggtcaa

SEQ ID NO: 7683 - DNA, 20 bp, Artificial Sequence
  sgRNA
ctgtaagtcccacagcagat

SEQ ID NO: 7684 - DNA, 20 bp, Artificial Sequence
  sgRNA
gcacttgttggagcagactg

SEQ ID NO: 7685 - DNA, 20 bp, Artificial Sequence
  sgRNA
tggaacaacctgagccagcc

SEQ ID NO: 7686 - DNA, 20 bp, Artificial Sequence
  sgRNA
cagacacccttaacagcaag

SEQ ID NO: 7687 - DNA, 20 bp, Artificial Sequence
  sgRNA
agcggcggcgcgacgccggt

SEQ ID NO: 7688 - DNA, 20 bp, Artificial Sequence
  sgRNA
tttgttcctcacttaccagc

SEQ ID NO: 7689 - DNA, 20 bp, Artificial Sequence
  sgRNA
gcgggactggttcttgaagt

SEQ ID NO: 7690 - DNA, 20 bp, Artificial Sequence
  sgRNA
cctattattctccatctctt

SEQ ID NO: 7691 - DNA, 20 bp, Artificial Sequence
  sgRNA
ggtcgtacacctcggtgccc

SEQ ID NO: 7692 - DNA, 20 bp, Artificial Sequence
  sgRNA
aacatggccgccgaggaggg

SEQ ID NO: 7693 - DNA, 20 bp, Artificial Sequence
  sgRNA
tccttggctgggtccagtga

SEQ ID NO: 7694 - DNA, 20 bp, Artificial Sequence
  sgRNA
actctgggactcgtcccttg

SEQ ID NO: 7695 - DNA, 20 bp, Artificial Sequence
  sgRNA
cccagttatccaaggaaacc

SEQ ID NO: 7696 - DNA, 20 bp, Artificial Sequence
  sgRNA
cagtatatgccagaatacat

SEQ ID NO: 7697 - DNA, 20 bp, Artificial Sequence
  sgRNA
tccgcagactgactcctcac

SEQ ID NO: 7698 - DNA, 20 bp, Artificial Sequence
  sgRNA
cagagacttggaatcttact

SEQ ID NO: 7699 - DNA, 20 bp, Artificial Sequence
  sgRNA
ttcagccttatgactcagtg

SEQ ID NO: 7700 - DNA, 20 bp, Artificial Sequence
  sgRNA
tgttatgaactcgcgctggg

SEQ ID NO: 7701 - DNA, 20 bp, Artificial Sequence
  sgRNA
gttgcctccactgctgtagc

SEQ ID NO: 7702 - DNA, 20 bp, Artificial Sequence
  sgRNA
ccctaattgggcggcccgga

SEQ ID NO: 7703 - DNA, 20 bp, Artificial Sequence
  sgRNA
gctgagcgagaggaactatg

SEQ ID NO: 7704 - DNA, 20 bp, Artificial Sequence
  sgRNA
tgggaggcagtatgactttg

SEQ ID NO: 7705 - DNA, 20 bp, Artificial Sequence
  sgRNA
acatgaaactaatacggaaa

SEQ ID NO: 7706 - DNA, 20 bp, Artificial Sequence
  sgRNA
agaagctgtattcagctccc

SEQ ID NO: 7707 - DNA, 20 bp, Artificial Sequence
  sgRNA
ctctttgagactttattgac

SEQ ID NO: 7708 - DNA, 20 bp, Artificial Sequence
  sgRNA
ttggactccgctccgctgtt

SEQ ID NO: 7709 - DNA, 20 bp, Artificial Sequence
  sgRNA
agggctcgctctcggccctc

SEQ ID NO: 7710 - DNA, 20 bp, Artificial Sequence
  sgRNA
gttgttctctgaaatggacc

SEQ ID NO: 7711 - DNA, 20 bp, Artificial Sequence
  sgRNA
gggagtcaggagaactctcc

SEQ ID NO: 7712 - DNA, 20 bp, Artificial Sequence
  sgRNA
gagataggtgcggttgtctc

SEQ ID NO: 7713 - DNA, 20 bp, Artificial Sequence
  sgRNA
gaggctgctcacagtgtgta

SEQ ID NO: 7714 - DNA, 20 bp, Artificial Sequence
  sgRNA
atgtcagcagcaaggtcacg

SEQ ID NO: 7715 - DNA, 20 bp, Artificial Sequence
  sgRNA
atttgagaacagaccctaag

SEQ ID NO: 7716 - DNA, 20 bp, Artificial Sequence
  sgRNA
gagtgctgtcactcaagccc

SEQ ID NO: 7717 - DNA, 20 bp, Artificial Sequence
  sgRNA
aggctctcgcgggagcccgt

SEQ ID NO: 7718 - DNA, 20 bp, Artificial Sequence
  sgRNA
gtttgtgtcaccacagggtc

SEQ ID NO: 7719 - DNA, 20 bp, Artificial Sequence
  sgRNA
actctggctttggagaagac

SEQ ID NO: 7720 - DNA, 20 bp, Artificial Sequence
  sgRNA
cggaaggatatacccgcttg

SEQ ID NO: 7721 - DNA, 20 bp, Artificial Sequence
  sgRNA
acaaatgacaaatatcaccc

SEQ ID NO: 7722 - DNA, 20 bp, Artificial Sequence
  sgRNA
ggaagtgttgttgaccgtag

SEQ ID NO: 7723 - DNA, 20 bp, Artificial Sequence
  sgRNA
gccattgtgcggtgcattgt

SEQ ID NO: 7724 - DNA, 20 bp, Artificial Sequence
  sgRNA
aatcttaaccgcgttgccat

SEQ ID NO: 7725 - DNA, 20 bp, Artificial Sequence
  sgRNA
gtccgacggactgtacttta

SEQ ID NO: 7726 - DNA, 20 bp, Artificial Sequence
  sgRNA
tgtgaccctagtggttggcg

SEQ ID NO: 7727 - DNA, 20 bp, Artificial Sequence
  sgRNA
gcagggagcgcgcgatcccg

SEQ ID NO: 7728 - DNA, 20 bp, Artificial Sequence
  sgRNA
gtgcctctaggcggaagtgc

SEQ ID NO: 7729 - DNA, 20 bp, Artificial Sequence
  sgRNA
gttgagcaattataggagct

SEQ ID NO: 7730 - DNA, 20 bp, Artificial Sequence
  sgRNA
ggaaggcgctccggatgcgg

SEQ ID NO: 7731 - DNA, 20 bp, Artificial Sequence
  sgRNA
agaactgacaactcatctac

SEQ ID NO: 7732 - DNA, 20 bp, Artificial Sequence
  sgRNA
actgagatactgaatgagac

SEQ ID NO: 7733 - DNA, 20 bp, Artificial Sequence
  sgRNA
tttaaatcgagttcctgaga

SEQ ID NO: 7734 - DNA, 20 bp, Artificial Sequence
  sgRNA
tcagggtaggtgaagggtgt

SEQ ID NO: 7735 - DNA, 20 bp, Artificial Sequence
  sgRNA
ccggctcggcgtctcgcgag

SEQ ID NO: 7736 - DNA, 20 bp, Artificial Sequence
  sgRNA
gcggtccctcaatgacgcac

SEQ ID NO: 7737 - DNA, 20 bp, Artificial Sequence
  sgRNA
atagggttccacaatggccg

SEQ ID NO: 7738 - DNA, 20 bp, Artificial Sequence
  sgRNA
cggaacacaacccgcttctc

SEQ ID NO: 7739 - DNA, 20 bp, Artificial Sequence
  sgRNA
gcacgccgctgctgctcagc

SEQ ID NO: 7740 - DNA, 20 bp, Artificial Sequence
  sgRNA
aggactgctgatcctcctca

SEQ ID NO: 7741 - DNA, 20 bp, Artificial Sequence
  sgRNA
ggtcctcccttagactcgag

SEQ ID NO: 7742 - DNA, 20 bp, Artificial Sequence
  sgRNA
aggtctcacacttgtgtcat

SEQ ID NO: 7743 - DNA, 20 bp, Artificial Sequence
  sgRNA
gccagcataggtagataggc

SEQ ID NO: 7744 - DNA, 20 bp, Artificial Sequence
  sgRNA
gggcagccgacgtgtcaggg

SEQ ID NO: 7745 - DNA, 20 bp, Artificial Sequence
  sgRNA
aagctgctcaatggttgcca

SEQ ID NO: 7746 - DNA, 20 bp, Artificial Sequence
  sgRNA
acgtcaggcggaagtgcctg

SEQ ID NO: 7747 - DNA, 20 bp, Artificial Sequence
  sgRNA
tgctgcatagagttaaagcc

SEQ ID NO: 7748 - DNA, 20 bp, Artificial Sequence
  sgRNA
gggcttgtaaccgaatccac

SEQ ID NO: 7749 - DNA, 20 bp, Artificial Sequence
  sgRNA
ctttaacaaggcgacccgcc

SEQ ID NO: 7750 - DNA, 20 bp, Artificial Sequence
  sgRNA
acaacgaaagcaagtcagag

SEQ ID NO: 7751 - DNA, 20 bp, Artificial Sequence
  sgRNA
actgctgacttcctgatcac

SEQ ID NO: 7752 - DNA, 20 bp, Artificial Sequence
  sgRNA
gagttccggccaggacctgg

SEQ ID NO: 7753 - DNA, 20 bp, Artificial Sequence
  sgRNA
attctgaccgcatctcattt

SEQ ID NO: 7754 - DNA, 20 bp, Artificial Sequence
  sgRNA
gtggatttatgatgacacaa

SEQ ID NO: 7755 - DNA, 20 bp, Artificial Sequence
  sgRNA
ggcttgggaatcgatttccc

SEQ ID NO: 7756 - DNA, 20 bp, Artificial Sequence
  sgRNA
gtgcaaatccgagcagtgga

SEQ ID NO: 7757 - DNA, 20 bp, Artificial Sequence
  sgRNA
agccgtccagcgctcaccgc

SEQ ID NO: 7758 - DNA, 20 bp, Artificial Sequence
  sgRNA
ctcggacagtaagcaaagcc

SEQ ID NO: 7759 - DNA, 20 bp, Artificial Sequence
  sgRNA
gctcagggctcccgcgtacc

SEQ ID NO: 7760 - DNA, 20 bp, Artificial Sequence
  sgRNA
ggaacagggattctcccttg

SEQ ID NO: 7761 - DNA, 20 bp, Artificial Sequence
  sgRNA
aaataggtcagagttccaat

SEQ ID NO: 7762 - DNA, 20 bp, Artificial Sequence
  sgRNA
tgtgttggtacggtagcctt

SEQ ID NO: 7763 - DNA, 20 bp, Artificial Sequence
  sgRNA
gccttgccctcagacggtag

SEQ ID NO: 7764 - DNA, 20 bp, Artificial Sequence
  sgRNA
gaatagctaggcttacagtt

SEQ ID NO: 7765 - DNA, 20 bp, Artificial Sequence
  sgRNA
agtgcaagtgcgaggtacct

SEQ ID NO: 7766 - DNA, 20 bp, Artificial Sequence
  sgRNA
ccagttgtgcagtgttcacg

SEQ ID NO: 7767 - DNA, 20 bp, Artificial Sequence
  sgRNA
tgttcccggccttgaggatc

SEQ ID NO: 7768 - DNA, 20 bp, Artificial Sequence
  sgRNA
cggcacggcggcacggcttc

SEQ ID NO: 7769 - DNA, 20 bp, Artificial Sequence
  sgRNA
gtgggtacccggaccattga

SEQ ID NO: 7770 - DNA, 20 bp, Artificial Sequence
  sgRNA
acaatttaaaggcagtctag

SEQ ID NO: 7771 - DNA, 20 bp, Artificial Sequence
  sgRNA
tagggattgatagggttgtg

SEQ ID NO: 7772 - DNA, 20 bp, Artificial Sequence
  sgRNA
aaatgaggacaaagcccgcc

SEQ ID NO: 7773 - DNA, 20 bp, Artificial Sequence
  sgRNA
ggtctggcttgggatagctt

SEQ ID NO: 7774 - DNA, 20 bp, Artificial Sequence
  sgRNA
acatgggtgtgtctgaccag

SEQ ID NO: 7775 - DNA, 20 bp, Artificial Sequence
  sgRNA
gctgcttcgggagtgcgctt

SEQ ID NO: 7776 - DNA, 20 bp, Artificial Sequence
  sgRNA
gacagatgcaccaagaggtg

SEQ ID NO: 7777 - DNA, 20 bp, Artificial Sequence
  sgRNA
cgctgaccaatgggatcgcg

SEQ ID NO: 7778 - DNA, 20 bp, Artificial Sequence
  sgRNA
gttccgggaaacaccgcctg

SEQ ID NO: 7779 - DNA, 20 bp, Artificial Sequence
  sgRNA
cctgacggtgccagggttgg

SEQ ID NO: 7780 - DNA, 20 bp, Artificial Sequence
  sgRNA
tgcgaggtcctagacatcct

SEQ ID NO: 7781 - DNA, 20 bp, Artificial Sequence
  sgRNA
tcttcctctcgcagcggcgc

SEQ ID NO: 7782 - DNA, 20 bp, Artificial Sequence
  sgRNA
ctcaagtccggttgtcggcc

SEQ ID NO: 7783 - DNA, 20 bp, Artificial Sequence
  sgRNA
aggcaggaggcaaacctgta

SEQ ID NO: 7784 - DNA, 20 bp, Artificial Sequence
  sgRNA
gcgcgacaatctagcgcacc

SEQ ID NO: 7785 - DNA, 20 bp, Artificial Sequence
  sgRNA
ctgctggagataaacgcttg

SEQ ID NO: 7786 - DNA, 20 bp, Artificial Sequence
  sgRNA
tctggatacttagagggctg

SEQ ID NO: 7787 - DNA, 20 bp, Artificial Sequence
  sgRNA
ccggcggcgcagtagggacg

SEQ ID NO: 7788 - DNA, 20 bp, Artificial Sequence
  sgRNA
gaccaatcggtgtgcgcgcg

SEQ ID NO: 7789 - DNA, 20 bp, Artificial Sequence
  sgRNA
agcatgtggcaacgtcacag

SEQ ID NO: 7790 - DNA, 20 bp, Artificial Sequence
  sgRNA
gctgcagtaatagcaaactg

SEQ ID NO: 7791 - DNA, 20 bp, Artificial Sequence
  sgRNA
ctttgctctcgccgctgcca

SEQ ID NO: 7792 - DNA, 20 bp, Artificial Sequence
  sgRNA
aaccaattacagtctccctc

SEQ ID NO: 7793 - DNA, 20 bp, Artificial Sequence
  sgRNA
ctggaatgagccaccagagt

SEQ ID NO: 7794 - DNA, 20 bp, Artificial Sequence
  sgRNA
gggcgacttctgcaatcaag

SEQ ID NO: 7795 - DNA, 20 bp, Artificial Sequence
  sgRNA
cctagagtttcaacaccagg

SEQ ID NO: 7796 - DNA, 20 bp, Artificial Sequence
  sgRNA
agctttcacagcagattatg

SEQ ID NO: 7797 - DNA, 20 bp, Artificial Sequence
  sgRNA
gagcagagtccgcaccacct

SEQ ID NO: 7798 - DNA, 20 bp, Artificial Sequence
  sgRNA
gatgaggataagaagggcat

SEQ ID NO: 7799 - DNA, 20 bp, Artificial Sequence
  sgRNA
cgtcaggatgtaggtagtct

SEQ ID NO: 7800 - DNA, 20 bp, Artificial Sequence
  sgRNA
ccctggttcccattggtcgg

SEQ ID NO: 7801 - DNA, 20 bp, Artificial Sequence
  sgRNA
cacccactgtgccctataat

SEQ ID NO: 7802 - DNA, 20 bp, Artificial Sequence
  sgRNA
caccatgtgtttacactgat

SEQ ID NO: 7803 - DNA, 20 bp, Artificial Sequence
  sgRNA
gtagaggcggccacttcgta

SEQ ID NO: 7804 - DNA, 20 bp, Artificial Sequence
  sgRNA
ctcaggtaggccatccgcgt

SEQ ID NO: 7805 - DNA, 20 bp, Artificial Sequence
  sgRNA
agagaaatattaatccaggc

SEQ ID NO: 7806 - DNA, 20 bp, Artificial Sequence
  sgRNA
gttacgtcataccaccaccg

SEQ ID NO: 7807 - DNA, 20 bp, Artificial Sequence
  sgRNA
ggtgaggtcagtcacacaac

SEQ ID NO: 7808 - DNA, 20 bp, Artificial Sequence
  sgRNA
gttgtataatttgatatccc

SEQ ID NO: 7809 - DNA, 20 bp, Artificial Sequence
  sgRNA
gagacacagcattgctctcc

SEQ ID NO: 7810 - DNA, 20 bp, Artificial Sequence
  sgRNA
atggagctcccgcggccgag

SEQ ID NO: 7811 - DNA, 20 bp, Artificial Sequence
  sgRNA
ccctgcgagccaggcacgcg

SEQ ID NO: 7812 - DNA, 20 bp, Artificial Sequence
  sgRNA
ggagcggtgcttccaccgcc

SEQ ID NO: 7813 - DNA, 20 bp, Artificial Sequence
  sgRNA
ggtggtggacttgatcaaga

SEQ ID NO: 7814 - DNA, 20 bp, Artificial Sequence
  sgRNA
ccctcctgtcgcacaggtcg

SEQ ID NO: 7815 - DNA, 20 bp, Artificial Sequence
  sgRNA
agggcgcagttgggcgctcc

SEQ ID NO: 7816 - DNA, 20 bp, Artificial Sequence
  sgRNA
ccatgaacgttaacagtctg

SEQ ID NO: 7817 - DNA, 20 bp, Artificial Sequence
  sgRNA
cgtctgtgaatgtatcagtt

SEQ ID NO: 7818 - DNA, 20 bp, Artificial Sequence
  sgRNA
aaggagctggatagatcaac

SEQ ID NO: 7819 - DNA, 20 bp, Artificial Sequence
  sgRNA
cagcaatcgtccctttaaat

SEQ ID NO: 7820 - DNA, 20 bp, Artificial Sequence
  sgRNA
taactgtccaattaggaacg

SEQ ID NO: 7821 - DNA, 20 bp, Artificial Sequence
  sgRNA
tgtagctgcctcttgtccca

SEQ ID NO: 7822 - DNA, 20 bp, Artificial Sequence
  sgRNA
ctctgacgtcagaggcctta

SEQ ID NO: 7823 - DNA, 20 bp, Artificial Sequence
  sgRNA
ccaaattaacccattattgt

SEQ ID NO: 7824 - DNA, 20 bp, Artificial Sequence
  sgRNA
agtgtgtcattacacagaac

SEQ ID NO: 7825 - DNA, 20 bp, Artificial Sequence
  sgRNA
ggattctcagaagtgggtgg

SEQ ID NO: 7826 - DNA, 20 bp, Artificial Sequence
  sgRNA
cttcctctaagtagcatgtt

SEQ ID NO: 7827 - DNA, 20 bp, Artificial Sequence
  sgRNA
gggtcttgagttcaagagat

SEQ ID NO: 7828 - DNA, 20 bp, Artificial Sequence
  sgRNA
catcagagatcattgggcta

SEQ ID NO: 7829 - DNA, 20 bp, Artificial Sequence
  sgRNA
ttacagcccggctctgtgat

SEQ ID NO: 7830 - DNA, 20 bp, Artificial Sequence
  sgRNA
agatcatgtgagtgtaggca

SEQ ID NO: 7831 - DNA, 20 bp, Artificial Sequence
  sgRNA
tgcgcactggcgccggcgtg

SEQ ID NO: 7832 - DNA, 20 bp, Artificial Sequence
  sgRNA
atctccagtagcgctctgac

SEQ ID NO: 7833 - DNA, 20 bp, Artificial Sequence
  sgRNA
gtgaagcctagctttctgcc

SEQ ID NO: 7834 - DNA, 20 bp, Artificial Sequence
  sgRNA
gtcacttccgcccaccggag

SEQ ID NO: 7835 - DNA, 20 bp, Artificial Sequence
  sgRNA
ggaggagagcaatgtgtgta

SEQ ID NO: 7836 - DNA, 20 bp, Artificial Sequence
  sgRNA
aggccacgtcgacggtggcg

SEQ ID NO: 7837 - DNA, 20 bp, Artificial Sequence
  sgRNA
gtctacgtcagaagtccgcg

SEQ ID NO: 7838 - DNA, 20 bp, Artificial Sequence
  sgRNA
cccttccagaagctgggcgc

SEQ ID NO: 7839 - DNA, 20 bp, Artificial Sequence
  sgRNA
gacggaagtcgccaggcttc

SEQ ID NO: 7840 - DNA, 20 bp, Artificial Sequence
  sgRNA
gaacacccgcacacaacaag

SEQ ID NO: 7841 - DNA, 20 bp, Artificial Sequence
  sgRNA
gaactgaatgtcgctcattt

SEQ ID NO: 7842 - DNA, 20 bp, Artificial Sequence
  sgRNA
ttccagcagctgcgtttgcc

SEQ ID NO: 7843 - DNA, 20 bp, Artificial Sequence
  sgRNA
tggctgactgatgtccgcgg

SEQ ID NO: 7844 - DNA, 20 bp, Artificial Sequence
  sgRNA
gcagggcgcgttgaaacttt

SEQ ID NO: 7845 - DNA, 20 bp, Artificial Sequence
  sgRNA
cccgcaccgcctccgttgag

SEQ ID NO: 7846 - DNA, 20 bp, Artificial Sequence
  sgRNA
ggttgctctcgcggcgcgcc

SEQ ID NO: 7847 - DNA, 20 bp, Artificial Sequence
  sgRNA
catatattactttagcggct

SEQ ID NO: 7848 - DNA, 20 bp, Artificial Sequence
  sgRNA
agtccaaatgagtgcttcta

SEQ ID NO: 7849 - DNA, 20 bp, Artificial Sequence
  sgRNA
caggcacagcaggcgtggag

SEQ ID NO: 7850 - DNA, 20 bp, Artificial Sequence
  sgRNA
acagctgctacggccgaggg

SEQ ID NO: 7851 - DNA, 20 bp, Artificial Sequence
  sgRNA
cgaatgctaatgagctgaaa

SEQ ID NO: 7852 - DNA, 20 bp, Artificial Sequence
  sgRNA
aaaggatgtaaactttacag

SEQ ID NO: 7853 - DNA, 20 bp, Artificial Sequence
  sgRNA
gctccggagcccaaacctgt

SEQ ID NO: 7854 - DNA, 20 bp, Artificial Sequence
  sgRNA
tgtcaggaagtggacagggt

SEQ ID NO: 7855 - DNA, 20 bp, Artificial Sequence
  sgRNA
ctttcatttactgcagagca

SEQ ID NO: 7856 - DNA, 20 bp, Artificial Sequence
  sgRNA
tagcattgcttataaattgc

SEQ ID NO: 7857 - DNA, 20 bp, Artificial Sequence
  sgRNA
gcagacgcgagtttgagccg

SEQ ID NO: 7858 - DNA, 20 bp, Artificial Sequence
  sgRNA
ctacgaaccagtccggagcg

SEQ ID NO: 7859 - DNA, 20 bp, Artificial Sequence
  sgRNA
ttcaaactggaaagcagaaa

SEQ ID NO: 7860 - DNA, 20 bp, Artificial Sequence
  sgRNA
gtcgggacgtgtgcttcact

SEQ ID NO: 7861 - DNA, 20 bp, Artificial Sequence
  sgRNA
aagggttcctgagacagcca

SEQ ID NO: 7862 - DNA, 20 bp, Artificial Sequence
  sgRNA
acgagcccagcgagcgataa

SEQ ID NO: 7863 - DNA, 20 bp, Artificial Sequence
  sgRNA
ttgcactgaacgagggccgc

SEQ ID NO: 7864 - DNA, 20 bp, Artificial Sequence
  sgRNA
ttcgcggatccacagtaggg

SEQ ID NO: 7865 - DNA, 20 bp, Artificial Sequence
  sgRNA
ccaacctggtgccacaatat

SEQ ID NO: 7866 - DNA, 20 bp, Artificial Sequence
  sgRNA
cagggaaagactccacgcaa

SEQ ID NO: 7867 - DNA, 20 bp, Artificial Sequence
  sgRNA
cgtgggtgtgcaagggtgca

SEQ ID NO: 7868 - DNA, 20 bp, Artificial Sequence
  sgRNA
gtctgtccggttgcgccgag

SEQ ID NO: 7869 - DNA, 20 bp, Artificial Sequence
  sgRNA
ttagactggaagtggtgtgc

SEQ ID NO: 7870 - DNA, 20 bp, Artificial Sequence
  sgRNA
tggcggtgtccgctgctgcc

SEQ ID NO: 7871 - DNA, 20 bp, Artificial Sequence
  sgRNA
gcgcgggactagacacaaag

SEQ ID NO: 7872 - DNA, 20 bp, Artificial Sequence
  sgRNA
tgcagtatggtgtgtgtgtt

SEQ ID NO: 7873 - DNA, 20 bp, Artificial Sequence
  sgRNA
catctatcgatcatagtgca

SEQ ID NO: 7874 - DNA, 20 bp, Artificial Sequence
  sgRNA
cttcccacacgcgccctgcc

SEQ ID NO: 7875 - DNA, 20 bp, Artificial Sequence
  sgRNA
tcaaggaccaatcgtacccg

SEQ ID NO: 7876 - DNA, 20 bp, Artificial Sequence
  sgRNA
cccggcgccaactgtggagg

SEQ ID NO: 7877 - DNA, 20 bp, Artificial Sequence
  sgRNA
gggcagcgagcgaatccgat

SEQ ID NO: 7878 - DNA, 20 bp, Artificial Sequence
  sgRNA
acagctttcagtgtgagttg

SEQ ID NO: 7879 - DNA, 20 bp, Artificial Sequence
  sgRNA
gggcgcggcatgcactgctt

SEQ ID NO: 7880 - DNA, 20 bp, Artificial Sequence
  sgRNA
gaagaggatgccgagagcac

SEQ ID NO: 7881 - DNA, 20 bp, Artificial Sequence
  sgRNA
ggcggagccctatggactcc

SEQ ID NO: 7882 - DNA, 20 bp, Artificial Sequence
  sgRNA
cccatctcacgcccacggcg

SEQ ID NO: 7883 - DNA, 20 bp, Artificial Sequence
  sgRNA
ccagttcacagggctcccaa

SEQ ID NO: 7884 - DNA, 20 bp, Artificial Sequence
  sgRNA
gaagccacaaatgcttgcag

SEQ ID NO: 7885 - DNA, 20 bp, Artificial Sequence
  sgRNA
tcaaagtcgcggaagccaat

SEQ ID NO: 7886 - DNA, 20 bp, Artificial Sequence
  sgRNA
gtagttgagaacttcagccc

SEQ ID NO: 7887 - DNA, 20 bp, Artificial Sequence
  sgRNA
tatagctcgcgggcttaggc

SEQ ID NO: 7888 - DNA, 20 bp, Artificial Sequence
  sgRNA
cccgcggcactgaccgtcgg

SEQ ID NO: 7889 - DNA, 20 bp, Artificial Sequence
  sgRNA
agctgtactgaaatgtcaga

SEQ ID NO: 7890 - DNA, 20 bp, Artificial Sequence
  sgRNA
cccaaacccagagaagagca

SEQ ID NO: 7891 - DNA, 20 bp, Artificial Sequence
  sgRNA
gcaacatggcagcttctacc

SEQ ID NO: 7892 - DNA, 20 bp, Artificial Sequence
  sgRNA
ttatagtatcctgggaacca

SEQ ID NO: 7893 - DNA, 20 bp, Artificial Sequence
  sgRNA
tggactgatcgctcaggcaa

SEQ ID NO: 7894 - DNA, 20 bp, Artificial Sequence
  sgRNA
tacgcagttcactgggctgt

SEQ ID NO: 7895 - DNA, 20 bp, Artificial Sequence
  sgRNA
ctgcacgaaatgcttctctt

SEQ ID NO: 7896 - DNA, 20 bp, Artificial Sequence
  sgRNA
cacttcctccgcccacgagc

SEQ ID NO: 7897 - DNA, 20 bp, Artificial Sequence
  sgRNA
ggagagatctaccaaagcag

SEQ ID NO: 7898 - DNA, 20 bp, Artificial Sequence
  sgRNA
gcagccttacctgagtactt

SEQ ID NO: 7899 - DNA, 20 bp, Artificial Sequence
  sgRNA
acgctgccacctacagcgtc

SEQ ID NO: 7900 - DNA, 20 bp, Artificial Sequence
  sgRNA
aagcagtatactcaaatctg

SEQ ID NO: 7901 - DNA, 20 bp, Artificial Sequence
  sgRNA
ttcatcccgcctgggatctg

SEQ ID NO: 7902 - DNA, 20 bp, Artificial Sequence
  sgRNA
gctggcgcgggcaggaggag

SEQ ID NO: 7903 - DNA, 20 bp, Artificial Sequence
  sgRNA
aaaggtgacgtgtggtccaa

SEQ ID NO: 7904 - DNA, 20 bp, Artificial Sequence
  sgRNA
cgggcgtcagcttggagctg

SEQ ID NO: 7905 - DNA, 20 bp, Artificial Sequence
  sgRNA
atgctggagtttggtcaatg

SEQ ID NO: 7906 - DNA, 20 bp, Artificial Sequence
  sgRNA
gggaaagggagagtgagagg

SEQ ID NO: 7907 - DNA, 20 bp, Artificial Sequence
  sgRNA
aaactgtcaagccagcgcct

SEQ ID NO: 7908 - DNA, 20 bp, Artificial Sequence
  sgRNA
ctggagctccgcacccgttt

SEQ ID NO: 7909 - DNA, 20 bp, Artificial Sequence
  sgRNA
catggatgctacatccagca

SEQ ID NO: 7910 - DNA, 20 bp, Artificial Sequence
  sgRNA
tcgctcggaacgcgttccgg

SEQ ID NO: 7911 - DNA, 20 bp, Artificial Sequence
  sgRNA
gtggctgtcttccacttctc

SEQ ID NO: 7912 - DNA, 20 bp, Artificial Sequence
  sgRNA
gcgatgcgtcatttccgtcc

SEQ ID NO: 7913 - DNA, 20 bp, Artificial Sequence
  sgRNA
ggctttgatcttgggcgagc

SEQ ID NO: 7914 - DNA, 20 bp, Artificial Sequence
  sgRNA
cggcggcggctcggcctaag

SEQ ID NO: 7915 - DNA, 20 bp, Artificial Sequence
  sgRNA
cagcttggagtgggtgcagc

SEQ ID NO: 7916 - DNA, 20 bp, Artificial Sequence
  sgRNA
atcaagcctagagcaaagcc

SEQ ID NO: 7917 - DNA, 20 bp, Artificial Sequence
  sgRNA
cccagcaacaccaataagct

SEQ ID NO: 7918 - DNA, 20 bp, Artificial Sequence
  sgRNA
tctccgcggacgagacagcg

SEQ ID NO: 7919 - DNA, 20 bp, Artificial Sequence
  sgRNA
caggaaggagcaagtcaggg

SEQ ID NO: 7920 - DNA, 20 bp, Artificial Sequence
  sgRNA
aggcgaggatggaggaggag

SEQ ID NO: 7921 - DNA, 20 bp, Artificial Sequence
  sgRNA
aaagagcagagtgaaccaat

SEQ ID NO: 7922 - DNA, 20 bp, Artificial Sequence
  sgRNA
ttaaagacacgcccacgtca

SEQ ID NO: 7923 - DNA, 20 bp, Artificial Sequence
  sgRNA
gtgctgctctgggactgaac

SEQ ID NO: 7924 - DNA, 20 bp, Artificial Sequence
  sgRNA
gtactgggttctttagctcc

SEQ ID NO: 7925 - DNA, 20 bp, Artificial Sequence
  sgRNA
cgggcggcccgcgagcttga

SEQ ID NO: 7926 - DNA, 20 bp, Artificial Sequence
  sgRNA
gccttctattggcccagtga

SEQ ID NO: 7927 - DNA, 20 bp, Artificial Sequence
  sgRNA
cccacggtaggaggacgcag

SEQ ID NO: 7928 - DNA, 20 bp, Artificial Sequence
  sgRNA
aaagcagccggtcagaggtg

SEQ ID NO: 7929 - DNA, 20 bp, Artificial Sequence
  sgRNA
gagttaatgaagtactaggc

SEQ ID NO: 7930 - DNA, 20 bp, Artificial Sequence
  sgRNA
tgcccgtgcctgtctttagg

SEQ ID NO: 7931 - DNA, 20 bp, Artificial Sequence
  sgRNA
gagcaagcctgttgggcacg

SEQ ID NO: 7932 - DNA, 20 bp, Artificial Sequence
  sgRNA
gcttctaaaggctactccct

SEQ ID NO: 7933 - DNA, 20 bp, Artificial Sequence
  sgRNA
ctcaattgagaaggtagttc

SEQ ID NO: 7934 - DNA, 20 bp, Artificial Sequence
  sgRNA
tgcgcgtgcgtcgcgccgga

SEQ ID NO: 7935 - DNA, 20 bp, Artificial Sequence
  sgRNA
ccaagtgcggtgagccgttg

SEQ ID NO: 7936 - DNA, 20 bp, Artificial Sequence
  sgRNA
ctaaagctggtagcagtcac

SEQ ID NO: 7937 - DNA, 20 bp, Artificial Sequence
  sgRNA
ccggtgcacagcaagtgtcc

SEQ ID NO: 7938 - DNA, 20 bp, Artificial Sequence
  sgRNA
atctttgacttctagcttgg

SEQ ID NO: 7939 - DNA, 20 bp, Artificial Sequence
  sgRNA
gaatctggacacacctcctc

SEQ ID NO: 7940 - DNA, 20 bp, Artificial Sequence
  sgRNA
catccgggccagggatactc

SEQ ID NO: 7941 - DNA, 20 bp, Artificial Sequence
  sgRNA
gagaagacgaagacagggcc

SEQ ID NO: 7942 - DNA, 20 bp, Artificial Sequence
  sgRNA
tgattgagattatgttccaa

SEQ ID NO: 7943 - DNA, 20 bp, Artificial Sequence
  sgRNA
gcaggcaagcaccttccaac

SEQ ID NO: 7944 - DNA, 20 bp, Artificial Sequence
  sgRNA
attactattgctttctggaa

SEQ ID NO: 7945 - DNA, 20 bp, Artificial Sequence
  sgRNA
ggcgagggagaggacgccct

SEQ ID NO: 7946 - DNA, 20 bp, Artificial Sequence
  sgRNA
tcacacttcttcaaagtgct

SEQ ID NO: 7947 - DNA, 20 bp, Artificial Sequence
  sgRNA
tccgtgcgcagcacacagag

SEQ ID NO: 7948 - DNA, 20 bp, Artificial Sequence
  sgRNA
ctacatcgttcatggagtgc

SEQ ID NO: 7949 - DNA, 20 bp, Artificial Sequence
  sgRNA
cggaggctggaactcacctg

SEQ ID NO: 7950 - DNA, 20 bp, Artificial Sequence
  sgRNA
tcagcgtggaattcatgaag

SEQ ID NO: 7951 - DNA, 20 bp, Artificial Sequence
  sgRNA
aggaccgcatctggtgcgcc

SEQ ID NO: 7952 - DNA, 20 bp, Artificial Sequence
  sgRNA
cccgttgtttagatcttgac

SEQ ID NO: 7953 - DNA, 20 bp, Artificial Sequence
  sgRNA
gaggtgctaagcagacgtcc

SEQ ID NO: 7954 - DNA, 20 bp, Artificial Sequence
  sgRNA
cctaatgtacgctgtacagg

SEQ ID NO: 7955 - DNA, 20 bp, Artificial Sequence
  sgRNA
cgaagtctggcgtcacgtcc

SEQ ID NO: 7956 - DNA, 20 bp, Artificial Sequence
  sgRNA
gtcctcccatctgaagaccc

SEQ ID NO: 7957 - DNA, 20 bp, Artificial Sequence
  sgRNA
cctaccttattaacttagtg

SEQ ID NO: 7958 - DNA, 20 bp, Artificial Sequence
  sgRNA
ccaggcacccgaccctgcgt

SEQ ID NO: 7959 - DNA, 20 bp, Artificial Sequence
  sgRNA
agagctagactgccacgttg

SEQ ID NO: 7960 - DNA, 20 bp, Artificial Sequence
  sgRNA
ttggaggcaccctccggctg

SEQ ID NO: 7961 - DNA, 20 bp, Artificial Sequence
  sgRNA
ctagctggtctaggagatcc

SEQ ID NO: 7962 - DNA, 20 bp, Artificial Sequence
  sgRNA
taagtgacacgtgactgccc

SEQ ID NO: 7963 - DNA, 20 bp, Artificial Sequence
  sgRNA
gtcgaggagcggctccttaa

SEQ ID NO: 7964 - DNA, 20 bp, Artificial Sequence
  sgRNA
cccttgcacgatctgtgggc

SEQ ID NO: 7965 - DNA, 20 bp, Artificial Sequence
  sgRNA
cgagttcacctatagtacat

SEQ ID NO: 7966 - DNA, 20 bp, Artificial Sequence
  sgRNA
gactgtagagattgacgtgg

SEQ ID NO: 7967 - DNA, 20 bp, Artificial Sequence
  sgRNA
tgacaagctagatccctttc

SEQ ID NO: 7968 - DNA, 20 bp, Artificial Sequence
  sgRNA
agctgaacatagcccggttt

SEQ ID NO: 7969 - DNA, 20 bp, Artificial Sequence
  sgRNA
tctctaggctctaacccgag

SEQ ID NO: 7970 - DNA, 20 bp, Artificial Sequence
  sgRNA
gtccttattgcgggccgcgc

SEQ ID NO: 7971 - DNA, 20 bp, Artificial Sequence
  sgRNA
tctggccctagatatagcag

SEQ ID NO: 7972 - DNA, 20 bp, Artificial Sequence
  sgRNA
gcacctcgactctggcgacc

SEQ ID NO: 7973 - DNA, 20 bp, Artificial Sequence
  sgRNA
agtcaaaggtcggtaaatag

SEQ ID NO: 7974 - DNA, 20 bp, Artificial Sequence
  sgRNA
gccggccttcctccatgcct

SEQ ID NO: 7975 - DNA, 20 bp, Artificial Sequence
  sgRNA
tgttgggcccgcctctcctc

SEQ ID NO: 7976 - DNA, 20 bp, Artificial Sequence
  sgRNA
ggagagagagagaggagagc

SEQ ID NO: 7977 - DNA, 20 bp, Artificial Sequence
  sgRNA
aggtagagcggtgacgcagc

SEQ ID NO: 7978 - DNA, 20 bp, Artificial Sequence
  sgRNA
aagcagaaagaagttaatgc

SEQ ID NO: 7979 - DNA, 20 bp, Artificial Sequence
  sgRNA
gtacgcgtgcgcacagcgaa

SEQ ID NO: 7980 - DNA, 20 bp, Artificial Sequence
  sgRNA
ggcactgaggcattgtgtgc

SEQ ID NO: 7981 - DNA, 20 bp, Artificial Sequence
  sgRNA
acattccactgaagtcccac

SEQ ID NO: 7982 - DNA, 20 bp, Artificial Sequence
  sgRNA
tttcggttgtctttctgcag

SEQ ID NO: 7983 - DNA, 20 bp, Artificial Sequence
  sgRNA
acttgcgtcaggtcggcagc

SEQ ID NO: 7984 - DNA, 20 bp, Artificial Sequence
  sgRNA
ctcatgactgttactctcgc

SEQ ID NO: 7985 - DNA, 20 bp, Artificial Sequence
  sgRNA
gctcacattgcttatagcta

SEQ ID NO: 7986 - DNA, 20 bp, Artificial Sequence
  sgRNA
cagttactctggccctaaat

SEQ ID NO: 7987 - DNA, 20 bp, Artificial Sequence
  sgRNA
gcagcaaagaattgaacgga

SEQ ID NO: 7988 - DNA, 20 bp, Artificial Sequence
  sgRNA
acgttgttaaccaaatcaaa

SEQ ID NO: 7989 - DNA, 20 bp, Artificial Sequence
  sgRNA
atgggagggtcgcaacgacc

SEQ ID NO: 7990 - DNA, 20 bp, Artificial Sequence
  sgRNA
actaagaggagggagaaggg

SEQ ID NO: 7991 - DNA, 20 bp, Artificial Sequence
  sgRNA
ggcgcgagtaggactgggcc

SEQ ID NO: 7992 - DNA, 20 bp, Artificial Sequence
  sgRNA
aggtcccattgaatcactaa

SEQ ID NO: 7993 - DNA, 20 bp, Artificial Sequence
  sgRNA
ctccctgtggtggaggctcg

SEQ ID NO: 7994 - DNA, 20 bp, Artificial Sequence
  sgRNA
aaatacagctttcctcaagc

SEQ ID NO: 7995 - DNA, 20 bp, Artificial Sequence
  sgRNA
cggcatggcccgacagcccg

SEQ ID NO: 7996 - DNA, 20 bp, Artificial Sequence
  sgRNA
ggcaagaccggagaggagga

SEQ ID NO: 7997 - DNA, 20 bp, Artificial Sequence
  sgRNA
acgtaccacgtgcccaaacg

SEQ ID NO: 7998 - DNA, 20 bp, Artificial Sequence
  sgRNA
ccgaagtctgtctgagcctg

SEQ ID NO: 7999 - DNA, 20 bp, Artificial Sequence
  sgRNA
ccctcccaaagactagcggg

SEQ ID NO: 8000 - DNA, 20 bp, Artificial Sequence
  sgRNA
taggtctgaactccctctta

SEQ ID NO: 8001 - DNA, 20 bp, Artificial Sequence
  sgRNA
gctgctactctcagcacgcc

SEQ ID NO: 8002 - DNA, 20 bp, Artificial Sequence
  sgRNA
taggtcatcgctagcaggtt

SEQ ID NO: 8003 - DNA, 20 bp, Artificial Sequence
  sgRNA
cagattcctcacagtcaata

SEQ ID NO: 8004 - DNA, 20 bp, Artificial Sequence
  sgRNA
cagacactttatcagataag

SEQ ID NO: 8005 - DNA, 20 bp, Artificial Sequence
  sgRNA
ccgcagctctcagacttcta

SEQ ID NO: 8006 - DNA, 20 bp, Artificial Sequence
  sgRNA
actagcccttgcgccaaggc

SEQ ID NO: 8007 - DNA, 20 bp, Artificial Sequence
  sgRNA
gagaccgggcaagtcctgtg

SEQ ID NO: 8008 - DNA, 20 bp, Artificial Sequence
  sgRNA
gctgcggtcccgcggaaggg

SEQ ID NO: 8009 - DNA, 20 bp, Artificial Sequence
  sgRNA
aacactgtttagctatggat

SEQ ID NO: 8010 - DNA, 20 bp, Artificial Sequence
  sgRNA
tatctaggtcaccaggtctt

SEQ ID NO: 8011 - DNA, 20 bp, Artificial Sequence
  sgRNA
cgcactaaaccaatgtttat

SEQ ID NO: 8012 - DNA, 20 bp, Artificial Sequence
  sgRNA
gctaacacccttgagattta

SEQ ID NO: 8013 - DNA, 20 bp, Artificial Sequence
  sgRNA
gaagtgggtggagatcaata

SEQ ID NO: 8014 - DNA, 20 bp, Artificial Sequence
  sgRNA
tttcaggactcgcctttatt

SEQ ID NO: 8015 - DNA, 20 bp, Artificial Sequence
  sgRNA
agcggtcgcaactttggcgc

SEQ ID NO: 8016 - DNA, 20 bp, Artificial Sequence
  sgRNA
agagataacttccgggagat

SEQ ID NO: 8017 - DNA, 20 bp, Artificial Sequence
  sgRNA
ggcgggatgttcccacgtgg

SEQ ID NO: 8018 - DNA, 20 bp, Artificial Sequence
  sgRNA
ctgtcgcaaaggccacatcc

SEQ ID NO: 8019 - DNA, 20 bp, Artificial Sequence
  sgRNA
tgggaaatagcccgtgtgat

SEQ ID NO: 8020 - DNA, 20 bp, Artificial Sequence
  sgRNA
tttggagacggagacaggtc

SEQ ID NO: 8021 - DNA, 20 bp, Artificial Sequence
  sgRNA
tttgctaggctgatttggag

SEQ ID NO: 8022 - DNA, 20 bp, Artificial Sequence
  sgRNA
aggaagtcaataccgtcagg

SEQ ID NO: 8023 - DNA, 20 bp, Artificial Sequence
  sgRNA
cccagggagcagccttggac

SEQ ID NO: 8024 - DNA, 20 bp, Artificial Sequence
  sgRNA
ggcgcctctccgaatccggg

SEQ ID NO: 8025 - DNA, 20 bp, Artificial Sequence
  sgRNA
agtgtcaatgtttggtcgga

SEQ ID NO: 8026 - DNA, 20 bp, Artificial Sequence
  sgRNA
tcctgcggagcgctcctaga

SEQ ID NO: 8027 - DNA, 20 bp, Artificial Sequence
  sgRNA
ggtggcgcggctgcgtcgtg

SEQ ID NO: 8028 - DNA, 20 bp, Artificial Sequence
  sgRNA
atagacactcagcgcgcgca

SEQ ID NO: 8029 - DNA, 20 bp, Artificial Sequence
  sgRNA
gggcggagactgacgcttcc

SEQ ID NO: 8030 - DNA, 20 bp, Artificial Sequence
  sgRNA
aagctgagcagaagcaatgg

SEQ ID NO: 8031 - DNA, 20 bp, Artificial Sequence
  sgRNA
caactctaagttgggagccc

SEQ ID NO: 8032 - DNA, 20 bp, Artificial Sequence
  sgRNA
gaaacctgccacctcttacc

SEQ ID NO: 8033 - DNA, 20 bp, Artificial Sequence
  sgRNA
aatgggcaggatgtctagca

SEQ ID NO: 8034 - DNA, 20 bp, Artificial Sequence
  sgRNA
ccctagaaagcaatcagagg

SEQ ID NO: 8035 - DNA, 20 bp, Artificial Sequence
  sgRNA
taacttatcccatttcaaac

SEQ ID NO: 8036 - DNA, 20 bp, Artificial Sequence
  sgRNA
tgggaaggcgcttcgagcga

SEQ ID NO: 8037 - DNA, 20 bp, Artificial Sequence
  sgRNA
cattgtgggagccgcgcgag

SEQ ID NO: 8038 - DNA, 20 bp, Artificial Sequence
  sgRNA
gaggaagccgagacctaaat

SEQ ID NO: 8039 - DNA, 20 bp, Artificial Sequence
  sgRNA
cccagtggaagtcgtgacgt

SEQ ID NO: 8040 - DNA, 20 bp, Artificial Sequence
  sgRNA
gactcctccttcaagaattg

SEQ ID NO: 8041 - DNA, 20 bp, Artificial Sequence
  sgRNA
gaaggtgcgggtccggctgt

SEQ ID NO: 8042 - DNA, 20 bp, Artificial Sequence
  sgRNA
aattgactgctgcgatggct

SEQ ID NO: 8043 - DNA, 20 bp, Artificial Sequence
  sgRNA
ggtcccgcatctacttccgg

SEQ ID NO: 8044 - DNA, 20 bp, Artificial Sequence
  sgRNA
caacgtcaagtgttgcgtgg

SEQ ID NO: 8045 - DNA, 20 bp, Artificial Sequence
  sgRNA
gcacgcgtgatggagctacc

SEQ ID NO: 8046 - DNA, 20 bp, Artificial Sequence
  sgRNA
gcacacctgcatcctagcct

SEQ ID NO: 8047 - DNA, 20 bp, Artificial Sequence
  sgRNA
gctgaagccttatcctcttg

SEQ ID NO: 8048 - DNA, 20 bp, Artificial Sequence
  sgRNA
aaaggaactgcgttcattga

SEQ ID NO: 8049 - DNA, 20 bp, Artificial Sequence
  sgRNA
tgcatctatgtcacatgggc

SEQ ID NO: 8050 - DNA, 20 bp, Artificial Sequence
  sgRNA
agccgtgagcccttctgtcc

SEQ ID NO: 8051 - DNA, 20 bp, Artificial Sequence
  sgRNA
cgcgaacaatgctgtgaccc

SEQ ID NO: 8052 - DNA, 20 bp, Artificial Sequence
  sgRNA
ggcggccgggcgcgcgccgg

SEQ ID NO: 8053 - DNA, 20 bp, Artificial Sequence
  sgRNA
tttcccatcccgtcatgggc

SEQ ID NO: 8054 - DNA, 20 bp, Artificial Sequence
  sgRNA
aacaggccacagagtgggag

SEQ ID NO: 8055 - DNA, 20 bp, Artificial Sequence
  sgRNA
ggtagttacaaaggcataga

SEQ ID NO: 8056 - DNA, 20 bp, Artificial Sequence
  sgRNA
gaggacaggctccaaccaaa

SEQ ID NO: 8057 - DNA, 20 bp, Artificial Sequence
  sgRNA
cttaggatgtgcatgtgaca

SEQ ID NO: 8058 - DNA, 20 bp, Artificial Sequence
  sgRNA
caagcgccacagacaataac

SEQ ID NO: 8059 - DNA, 20 bp, Artificial Sequence
  sgRNA
aacgggaagtctttggtctc

SEQ ID NO: 8060 - DNA, 20 bp, Artificial Sequence
  sgRNA
taggaacgcttgcaacagtg

SEQ ID NO: 8061 - DNA, 20 bp, Artificial Sequence
  sgRNA
acgggagggcgccggcccgg

SEQ ID NO: 8062 - DNA, 20 bp, Artificial Sequence
  sgRNA
agggcgtgtccttgtagtgg

SEQ ID NO: 8063 - DNA, 20 bp, Artificial Sequence
  sgRNA
gggcggtgatggactcagcg

SEQ ID NO: 8064 - DNA, 20 bp, Artificial Sequence
  sgRNA
ctgcagcgaggtccggacgc

SEQ ID NO: 8065 - DNA, 20 bp, Artificial Sequence
  sgRNA
acaagggcggtcacgtgcga

SEQ ID NO: 8066 - DNA, 20 bp, Artificial Sequence
  sgRNA
actcacccagaagcctctag

SEQ ID NO: 8067 - DNA, 20 bp, Artificial Sequence
  sgRNA
agtagagtggattataagac

SEQ ID NO: 8068 - DNA, 20 bp, Artificial Sequence
  sgRNA
cgagtgccgagcgcgccgag

SEQ ID NO: 8069 - DNA, 20 bp, Artificial Sequence
  sgRNA
caagttggctaggagcccag

SEQ ID NO: 8070 - DNA, 20 bp, Artificial Sequence
  sgRNA
aatcgaatgcgcaagactgg

SEQ ID NO: 8071 - DNA, 20 bp, Artificial Sequence
  sgRNA
gctgcttagtctgtcttctc

SEQ ID NO: 8072 - DNA, 20 bp, Artificial Sequence
  sgRNA
ggtggatgaggtcatcggct

SEQ ID NO: 8073 - DNA, 20 bp, Artificial Sequence
  sgRNA
tggaagagatgtgagtctgc

SEQ ID NO: 8074 - DNA, 20 bp, Artificial Sequence
  sgRNA
aacttgcctaccctgagcaa

SEQ ID NO: 8075 - DNA, 20 bp, Artificial Sequence
  sgRNA
cgccgggcttcgcctccaag

SEQ ID NO: 8076 - DNA, 20 bp, Artificial Sequence
  sgRNA
agagcgccttcagagaaatg

SEQ ID NO: 8077 - DNA, 20 bp, Artificial Sequence
  sgRNA
cccgggcgctgctggtcgaa

SEQ ID NO: 8078 - DNA, 20 bp, Artificial Sequence
  sgRNA
gaggatcagcgcaaacgtgg

SEQ ID NO: 8079 - DNA, 20 bp, Artificial Sequence
  sgRNA
acacaccgcggacgagctgg

SEQ ID NO: 8080 - DNA, 20 bp, Artificial Sequence
  sgRNA
gggtggcagttcagatcatc

SEQ ID NO: 8081 - DNA, 20 bp, Artificial Sequence
  sgRNA
ccgatggcgagcattggttg

SEQ ID NO: 8082 - DNA, 20 bp, Artificial Sequence
  sgRNA
gatggtatcagcctgtcttc

SEQ ID NO: 8083 - DNA, 20 bp, Artificial Sequence
  sgRNA
attggagtcgcgtctgcagg

SEQ ID NO: 8084 - DNA, 20 bp, Artificial Sequence
  sgRNA
gggagcacgcgaccatagag

SEQ ID NO: 8085 - DNA, 20 bp, Artificial Sequence
  sgRNA
tggcagtcatggacatgcag

SEQ ID NO: 8086 - DNA, 20 bp, Artificial Sequence
  sgRNA
acagcggtcggtcggaatgc

SEQ ID NO: 8087 - DNA, 20 bp, Artificial Sequence
  sgRNA
gtcacctgtttgggacgcca

SEQ ID NO: 8088 - DNA, 20 bp, Artificial Sequence
  sgRNA
acgtaaatcgtccatagcac

SEQ ID NO: 8089 - DNA, 20 bp, Artificial Sequence
  sgRNA
cggcctcacacccaacctgg

SEQ ID NO: 8090 - DNA, 20 bp, Artificial Sequence
  sgRNA
catggactacatacagtctt

SEQ ID NO: 8091 - DNA, 20 bp, Artificial Sequence
  sgRNA
tacagattaagtgcttcatg

SEQ ID NO: 8092 - DNA, 20 bp, Artificial Sequence
  sgRNA
aatgagtcatttgacgctcc

SEQ ID NO: 8093 - DNA, 20 bp, Artificial Sequence
  sgRNA
gtcgcgtgccggtgtcgccg

SEQ ID NO: 8094 - DNA, 20 bp, Artificial Sequence
  sgRNA
tgacattaagtactcagtgt

SEQ ID NO: 8095 - DNA, 20 bp, Artificial Sequence
  sgRNA
tttgaaacgtctccaacgat

SEQ ID NO: 8096 - DNA, 20 bp, Artificial Sequence
  sgRNA
taattagctcttatccctat

SEQ ID NO: 8097 - DNA, 20 bp, Artificial Sequence
  sgRNA
agaagctgaaatctagaact

SEQ ID NO: 8098 - DNA, 20 bp, Artificial Sequence
  sgRNA
tgcgtatacgtcagtcccaa

SEQ ID NO: 8099 - DNA, 20 bp, Artificial Sequence
  sgRNA
acgcggcttcagacgtctgc

SEQ ID NO: 8100 - DNA, 20 bp, Artificial Sequence
  sgRNA
ggtgaggcccaggtgcggac

SEQ ID NO: 8101 - DNA, 20 bp, Artificial Sequence
  sgRNA
accctaaacatgatgtcatc

SEQ ID NO: 8102 - DNA, 20 bp, Artificial Sequence
  sgRNA
cgctcggccgcgcgtcggga

SEQ ID NO: 8103 - DNA, 20 bp, Artificial Sequence
  sgRNA
gggcgtggcctcaagtgggc

SEQ ID NO: 8104 - DNA, 20 bp, Artificial Sequence
  sgRNA
accgggaagaggtgggagac

SEQ ID NO: 8105 - DNA, 20 bp, Artificial Sequence
  sgRNA
cacttctaaactacagaaat

SEQ ID NO: 8106 - DNA, 20 bp, Artificial Sequence
  sgRNA
gccggactcggcctcacacg

SEQ ID NO: 8107 - DNA, 20 bp, Artificial Sequence
  sgRNA
cccttcgctagccgggaccc

SEQ ID NO: 8108 - DNA, 20 bp, Artificial Sequence
  sgRNA
ttctgccttgtaaggccggg

SEQ ID NO: 8109 - DNA, 20 bp, Artificial Sequence
  sgRNA
ataactgcagaaagttcggg

SEQ ID NO: 8110 - DNA, 20 bp, Artificial Sequence
  sgRNA
cgcctgaacttcctcctgcg

SEQ ID NO: 8111 - DNA, 20 bp, Artificial Sequence
  sgRNA
gagatcagggccattcttgc

SEQ ID NO: 8112 - DNA, 20 bp, Artificial Sequence
  sgRNA
aactttggagcaggagtagg

SEQ ID NO: 8113 - DNA, 20 bp, Artificial Sequence
  sgRNA
gagcccggcgaagagttcag

SEQ ID NO: 8114 - DNA, 20 bp, Artificial Sequence
  sgRNA
atccacgtggcagagggacc

SEQ ID NO: 8115 - DNA, 20 bp, Artificial Sequence
  sgRNA
tctctggcctttacagcagc

SEQ ID NO: 8116 - DNA, 20 bp, Artificial Sequence
  sgRNA
gcccttctctcctacgcccg

SEQ ID NO: 8117 - DNA, 20 bp, Artificial Sequence
  sgRNA
cgctctatctccttaagaac

SEQ ID NO: 8118 - DNA, 20 bp, Artificial Sequence
  sgRNA
gttccttcccacccatcggc

SEQ ID NO: 8119 - DNA, 20 bp, Artificial Sequence
  sgRNA
tgggtctctaaactgcttaa

SEQ ID NO: 8120 - DNA, 20 bp, Artificial Sequence
  sgRNA
cggcggcggcaactccgcat

SEQ ID NO: 8121 - DNA, 20 bp, Artificial Sequence
  sgRNA
acaagtatcctacaccaaag

SEQ ID NO: 8122 - DNA, 20 bp, Artificial Sequence
  sgRNA
acgtcccattgctgagcccg

SEQ ID NO: 8123 - DNA, 20 bp, Artificial Sequence
  sgRNA
actgacgcagcgcgggcgcg

SEQ ID NO: 8124 - DNA, 20 bp, Artificial Sequence
  sgRNA
ggccttgacgaagctagccc

SEQ ID NO: 8125 - DNA, 20 bp, Artificial Sequence
  sgRNA
cgagagacaatatggccgcg

SEQ ID NO: 8126 - DNA, 20 bp, Artificial Sequence
  sgRNA
gatatgcaagattctacttt

SEQ ID NO: 8127 - DNA, 20 bp, Artificial Sequence
  sgRNA
gcgggatctcaagtggtccc

SEQ ID NO: 8128 - DNA, 20 bp, Artificial Sequence
  sgRNA
tttgagtatctacacggtga

SEQ ID NO: 8129 - DNA, 20 bp, Artificial Sequence
  sgRNA
atgctgcagtaataatcgca

SEQ ID NO: 8130 - DNA, 20 bp, Artificial Sequence
  sgRNA
ggataacccttgagcaaatt

SEQ ID NO: 8131 - DNA, 20 bp, Artificial Sequence
  sgRNA
atgaaattgagtcatgccat

SEQ ID NO: 8132 - DNA, 20 bp, Artificial Sequence
  sgRNA
attatctagggtggctgctg

SEQ ID NO: 8133 - DNA, 20 bp, Artificial Sequence
  sgRNA
caggcgacgcccattgccta

SEQ ID NO: 8134 - DNA, 20 bp, Artificial Sequence
  sgRNA
aaggcctatgtacccttggg

SEQ ID NO: 8135 - DNA, 20 bp, Artificial Sequence
  sgRNA
gccgcgggctcgctccaccc

SEQ ID NO: 8136 - DNA, 20 bp, Artificial Sequence
  sgRNA
ttgagaacctactgtatatg

SEQ ID NO: 8137 - DNA, 20 bp, Artificial Sequence
  sgRNA
cccagtaggctgtggcccag

SEQ ID NO: 8138 - DNA, 20 bp, Artificial Sequence
  sgRNA
taatcctctgaaaccttagt

SEQ ID NO: 8139 - DNA, 20 bp, Artificial Sequence
  sgRNA
tggactaacctgagcgccga

SEQ ID NO: 8140 - DNA, 20 bp, Artificial Sequence
  sgRNA
cgctgtgcgctagattgcaa

SEQ ID NO: 8141 - DNA, 20 bp, Artificial Sequence
  sgRNA
tcaggaaatctcagctatca

SEQ ID NO: 8142 - DNA, 20 bp, Artificial Sequence
  sgRNA
agagctcggaggtgtgggta

SEQ ID NO: 8143 - DNA, 20 bp, Artificial Sequence
  sgRNA
gaccttaacccttccgaccc

SEQ ID NO: 8144 - DNA, 20 bp, Artificial Sequence
  sgRNA
gaggtagacaagtggtctgg

SEQ ID NO: 8145 - DNA, 20 bp, Artificial Sequence
  sgRNA
cctgacagctggaagaaaca

SEQ ID NO: 8146 - DNA, 20 bp, Artificial Sequence
  sgRNA
gcttactgagtgtgtgcttt

SEQ ID NO: 8147 - DNA, 20 bp, Artificial Sequence
  sgRNA
actgcagttgcacaggagag

SEQ ID NO: 8148 - DNA, 20 bp, Artificial Sequence
  sgRNA
agagtgggtggtgttataaa

SEQ ID NO: 8149 - DNA, 20 bp, Artificial Sequence
  sgRNA
gagtctctctgacagggcgg

SEQ ID NO: 8150 - DNA, 20 bp, Artificial Sequence
  sgRNA
gccctgacacaaagcaaatc

SEQ ID NO: 8151 - DNA, 20 bp, Artificial Sequence
  sgRNA
gtacttaagagtgttctagg

SEQ ID NO: 8152 - DNA, 20 bp, Artificial Sequence
  sgRNA
taccagtaacagactcatgg

SEQ ID NO: 8153 - DNA, 20 bp, Artificial Sequence
  sgRNA
gatgacgtcaccgccgactg

SEQ ID NO: 8154 - DNA, 20 bp, Artificial Sequence
  sgRNA
gactctaaagacacggtgtg

SEQ ID NO: 8155 - DNA, 20 bp, Artificial Sequence
  sgRNA
gtctgcctggcgaccttgat

SEQ ID NO: 8156 - DNA, 20 bp, Artificial Sequence
  sgRNA
gggtacaaaggtgcctagtc

SEQ ID NO: 8157 - DNA, 20 bp, Artificial Sequence
  sgRNA
taaggaaagacggccctgag

SEQ ID NO: 8158 - DNA, 20 bp, Artificial Sequence
  sgRNA
gcgccagagttgcaggcggg

SEQ ID NO: 8159 - DNA, 20 bp, Artificial Sequence
  sgRNA
gaccagtagatggctcataa

SEQ ID NO: 8160 - DNA, 20 bp, Artificial Sequence
  sgRNA
cgtcacgggcgtcgcaggct

SEQ ID NO: 8161 - DNA, 20 bp, Artificial Sequence
  sgRNA
taggctttgtctaagacccg

SEQ ID NO: 8162 - DNA, 20 bp, Artificial Sequence
  sgRNA
ggcagtgggaggtgctgagc

SEQ ID NO: 8163 - DNA, 20 bp, Artificial Sequence
  sgRNA
tcttcgtaagcgtgaagcgc

SEQ ID NO: 8164 - DNA, 20 bp, Artificial Sequence
  sgRNA
tttcactttgtctgtagggc

SEQ ID NO: 8165 - DNA, 20 bp, Artificial Sequence
  sgRNA
tgccatccttcgctcctcgc

SEQ ID NO: 8166 - DNA, 20 bp, Artificial Sequence
  sgRNA
tgtactgatctgggatctca

SEQ ID NO: 8167 - DNA, 20 bp, Artificial Sequence
  sgRNA
agatgcaacccacgcaagtc

SEQ ID NO: 8168 - DNA, 20 bp, Artificial Sequence
  sgRNA
gttcagctaccgcaatccag

SEQ ID NO: 8169 - DNA, 20 bp, Artificial Sequence
  sgRNA
ttaaataggacagttcggcc

SEQ ID NO: 8170 - DNA, 20 bp, Artificial Sequence
  sgRNA
acgcgaacgctatggacacg

SEQ ID NO: 8171 - DNA, 20 bp, Artificial Sequence
  sgRNA
cctcggtgatttaaagcgtc

SEQ ID NO: 8172 - DNA, 20 bp, Artificial Sequence
  sgRNA
attcaccacaagcacagcaa

SEQ ID NO: 8173 - DNA, 20 bp, Artificial Sequence
  sgRNA
ggccagccgagtgataaggc

SEQ ID NO: 8174 - DNA, 20 bp, Artificial Sequence
  sgRNA
acggaggcggtcgtcaagcc

SEQ ID NO: 8175 - DNA, 20 bp, Artificial Sequence
  sgRNA
tgtcatggtttgaaatcctg

SEQ ID NO: 8176 - DNA, 20 bp, Artificial Sequence
  sgRNA
gaatttggttgtaaataacg

SEQ ID NO: 8177 - DNA, 20 bp, Artificial Sequence
  sgRNA
gttggacggagtctaagccc

SEQ ID NO: 8178 - DNA, 20 bp, Artificial Sequence
  sgRNA
cggagtcaagtccgctagag

SEQ ID NO: 8179 - DNA, 20 bp, Artificial Sequence
  sgRNA
cagtgaccacatgaaccttg

SEQ ID NO: 8180 - DNA, 20 bp, Artificial Sequence
  sgRNA
tttgtgaaggctttctgcac

SEQ ID NO: 8181 - DNA, 20 bp, Artificial Sequence
  sgRNA
actagcctgaaatgactgag

SEQ ID NO: 8182 - DNA, 20 bp, Artificial Sequence
  sgRNA
agcagcattcgctcggtttc

SEQ ID NO: 8183 - DNA, 20 bp, Artificial Sequence
  sgRNA
cagtagtcctaaatcatcag

SEQ ID NO: 8184 - DNA, 20 bp, Artificial Sequence
  sgRNA
tggctaaaccattgacggat

SEQ ID NO: 8185 - DNA, 20 bp, Artificial Sequence
  sgRNA
gctcacctgggagcttccta

SEQ ID NO: 8186 - DNA, 20 bp, Artificial Sequence
  sgRNA
tggaacggaagttccggcgg

SEQ ID NO: 8187 - DNA, 20 bp, Artificial Sequence
  sgRNA
ggaatacaaattctctaccc

SEQ ID NO: 8188 - DNA, 20 bp, Artificial Sequence
  sgRNA
agaggtgtaacagggtgtag

SEQ ID NO: 8189 - DNA, 20 bp, Artificial Sequence
  sgRNA
aggaagatgctgggagcatt

SEQ ID NO: 8190 - DNA, 20 bp, Artificial Sequence
  sgRNA
tgtttccaagatttctgaca

SEQ ID NO: 8191 - DNA, 20 bp, Artificial Sequence
  sgRNA
ggaacagtgaagggatggga

SEQ ID NO: 8192 - DNA, 20 bp, Artificial Sequence
  sgRNA
acaaccgggacaggttgccg

SEQ ID NO: 8193 - DNA, 20 bp, Artificial Sequence
  sgRNA
ggtgtgtccgcgcaccacgg

SEQ ID NO: 8194 - DNA, 20 bp, Artificial Sequence
  sgRNA
tcgattgtttctgacggact

SEQ ID NO: 8195 - DNA, 20 bp, Artificial Sequence
  sgRNA
cctgctcagttcgcagggtg

SEQ ID NO: 8196 - DNA, 20 bp, Artificial Sequence
  sgRNA
gacccagaaaggcgaagtga

SEQ ID NO: 8197 - DNA, 20 bp, Artificial Sequence
  sgRNA
agctcgaaagagccaatcag

SEQ ID NO: 8198 - DNA, 20 bp, Artificial Sequence
  sgRNA
gagagggatgtctgcagcgc

SEQ ID NO: 8199 - DNA, 20 bp, Artificial Sequence
  sgRNA
gtgcacatcgctcgctatcc

SEQ ID NO: 8200 - DNA, 20 bp, Artificial Sequence
  sgRNA
ccacgcctcttcgcgctaac

SEQ ID NO: 8201 - DNA, 20 bp, Artificial Sequence
  sgRNA
agtgtgcaccacgcgctgat

SEQ ID NO: 8202 - DNA, 20 bp, Artificial Sequence
  sgRNA
aaagccgcactcacgggagg

SEQ ID NO: 8203 - DNA, 20 bp, Artificial Sequence
  sgRNA
ggcgggtaggtagacatgct

SEQ ID NO: 8204 - DNA, 20 bp, Artificial Sequence
  sgRNA
ccctcgctcctctcctagtg

SEQ ID NO: 8205 - DNA, 20 bp, Artificial Sequence
  sgRNA
ccctgtttcctgcccaagtc

SEQ ID NO: 8206 - DNA, 20 bp, Artificial Sequence
  sgRNA
cagcaacaggtatagcgctc

SEQ ID NO: 8207 - DNA, 20 bp, Artificial Sequence
  sgRNA
agctttagaactaacaagtt

SEQ ID NO: 8208 - DNA, 20 bp, Artificial Sequence
  sgRNA
cgcggctctgattggaaggt

SEQ ID NO: 8209 - DNA, 20 bp, Artificial Sequence
  sgRNA
aatgagatcgcctctaccac

SEQ ID NO: 8210 - DNA, 20 bp, Artificial Sequence
  sgRNA
gaagagagcgagcttgaaga

SEQ ID NO: 8211 - DNA, 20 bp, Artificial Sequence
  sgRNA
gggtcgctgagccggtgcgc

SEQ ID NO: 8212 - DNA, 20 bp, Artificial Sequence
  sgRNA
gtcagctatcacgtggaggc

SEQ ID NO: 8213 - DNA, 20 bp, Artificial Sequence
  sgRNA
cacacaacgtttgcagaacg

SEQ ID NO: 8214 - DNA, 20 bp, Artificial Sequence
  sgRNA
cccgcgatggctaaggaatg

SEQ ID NO: 8215 - DNA, 20 bp, Artificial Sequence
  sgRNA
gggacaaagagcgtggccta

SEQ ID NO: 8216 - DNA, 20 bp, Artificial Sequence
  sgRNA
cgcgtctcacactcggcggt

SEQ ID NO: 8217 - DNA, 20 bp, Artificial Sequence
  sgRNA
ggtgaactccttgggtagcg

SEQ ID NO: 8218 - DNA, 20 bp, Artificial Sequence
  sgRNA
agggagccaggatgaactgt

SEQ ID NO: 8219 - DNA, 20 bp, Artificial Sequence
  sgRNA
ttgacaaggcgatgtttgca

SEQ ID NO: 8220 - DNA, 20 bp, Artificial Sequence
  sgRNA
cttctgcaacatcttccttc

SEQ ID NO: 8221 - DNA, 20 bp, Artificial Sequence
  sgRNA
actcacttggttgcgcgacg

SEQ ID NO: 8222 - DNA, 20 bp, Artificial Sequence
  sgRNA
tggctaaagtagagctcttg

SEQ ID NO: 8223 - DNA, 20 bp, Artificial Sequence
  sgRNA
gcaaagcaccagagttgacc

SEQ ID NO: 8224 - DNA, 20 bp, Artificial Sequence
  sgRNA
tctcggagcctcagacgctc

SEQ ID NO: 8225 - DNA, 20 bp, Artificial Sequence
  sgRNA
cccaggtccgaggtgagttg

SEQ ID NO: 8226 - DNA, 20 bp, Artificial Sequence
  sgRNA
ttataagtttctagacctga

SEQ ID NO: 8227 - DNA, 20 bp, Artificial Sequence
  sgRNA
ggctgtcattagcagttaca

SEQ ID NO: 8228 - DNA, 20 bp, Artificial Sequence
  sgRNA
tggatccgtggcgcctcgcc

SEQ ID NO: 8229 - DNA, 20 bp, Artificial Sequence
  sgRNA
gggtcaaactgcgattccgt

SEQ ID NO: 8230 - DNA, 20 bp, Artificial Sequence
  sgRNA
cgttacttcactgaggcaga

SEQ ID NO: 8231 - DNA, 20 bp, Artificial Sequence
  sgRNA
gcagcgccgcacgaaagctc

SEQ ID NO: 8232 - DNA, 20 bp, Artificial Sequence
  sgRNA
gggcccaagagatgagccac

SEQ ID NO: 8233 - DNA, 20 bp, Artificial Sequence
  sgRNA
actcgcacgggattggacac

SEQ ID NO: 8234 - DNA, 20 bp, Artificial Sequence
  sgRNA
gggagtacgtagacgcagac

SEQ ID NO: 8235 - DNA, 20 bp, Artificial Sequence
  sgRNA
ctctcacgtcccggcggctg

SEQ ID NO: 8236 - DNA, 20 bp, Artificial Sequence
  sgRNA
gagacctgtcagcgcccgcg

SEQ ID NO: 8237 - DNA, 20 bp, Artificial Sequence
  sgRNA
gcacccacttcccatattga

SEQ ID NO: 8238 - DNA, 20 bp, Artificial Sequence
  sgRNA
taatctcattaacgcgcgcg

SEQ ID NO: 8239 - DNA, 20 bp, Artificial Sequence
  sgRNA
ctccaatgctgggttaaacc

SEQ ID NO: 8240 - DNA, 20 bp, Artificial Sequence
  sgRNA
ggctgaggagctccgcgcac

SEQ ID NO: 8241 - DNA, 20 bp, Artificial Sequence
  sgRNA
ctcgctcaaccgggtccctc

SEQ ID NO: 8242 - DNA, 20 bp, Artificial Sequence
  sgRNA
tgtgtgacagcatcgacgtg

SEQ ID NO: 8243 - DNA, 20 bp, Artificial Sequence
  sgRNA
cgcatttagtaatacgcgcg

SEQ ID NO: 8244 - DNA, 20 bp, Artificial Sequence
  sgRNA
cagagagccggctccggagg

SEQ ID NO: 8245 - DNA, 20 bp, Artificial Sequence
  sgRNA
ttaatgattgtcggactcgg

SEQ ID NO: 8246 - DNA, 20 bp, Artificial Sequence
  sgRNA
ggatcacgcgactcttcagc

SEQ ID NO: 8247 - DNA, 20 bp, Artificial Sequence
  sgRNA
tctcctgcatcccggccggg

SEQ ID NO: 8248 - DNA, 20 bp, Artificial Sequence
  sgRNA
ttctttggaccggaagcagg

SEQ ID NO: 8249 - DNA, 20 bp, Artificial Sequence
  sgRNA
agctgtttgcggcgacgatc

SEQ ID NO: 8250 - DNA, 20 bp, Artificial Sequence
  sgRNA
gagaaacaggatgtgtgttt

SEQ ID NO: 8251 - DNA, 20 bp, Artificial Sequence
  sgRNA
aggcaagaagacaagcgccg

SEQ ID NO: 8252 - DNA, 20 bp, Artificial Sequence
  sgRNA
gtcagaactaatgagcgggt

SEQ ID NO: 8253 - DNA, 20 bp, Artificial Sequence
  sgRNA
ccgttggcctcccgattcgt

SEQ ID NO: 8254 - DNA, 20 bp, Artificial Sequence
  sgRNA
gtgtgtgtgtgacttactga

SEQ ID NO: 8255 - DNA, 20 bp, Artificial Sequence
  sgRNA
caattcaagtccaaagtcga

SEQ ID NO: 8256 - DNA, 20 bp, Artificial Sequence
  sgRNA
gtaggtactgtgctctgcca

SEQ ID NO: 8257 - DNA, 20 bp, Artificial Sequence
  sgRNA
gcgcatcacgtgcgccggtc

SEQ ID NO: 8258 - DNA, 20 bp, Artificial Sequence
  sgRNA
gggcggctcaggcctttccc

SEQ ID NO: 8259 - DNA, 20 bp, Artificial Sequence
  sgRNA
ataaacggatactatcagag

SEQ ID NO: 8260 - DNA, 20 bp, Artificial Sequence
  sgRNA
atgctcgcacagtgtcctca

SEQ ID NO: 8261 - DNA, 20 bp, Artificial Sequence
  sgRNA
cagctttccggtctgttcta

SEQ ID NO: 8262 - DNA, 20 bp, Artificial Sequence
  sgRNA
gattacccttcttaccctcg

SEQ ID NO: 8263 - DNA, 20 bp, Artificial Sequence
  sgRNA
gctgcttccaggaagggctt

SEQ ID NO: 8264 - DNA, 20 bp, Artificial Sequence
  sgRNA
agggagcaaggcccgcccac

SEQ ID NO: 8265 - DNA, 20 bp, Artificial Sequence
  sgRNA
aaagaacctcacataagctc

SEQ ID NO: 8266 - DNA, 20 bp, Artificial Sequence
  sgRNA
tcatgggccgtgaagtcctt

SEQ ID NO: 8267 - DNA, 20 bp, Artificial Sequence
  sgRNA
gatgacgcgcaggcgcggtg

SEQ ID NO: 8268 - DNA, 20 bp, Artificial Sequence
  sgRNA
gcgtggtccagagactgccc

SEQ ID NO: 8269 - DNA, 20 bp, Artificial Sequence
  sgRNA
gcagagcctttggtacgcat

SEQ ID NO: 8270 - DNA, 20 bp, Artificial Sequence
  sgRNA
ggaggaaggtgtaatcagta

SEQ ID NO: 8271 - DNA, 20 bp, Artificial Sequence
  sgRNA
gaaagaatgcccgcctggcg

SEQ ID NO: 8272 - DNA, 20 bp, Artificial Sequence
  sgRNA
catgcgcatttgcaagcgct

SEQ ID NO: 8273 - DNA, 20 bp, Artificial Sequence
  sgRNA
gggtggaatcccgttacgat

SEQ ID NO: 8274 - DNA, 20 bp, Artificial Sequence
  sgRNA
tcattatttgcagcttaatg

SEQ ID NO: 8275 - DNA, 20 bp, Artificial Sequence
  sgRNA
gataataccgggcgccatat

SEQ ID NO: 8276 - DNA, 20 bp, Artificial Sequence
  sgRNA
tagagctcatttgtctgcaa

SEQ ID NO: 8277 - DNA, 20 bp, Artificial Sequence
  sgRNA
ggccgttccggaggcgggcg

SEQ ID NO: 8278 - DNA, 20 bp, Artificial Sequence
  sgRNA
atgtctttagaaatactgca

SEQ ID NO: 8279 - DNA, 20 bp, Artificial Sequence
  sgRNA
tttctttcccaccgaataca

SEQ ID NO: 8280 - DNA, 20 bp, Artificial Sequence
  sgRNA
gtgcagtgcagcgaggatgg

SEQ ID NO: 8281 - DNA, 20 bp, Artificial Sequence
  sgRNA
taatagcaggttccatccta

SEQ ID NO: 8282 - DNA, 20 bp, Artificial Sequence
  sgRNA
ggtctgccaggtgagatact

SEQ ID NO: 8283 - DNA, 20 bp, Artificial Sequence
  sgRNA
gtcagaatcgcgagggccag

SEQ ID NO: 8284 - DNA, 20 bp, Artificial Sequence
  sgRNA
cgagccctcggcgcgagccc

SEQ ID NO: 8285 - DNA, 20 bp, Artificial Sequence
  sgRNA
aagtcaaggctgcctcatcc

SEQ ID NO: 8286 - DNA, 20 bp, Artificial Sequence
  sgRNA
tctgcttcagttctgataga

SEQ ID NO: 8287 - DNA, 20 bp, Artificial Sequence
  sgRNA
cacgggtgatgtatgctcct

SEQ ID NO: 8288 - DNA, 20 bp, Artificial Sequence
  sgRNA
agtccagatgtcgctctccc

SEQ ID NO: 8289 - DNA, 20 bp, Artificial Sequence
  sgRNA
acttcacgccgtccaatcag

SEQ ID NO: 8290 - DNA, 20 bp, Artificial Sequence
  sgRNA
tcaagaaatgcgtgggctgt

SEQ ID NO: 8291 - DNA, 20 bp, Artificial Sequence
  sgRNA
ggtgagagaggcgcgggcca

SEQ ID NO: 8292 - DNA, 20 bp, Artificial Sequence
  sgRNA
ttgcgcaacaatcagcgccg

SEQ ID NO: 8293 - DNA, 20 bp, Artificial Sequence
  sgRNA
ataaatcaatatgacggaag

SEQ ID NO: 8294 - DNA, 20 bp, Artificial Sequence
  sgRNA
tagacagagcccatccttcc

SEQ ID NO: 8295 - DNA, 20 bp, Artificial Sequence
  sgRNA
ggtttgcaaggcaccgcacg

SEQ ID NO: 8296 - DNA, 20 bp, Artificial Sequence
  sgRNA
catgcgcaccgcggtccgcc

SEQ ID NO: 8297 - DNA, 20 bp, Artificial Sequence
  sgRNA
gcgggagctacggcggcgct

SEQ ID NO: 8298 - DNA, 20 bp, Artificial Sequence
  sgRNA
gtcagaggttctagccggag

SEQ ID NO: 8299 - DNA, 20 bp, Artificial Sequence
  sgRNA
ctggattagagccagtcgcc

SEQ ID NO: 8300 - DNA, 20 bp, Artificial Sequence
  sgRNA
tgcatcctgtgatgtgagat

SEQ ID NO: 8301 - DNA, 20 bp, Artificial Sequence
  sgRNA
cgaactcctcacaagttctc

SEQ ID NO: 8302 - DNA, 20 bp, Artificial Sequence
  sgRNA
atggagtgcatggccggcgg

SEQ ID NO: 8303 - DNA, 20 bp, Artificial Sequence
  sgRNA
ttgtgactatagcactcaag

SEQ ID NO: 8304 - DNA, 20 bp, Artificial Sequence
  sgRNA
gggcgcggtgcactaggcgc

SEQ ID NO: 8305 - DNA, 20 bp, Artificial Sequence
  sgRNA
ggcttaaggagaattgccaa

SEQ ID NO: 8306 - DNA, 20 bp, Artificial Sequence
  sgRNA
aaatgctccgctacaaacac

SEQ ID NO: 8307 - DNA, 20 bp, Artificial Sequence
  sgRNA
tttgctttccgtcggagcct

SEQ ID NO: 8308 - DNA, 20 bp, Artificial Sequence
  sgRNA
tgggtccggatgggaattaa

SEQ ID NO: 8309 - DNA, 20 bp, Artificial Sequence
  sgRNA
tcaggctgggcaggaattca

SEQ ID NO: 8310 - DNA, 20 bp, Artificial Sequence
  sgRNA
gggactacgtgttgtagccg

SEQ ID NO: 8311 - DNA, 20 bp, Artificial Sequence
  sgRNA
tgggagaccgatggttgctc

SEQ ID NO: 8312 - DNA, 20 bp, Artificial Sequence
  sgRNA
gagtgattgggagctggagt

SEQ ID NO: 8313 - DNA, 20 bp, Artificial Sequence
  sgRNA
tagaacctttatcaagcata

SEQ ID NO: 8314 - DNA, 20 bp, Artificial Sequence
  sgRNA
tcaccacactgtgtctgaga

SEQ ID NO: 8315 - DNA, 20 bp, Artificial Sequence
  sgRNA
ggcttcaataagcgggtggg

SEQ ID NO: 8316 - DNA, 20 bp, Artificial Sequence
  sgRNA
cgacgtaaccgcaccagcgc

SEQ ID NO: 8317 - DNA, 20 bp, Artificial Sequence
  sgRNA
tggcgtccctctctgggcac

SEQ ID NO: 8318 - DNA, 20 bp, Artificial Sequence
  sgRNA
aataaatgacacgcctacgc

SEQ ID NO: 8319 - DNA, 20 bp, Artificial Sequence
  sgRNA
gggagtgcagtctgggatac

SEQ ID NO: 8320 - DNA, 20 bp, Artificial Sequence
  sgRNA
ctcactggaataaacattac

SEQ ID NO: 8321 - DNA, 20 bp, Artificial Sequence
  sgRNA
aatgtgggaatttcctctta

SEQ ID NO: 8322 - DNA, 20 bp, Artificial Sequence
  sgRNA
gggctggaagaaatgcatag

SEQ ID NO: 8323 - DNA, 20 bp, Artificial Sequence
  sgRNA
ccaactcactgtgactccct

SEQ ID NO: 8324 - DNA, 20 bp, Artificial Sequence
  sgRNA
agagcagcatcgggaagtag

SEQ ID NO: 8325 - DNA, 20 bp, Artificial Sequence
  sgRNA
cgagcgaaattcctgagacc

SEQ ID NO: 8326 - DNA, 20 bp, Artificial Sequence
  sgRNA
cggttctcctcaggtgcggg

SEQ ID NO: 8327 - DNA, 20 bp, Artificial Sequence
  sgRNA
tgcttccggaggcgggtcag

SEQ ID NO: 8328 - DNA, 20 bp, Artificial Sequence
  sgRNA
tcgtcctgctcgtgttgctt

SEQ ID NO: 8329 - DNA, 20 bp, Artificial Sequence
  sgRNA
agcattggactatggcttga

SEQ ID NO: 8330 - DNA, 20 bp, Artificial Sequence
  sgRNA
agagtatctgtcagctgtgg

SEQ ID NO: 8331 - DNA, 20 bp, Artificial Sequence
  sgRNA
ccgcgtgttcctggatttga

SEQ ID NO: 8332 - DNA, 20 bp, Artificial Sequence
  sgRNA
gcgcgggtgaggcggtgcgg

SEQ ID NO: 8333 - DNA, 20 bp, Artificial Sequence
  sgRNA
gctccgcggcaggttggccc

SEQ ID NO: 8334 - DNA, 20 bp, Artificial Sequence
  sgRNA
tgctgctgctttcacaacag

SEQ ID NO: 8335 - DNA, 20 bp, Artificial Sequence
  sgRNA
gcttgtcacgtgcaattctg

SEQ ID NO: 8336 - DNA, 20 bp, Artificial Sequence
  sgRNA
cgtacatgttcccgcctctc

SEQ ID NO: 8337 - DNA, 20 bp, Artificial Sequence
  sgRNA
cacactgcacaagacctagt

SEQ ID NO: 8338 - DNA, 20 bp, Artificial Sequence
  sgRNA
tgcttagctgcgcagctttg

SEQ ID NO: 8339 - DNA, 20 bp, Artificial Sequence
  sgRNA
cgctggccaatagaaagtct

SEQ ID NO: 8340 - DNA, 20 bp, Artificial Sequence
  sgRNA
cgggaggctgggctgctggg

SEQ ID NO: 8341 - DNA, 20 bp, Artificial Sequence
  sgRNA
agggtgcaggttcaaacatc

SEQ ID NO: 8342 - DNA, 20 bp, Artificial Sequence
  sgRNA
cgcgagggctcggtgccgag

SEQ ID NO: 8343 - DNA, 20 bp, Artificial Sequence
  sgRNA
gaagacaggcggtggaccaa

SEQ ID NO: 8344 - DNA, 20 bp, Artificial Sequence
  sgRNA
gtggaatcggtgggaggaac

SEQ ID NO: 8345 - DNA, 20 bp, Artificial Sequence
  sgRNA
acacgtcacctctacgtgat

SEQ ID NO: 8346 - DNA, 20 bp, Artificial Sequence
  sgRNA
ctgtattgtccagttgctag

SEQ ID NO: 8347 - DNA, 20 bp, Artificial Sequence
  sgRNA
ggcgagacaagactccgacg

SEQ ID NO: 8348 - DNA, 20 bp, Artificial Sequence
  sgRNA
ataaagcattcagccctgcg

SEQ ID NO: 8349 - DNA, 20 bp, Artificial Sequence
  sgRNA
ccacagcgccactcaacggc

SEQ ID NO: 8350 - DNA, 20 bp, Artificial Sequence
  sgRNA
agcgcggcggtgcaggccaa

SEQ ID NO: 8351 - DNA, 20 bp, Artificial Sequence
  sgRNA
ctgtggagggcgaaaggacg

SEQ ID NO: 8352 - DNA, 20 bp, Artificial Sequence
  sgRNA
agcacagctactcctaggag

SEQ ID NO: 8353 - DNA, 20 bp, Artificial Sequence
  sgRNA
ggcggcgtcttagggtgttt

SEQ ID NO: 8354 - DNA, 20 bp, Artificial Sequence
  sgRNA
ttgctaggcttacaaggagc

SEQ ID NO: 8355 - DNA, 20 bp, Artificial Sequence
  sgRNA
cggctgctccctgctgactg

SEQ ID NO: 8356 - DNA, 20 bp, Artificial Sequence
  sgRNA
aaagagtttaccaggccctg

SEQ ID NO: 8357 - DNA, 20 bp, Artificial Sequence
  sgRNA
cagcagcagcggagacaacc

SEQ ID NO: 8358 - DNA, 20 bp, Artificial Sequence
  sgRNA
ccagctggtcaacagcattt

SEQ ID NO: 8359 - DNA, 20 bp, Artificial Sequence
  sgRNA
aggagagtctgtgcagatcc

SEQ ID NO: 8360 - DNA, 20 bp, Artificial Sequence
  sgRNA
aagtttgttgtgtgattaac

SEQ ID NO: 8361 - DNA, 20 bp, Artificial Sequence
  sgRNA
gattgagagtgcccgactcc

SEQ ID NO: 8362 - DNA, 20 bp, Artificial Sequence
  sgRNA
tggaactctacaaatctcca

SEQ ID NO: 8363 - DNA, 20 bp, Artificial Sequence
  sgRNA
aatgatcctttactgtacgt

SEQ ID NO: 8364 - DNA, 20 bp, Artificial Sequence
  sgRNA
gcttggaggcagaactccca

SEQ ID NO: 8365 - DNA, 20 bp, Artificial Sequence
  sgRNA
cccgaacctggcggaggccg

SEQ ID NO: 8366 - DNA, 20 bp, Artificial Sequence
  sgRNA
aaatagggcagccgcggcag

SEQ ID NO: 8367 - DNA, 20 bp, Artificial Sequence
  sgRNA
ggacccgggaccgctttcct

SEQ ID NO: 8368 - DNA, 20 bp, Artificial Sequence
  sgRNA
catataagaaaggagcaata

SEQ ID NO: 8369 - DNA, 20 bp, Artificial Sequence
  sgRNA
gcttgccgcacggccttgtg

SEQ ID NO: 8370 - DNA, 20 bp, Artificial Sequence
  sgRNA
ccatgcaggattggccagat

SEQ ID NO: 8371 - DNA, 20 bp, Artificial Sequence
  sgRNA
ggccgtacggttaagcccat

SEQ ID NO: 8372 - DNA, 20 bp, Artificial Sequence
  sgRNA
aagagaggcggccctgctct

SEQ ID NO: 8373 - DNA, 20 bp, Artificial Sequence
  sgRNA
aactctaaccaaccagatca

SEQ ID NO: 8374 - DNA, 20 bp, Artificial Sequence
  sgRNA
tttccactaccgcagatcct

SEQ ID NO: 8375 - DNA, 20 bp, Artificial Sequence
  sgRNA
tttaaagaaatgcaaggcgg

SEQ ID NO: 8376 - DNA, 20 bp, Artificial Sequence
  sgRNA
gaaagacaagaatgagccaa

SEQ ID NO: 8377 - DNA, 20 bp, Artificial Sequence
  sgRNA
ctcaccaagttgtctgtcag

SEQ ID NO: 8378 - DNA, 20 bp, Artificial Sequence
  sgRNA
cactgacgattgtttatgtg

SEQ ID NO: 8379 - DNA, 20 bp, Artificial Sequence
  sgRNA
caataaccactcatctccct

SEQ ID NO: 8380 - DNA, 20 bp, Artificial Sequence
  sgRNA
ttccatacaagcgcatttct

SEQ ID NO: 8381 - DNA, 20 bp, Artificial Sequence
  sgRNA
ttggttaaattggcctctcc

SEQ ID NO: 8382 - DNA, 20 bp, Artificial Sequence
  sgRNA
tgacttgactcatctgtgat

SEQ ID NO: 8383 - DNA, 20 bp, Artificial Sequence
  sgRNA
ggctggcttctccatcatgg

SEQ ID NO: 8384 - DNA, 20 bp, Artificial Sequence
  sgRNA
gcaacgcgcctgcttacgct

SEQ ID NO: 8385 - DNA, 20 bp, Artificial Sequence
  sgRNA
caactaggcagttggactcc

SEQ ID NO: 8386 - DNA, 20 bp, Artificial Sequence
  sgRNA
agggaatctttgacagcgcc

SEQ ID NO: 8387 - DNA, 20 bp, Artificial Sequence
  sgRNA
tgtacggcctgccctgctac

SEQ ID NO: 8388 - DNA, 20 bp, Artificial Sequence
  sgRNA
ccagcccgctgcccttggac

SEQ ID NO: 8389 - DNA, 20 bp, Artificial Sequence
  sgRNA
gagggaagaagaggcgcgag

SEQ ID NO: 8390 - DNA, 20 bp, Artificial Sequence
  sgRNA
gggcagagccagcggaggaa

SEQ ID NO: 8391 - DNA, 20 bp, Artificial Sequence
  sgRNA
tttactctttcctacctgaa

SEQ ID NO: 8392 - DNA, 20 bp, Artificial Sequence
  sgRNA
ggtgtgagtccatgcaacct

SEQ ID NO: 8393 - DNA, 20 bp, Artificial Sequence
  sgRNA
ctcagctctttctcatcaga

SEQ ID NO: 8394 - DNA, 20 bp, Artificial Sequence
  sgRNA
ggctcatcgcgtggacagag

SEQ ID NO: 8395 - DNA, 20 bp, Artificial Sequence
  sgRNA
caaggttctagacaacaccc

SEQ ID NO: 8396 - DNA, 20 bp, Artificial Sequence
  sgRNA
tcagcagctcaacttcctgt

SEQ ID NO: 8397 - DNA, 20 bp, Artificial Sequence
  sgRNA
acaacagcggatgccagccc

SEQ ID NO: 8398 - DNA, 20 bp, Artificial Sequence
  sgRNA
cgggagggacgacaaggatg

SEQ ID NO: 8399 - DNA, 20 bp, Artificial Sequence
  sgRNA
aaaggcccaagcttccaaga

SEQ ID NO: 8400 - DNA, 20 bp, Artificial Sequence
  sgRNA
tcccaatgggaccagagcag

SEQ ID NO: 8401 - DNA, 20 bp, Artificial Sequence
  sgRNA
ttgggctgtcagcagatctg

SEQ ID NO: 8402 - DNA, 20 bp, Artificial Sequence
  sgRNA
ttcgcgtcagcatctgttcg

SEQ ID NO: 8403 - DNA, 20 bp, Artificial Sequence
  sgRNA
gccggtggtaatggatgtgg

SEQ ID NO: 8404 - DNA, 20 bp, Artificial Sequence
  sgRNA
tcaacacagcccagagagtc

SEQ ID NO: 8405 - DNA, 20 bp, Artificial Sequence
  sgRNA
gatgcaccaatggcgatgcg

SEQ ID NO: 8406 - DNA, 20 bp, Artificial Sequence
  sgRNA
cgtgcgcgcgcgctcgagcg

SEQ ID NO: 8407 - DNA, 20 bp, Artificial Sequence
  sgRNA
acatagtagctatgttgaca

SEQ ID NO: 8408 - DNA, 20 bp, Artificial Sequence
  sgRNA
gtctgtcctatggcagggag

SEQ ID NO: 8409 - DNA, 20 bp, Artificial Sequence
  sgRNA
aacttatgagaaggcccacc

SEQ ID NO: 8410 - DNA, 20 bp, Artificial Sequence
  sgRNA
agtgtcacatgctcttgccc

SEQ ID NO: 8411 - DNA, 20 bp, Artificial Sequence
  sgRNA
ctgatcaacctagatattaa

SEQ ID NO: 8412 - DNA, 20 bp, Artificial Sequence
  sgRNA
cgtttcacaattaaggtccc

SEQ ID NO: 8413 - DNA, 20 bp, Artificial Sequence
  sgRNA
tcggtcgcgatgcgccagcc

SEQ ID NO: 8414 - DNA, 20 bp, Artificial Sequence
  sgRNA
cgtagttccagacgccgagt

SEQ ID NO: 8415 - DNA, 20 bp, Artificial Sequence
  sgRNA
ttcctgttggatataagtat

SEQ ID NO: 8416 - DNA, 20 bp, Artificial Sequence
  sgRNA
ggagagacaacagccgatcg

SEQ ID NO: 8417 - DNA, 20 bp, Artificial Sequence
  sgRNA
acggtgaacatctctccact

SEQ ID NO: 8418 - DNA, 20 bp, Artificial Sequence
  sgRNA
tcacgcggctccttggtaac

SEQ ID NO: 8419 - DNA, 20 bp, Artificial Sequence
  sgRNA
tcagtgcaatctgtcactgt

SEQ ID NO: 8420 - DNA, 20 bp, Artificial Sequence
  sgRNA
ccacaggagatcaatggaaa

SEQ ID NO: 8421 - DNA, 20 bp, Artificial Sequence
  sgRNA
cgaggaggcggagcggtgga

SEQ ID NO: 8422 - DNA, 20 bp, Artificial Sequence
  sgRNA
gactgtggtgaacgcagagc

SEQ ID NO: 8423 - DNA, 20 bp, Artificial Sequence
  sgRNA
ggcttccttgccctttggat

SEQ ID NO: 8424 - DNA, 20 bp, Artificial Sequence
  sgRNA
gccacgcctacagtcttccc

SEQ ID NO: 8425 - DNA, 20 bp, Artificial Sequence
  sgRNA
gcgctggaaccggaccaatc

SEQ ID NO: 8426 - DNA, 20 bp, Artificial Sequence
  sgRNA
tggaaacgcagagcagcgca

SEQ ID NO: 8427 - DNA, 20 bp, Artificial Sequence
  sgRNA
gcgcattcgcctgctcctct

SEQ ID NO: 8428 - DNA, 20 bp, Artificial Sequence
  sgRNA
acgtcacgggaggcgcgcgc

SEQ ID NO: 8429 - DNA, 20 bp, Artificial Sequence
  sgRNA
gggtcacgcctgcgcactgg

SEQ ID NO: 8430 - DNA, 20 bp, Artificial Sequence
  sgRNA
gaggctatcacttgagggcg

SEQ ID NO: 8431 - DNA, 20 bp, Artificial Sequence
  sgRNA
agttacacttgtaggaggac

SEQ ID NO: 8432 - DNA, 20 bp, Artificial Sequence
  sgRNA
ggaagctctcacatccaagc

SEQ ID NO: 8433 - DNA, 20 bp, Artificial Sequence
  sgRNA
actagaaggctctccaatcg

SEQ ID NO: 8434 - DNA, 20 bp, Artificial Sequence
  sgRNA
gggctcagatggtccaggtt

SEQ ID NO: 8435 - DNA, 20 bp, Artificial Sequence
  sgRNA
atcattgacattcttcagga

SEQ ID NO: 8436 - DNA, 20 bp, Artificial Sequence
  sgRNA
cgaagtgacaaagtccactc

SEQ ID NO: 8437 - DNA, 20 bp, Artificial Sequence
  sgRNA
acttgtgctaagaactttcc

SEQ ID NO: 8438 - DNA, 20 bp, Artificial Sequence
  sgRNA
ctcaggtagagattgataaa

SEQ ID NO: 8439 - DNA, 20 bp, Artificial Sequence
  sgRNA
actattcatccttaaatgct

SEQ ID NO: 8440 - DNA, 20 bp, Artificial Sequence
  sgRNA
ggagcggcgcgcaaaccttc

SEQ ID NO: 8441 - DNA, 20 bp, Artificial Sequence
  sgRNA
atcctgccatttaagaagta

SEQ ID NO: 8442 - DNA, 20 bp, Artificial Sequence
  sgRNA
tgcagaagtgataaagacaa

SEQ ID NO: 8443 - DNA, 20 bp, Artificial Sequence
  sgRNA
tgagagatcaaatgctaaat

SEQ ID NO: 8444 - DNA, 20 bp, Artificial Sequence
  sgRNA
tgggcacagagcgagggcga

SEQ ID NO: 8445 - DNA, 20 bp, Artificial Sequence
  sgRNA
cccagttattcacaaccgcc

SEQ ID NO: 8446 - DNA, 20 bp, Artificial Sequence
  sgRNA
cggctggacagagctgacac

SEQ ID NO: 8447 - DNA, 20 bp, Artificial Sequence
  sgRNA
tgtgtgaccctcagacaaca

SEQ ID NO: 8448 - DNA, 20 bp, Artificial Sequence
  sgRNA
aggctgaggctggtctcttg

SEQ ID NO: 8449 - DNA, 20 bp, Artificial Sequence
  sgRNA
aatcaggatcttcacaaaca

SEQ ID NO: 8450 - DNA, 20 bp, Artificial Sequence
  sgRNA
tccagcccagtcaactctca

SEQ ID NO: 8451 - DNA, 20 bp, Artificial Sequence
  sgRNA
gggtctccggccggacagcg

SEQ ID NO: 8452 - DNA, 20 bp, Artificial Sequence
  sgRNA
taactttggcctgagaggtg

SEQ ID NO: 8453 - DNA, 20 bp, Artificial Sequence
  sgRNA
ttacgtcagtcaccgctagc

SEQ ID NO: 8454 - DNA, 20 bp, Artificial Sequence
  sgRNA
agaggcatccacaattcgga

SEQ ID NO: 8455 - DNA, 20 bp, Artificial Sequence
  sgRNA
catctctctacgtcacggcc

SEQ ID NO: 8456 - DNA, 20 bp, Artificial Sequence
  sgRNA
gaggctctgcaaacccgcag

SEQ ID NO: 8457 - DNA, 20 bp, Artificial Sequence
  sgRNA
acgagaggtatccctccgcg

SEQ ID NO: 8458 - DNA, 20 bp, Artificial Sequence
  sgRNA
cgccgcagaggaccactgcc

SEQ ID NO: 8459 - DNA, 20 bp, Artificial Sequence
  sgRNA
cttgatagggaccaagagct

SEQ ID NO: 8460 - DNA, 20 bp, Artificial Sequence
  sgRNA
gcgccagacatttcctaaag

SEQ ID NO: 8461 - DNA, 20 bp, Artificial Sequence
  sgRNA
actgaaggccatatgtggga

SEQ ID NO: 8462 - DNA, 20 bp, Artificial Sequence
  sgRNA
tgttcagcctctaagtgata

SEQ ID NO: 8463 - DNA, 20 bp, Artificial Sequence
  sgRNA
agtctagtctgcgggtctct

SEQ ID NO: 8464 - DNA, 20 bp, Artificial Sequence
  sgRNA
agggcgactggtcaggaggg

SEQ ID NO: 8465 - DNA, 20 bp, Artificial Sequence
  sgRNA
tgccacgcccatgcgtgaag

SEQ ID NO: 8466 - DNA, 20 bp, Artificial Sequence
  sgRNA
aaccaagagctggaggacaa

SEQ ID NO: 8467 - DNA, 20 bp, Artificial Sequence
  sgRNA
gtcgctggcagcgcggtcgg

SEQ ID NO: 8468 - DNA, 20 bp, Artificial Sequence
  sgRNA
tgatgacacgccagcgcgcg

SEQ ID NO: 8469 - DNA, 20 bp, Artificial Sequence
  sgRNA
tagagagccgctgctccaag

SEQ ID NO: 8470 - DNA, 20 bp, Artificial Sequence
  sgRNA
ttgacgggccaataagagag

SEQ ID NO: 8471 - DNA, 20 bp, Artificial Sequence
  sgRNA
gacgcgtgaatggaggtgga

SEQ ID NO: 8472 - DNA, 20 bp, Artificial Sequence
  sgRNA
ggagggacgcgtaaccgggc

SEQ ID NO: 8473 - DNA, 20 bp, Artificial Sequence
  sgRNA
ggtccagtgatctagaggcg

SEQ ID NO: 8474 - DNA, 20 bp, Artificial Sequence
  sgRNA
tactgggagaggcacggagc

SEQ ID NO: 8475 - DNA, 20 bp, Artificial Sequence
  sgRNA
ggaaggtacgtataaccagt

SEQ ID NO: 8476 - DNA, 20 bp, Artificial Sequence
  sgRNA
gctcgctgctctgtggtcca

SEQ ID NO: 8477 - DNA, 20 bp, Artificial Sequence
  sgRNA
tcttcagagttccagaagtc

SEQ ID NO: 8478 - DNA, 20 bp, Artificial Sequence
  sgRNA
agcgagccgaggtttgtcga

SEQ ID NO: 8479 - DNA, 20 bp, Artificial Sequence
  sgRNA
tggctcgcagttcctgtttc

SEQ ID NO: 8480 - DNA, 20 bp, Artificial Sequence
  sgRNA
tcaagggttctgtgttcttc

SEQ ID NO: 8481 - DNA, 20 bp, Artificial Sequence
  sgRNA
ggttatgtagactagggaca

SEQ ID NO: 8482 - DNA, 20 bp, Artificial Sequence
  sgRNA
gtacggcggcaaaggtgaag

SEQ ID NO: 8483 - DNA, 20 bp, Artificial Sequence
  sgRNA
ccacgcagatgcagtacagc

SEQ ID NO: 8484 - DNA, 20 bp, Artificial Sequence
  sgRNA
gcgggacgcgcccacttggc

SEQ ID NO: 8485 - DNA, 20 bp, Artificial Sequence
  sgRNA
cgtagggaggtcgtcaccgc

SEQ ID NO: 8486 - DNA, 20 bp, Artificial Sequence
  sgRNA
acacatcatccaaagtgaaa

SEQ ID NO: 8487 - DNA, 20 bp, Artificial Sequence
  sgRNA
gccaggcgtcaccctggtgg

SEQ ID NO: 8488 - DNA, 20 bp, Artificial Sequence
  sgRNA
actggagagacagaatcatg

SEQ ID NO: 8489 - DNA, 20 bp, Artificial Sequence
  sgRNA
gaccgggataggacagagcg

SEQ ID NO: 8490 - DNA, 20 bp, Artificial Sequence
  sgRNA
tggtaggatccttgaatctc

SEQ ID NO: 8491 - DNA, 20 bp, Artificial Sequence
  sgRNA
ggatgcctgcaactgtttgc

SEQ ID NO: 8492 - DNA, 20 bp, Artificial Sequence
  sgRNA
ttacgaggcaaccaagagga

SEQ ID NO: 8493 - DNA, 20 bp, Artificial Sequence
  sgRNA
gggtggagcctatggtacac

SEQ ID NO: 8494 - DNA, 20 bp, Artificial Sequence
  sgRNA
aaggaaacccaggctgtgtc

SEQ ID NO: 8495 - DNA, 20 bp, Artificial Sequence
  sgRNA
aagaacctcagtcccgtcgt

SEQ ID NO: 8496 - DNA, 20 bp, Artificial Sequence
  sgRNA
tttctaagaagccttgagca

SEQ ID NO: 8497 - DNA, 20 bp, Artificial Sequence
  sgRNA
actgcttgtctccactaatt

SEQ ID NO: 8498 - DNA, 20 bp, Artificial Sequence
  sgRNA
accgagttctaccggagctc

SEQ ID NO: 8499 - DNA, 20 bp, Artificial Sequence
  sgRNA
aggcaactggctaactagcc

SEQ ID NO: 8500 - DNA, 20 bp, Artificial Sequence
  sgRNA
cgcacgctttggctcgggag

SEQ ID NO: 8501 - DNA, 20 bp, Artificial Sequence
  sgRNA
tggacaacacattgaacttg

SEQ ID NO: 8502 - DNA, 20 bp, Artificial Sequence
  sgRNA
cagctgcaagtactttgttc

SEQ ID NO: 8503 - DNA, 20 bp, Artificial Sequence
  sgRNA
agcctttctgcgttcatctt

SEQ ID NO: 8504 - DNA, 20 bp, Artificial Sequence
  sgRNA
caaggagggcgataccaaga

SEQ ID NO: 8505 - DNA, 20 bp, Artificial Sequence
  sgRNA
tcaaagcaaacagtgatagg

SEQ ID NO: 8506 - DNA, 20 bp, Artificial Sequence
  sgRNA
ctgagcagggtcgacagagc

SEQ ID NO: 8507 - DNA, 20 bp, Artificial Sequence
  sgRNA
aggaggaaagggacttcgaa

SEQ ID NO: 8508 - DNA, 20 bp, Artificial Sequence
  sgRNA
cgctctatatatacagcgcc

SEQ ID NO: 8509 - DNA, 20 bp, Artificial Sequence
  sgRNA
cccgcggcagtcacgtgcgc

SEQ ID NO: 8510 - DNA, 20 bp, Artificial Sequence
  sgRNA
gcgccatgagctctaggctt

SEQ ID NO: 8511 - DNA, 20 bp, Artificial Sequence
  sgRNA
caaccttagacttaggcatg

SEQ ID NO: 8512 - DNA, 20 bp, Artificial Sequence
  sgRNA
gaggaagggaggtgactgag

SEQ ID NO: 8513 - DNA, 20 bp, Artificial Sequence
  sgRNA
gacaagttcatgactgaatg

SEQ ID NO: 8514 - DNA, 20 bp, Artificial Sequence
  sgRNA
gaatgaaccaagtgtccgcc

SEQ ID NO: 8515 - DNA, 20 bp, Artificial Sequence
  sgRNA
aagaattcacatttgaaccc

SEQ ID NO: 8516 - DNA, 20 bp, Artificial Sequence
  sgRNA
tgtcgaatctcaacctagga

SEQ ID NO: 8517 - DNA, 20 bp, Artificial Sequence
  sgRNA
aacgactggcgcgcgcaccc

SEQ ID NO: 8518 - DNA, 20 bp, Artificial Sequence
  sgRNA
ctagagcgggttgttgaatc

SEQ ID NO: 8519 - DNA, 20 bp, Artificial Sequence
  sgRNA
cgcctccaaccgccgcacgc

SEQ ID NO: 8520 - DNA, 20 bp, Artificial Sequence
  sgRNA
cttattgattggccctgcag

SEQ ID NO: 8521 - DNA, 20 bp, Artificial Sequence
  sgRNA
tccaggactgacagtacttt

SEQ ID NO: 8522 - DNA, 20 bp, Artificial Sequence
  sgRNA
cccttggcagcgggtctaaa

SEQ ID NO: 8523 - DNA, 20 bp, Artificial Sequence
  sgRNA
cgcaggtaaatccatgcgcc

SEQ ID NO: 8524 - DNA, 20 bp, Artificial Sequence
  sgRNA
tcaacttatggtaatgagct

SEQ ID NO: 8525 - DNA, 20 bp, Artificial Sequence
  sgRNA
ctgtagtatcctctaagatt

SEQ ID NO: 8526 - DNA, 20 bp, Artificial Sequence
  sgRNA
ctagcgaaaggctgccgccc

SEQ ID NO: 8527 - DNA, 20 bp, Artificial Sequence
  sgRNA
agcgtagactaggcaagagg

SEQ ID NO: 8528 - DNA, 20 bp, Artificial Sequence
  sgRNA
gcaacaggattctttcagcc

SEQ ID NO: 8529 - DNA, 20 bp, Artificial Sequence
  sgRNA
actacaattcccataaagca

SEQ ID NO: 8530 - DNA, 20 bp, Artificial Sequence
  sgRNA
ctctcgctcctccggctttc

SEQ ID NO: 8531 - DNA, 20 bp, Artificial Sequence
  sgRNA
caaagtattgtaggaaatgc

SEQ ID NO: 8532 - DNA, 20 bp, Artificial Sequence
  sgRNA
ttgcgcgggcccaatgagcg

SEQ ID NO: 8533 - DNA, 20 bp, Artificial Sequence
  sgRNA
cagtcgtggcgcgtggagtg

SEQ ID NO: 8534 - DNA, 20 bp, Artificial Sequence
  sgRNA
tctgtgcagactgctggttg

SEQ ID NO: 8535 - DNA, 20 bp, Artificial Sequence
  sgRNA
ttgtggcggagagttagacg

SEQ ID NO: 8536 - DNA, 20 bp, Artificial Sequence
  sgRNA
tgagtagtatacatgtgagc

SEQ ID NO: 8537 - DNA, 20 bp, Artificial Sequence
  sgRNA
gaggcagcctacacacttcc

SEQ ID NO: 8538 - DNA, 20 bp, Artificial Sequence
  sgRNA
gtgtcttctagtctcaaagc

SEQ ID NO: 8539 - DNA, 20 bp, Artificial Sequence
  sgRNA
gtctgagctcgtacactgag

SEQ ID NO: 8540 - DNA, 20 bp, Artificial Sequence
  sgRNA
aggctcagtctgcttaggct

SEQ ID NO: 8541 - DNA, 20 bp, Artificial Sequence
  sgRNA
gaagcttccggcggacgcca

SEQ ID NO: 8542 - DNA, 20 bp, Artificial Sequence
  sgRNA
ggcagttagacagttctcca

SEQ ID NO: 8543 - DNA, 20 bp, Artificial Sequence
  sgRNA
tcaacaggaactagacagca

SEQ ID NO: 8544 - DNA, 20 bp, Artificial Sequence
  sgRNA
ggaaggaggaaggcagccgt

SEQ ID NO: 8545 - DNA, 20 bp, Artificial Sequence
  sgRNA
gcagccagcccggccttatt

SEQ ID NO: 8546 - DNA, 20 bp, Artificial Sequence
  sgRNA
aagttctagaccgcaggagg

SEQ ID NO: 8547 - DNA, 20 bp, Artificial Sequence
  sgRNA
tctggccctgtggctaagtc

SEQ ID NO: 8548 - DNA, 20 bp, Artificial Sequence
  sgRNA
tactttgcgcccactcctag

SEQ ID NO: 8549 - DNA, 20 bp, Artificial Sequence
  sgRNA
actctcctcaggccactgcg

SEQ ID NO: 8550 - DNA, 20 bp, Artificial Sequence
  sgRNA
aattattccacaaccatagc

SEQ ID NO: 8551 - DNA, 20 bp, Artificial Sequence
  sgRNA
aactgtgctggctggccacc

SEQ ID NO: 8552 - DNA, 20 bp, Artificial Sequence
  sgRNA
ttacatcatccttgggcgtg

SEQ ID NO: 8553 - DNA, 20 bp, Artificial Sequence
  sgRNA
ggctcgcgaccatagagaag

SEQ ID NO: 8554 - DNA, 20 bp, Artificial Sequence
  sgRNA
gagctctcggcaccgggctg

SEQ ID NO: 8555 - DNA, 20 bp, Artificial Sequence
  sgRNA
ttgcttgcaggagcgagtga

SEQ ID NO: 8556 - DNA, 20 bp, Artificial Sequence
  sgRNA
acgcggcgcttcccggaaga

SEQ ID NO: 8557 - DNA, 20 bp, Artificial Sequence
  sgRNA
tgtagaattggaactactag

SEQ ID NO: 8558 - DNA, 20 bp, Artificial Sequence
  sgRNA
tcctgtgaaatcagaccaat

SEQ ID NO: 8559 - DNA, 20 bp, Artificial Sequence
  sgRNA
tttgtccaatgagggagagc

SEQ ID NO: 8560 - DNA, 20 bp, Artificial Sequence
  sgRNA
atgctttcaacaccacattt

SEQ ID NO: 8561 - DNA, 20 bp, Artificial Sequence
  sgRNA
gggagggcccaggcgagcgg

SEQ ID NO: 8562 - DNA, 20 bp, Artificial Sequence
  sgRNA
gacatataggtggcctctgc

SEQ ID NO: 8563 - DNA, 20 bp, Artificial Sequence
  sgRNA
gctagctgtggaaagttggg

SEQ ID NO: 8564 - DNA, 20 bp, Artificial Sequence
  sgRNA
cccaccaaccgcgcgcggcg

SEQ ID NO: 8565 - DNA, 20 bp, Artificial Sequence
  sgRNA
aaattccgtagactcgccta

SEQ ID NO: 8566 - DNA, 20 bp, Artificial Sequence
  sgRNA
gtagactcaacaagttccag

SEQ ID NO: 8567 - DNA, 20 bp, Artificial Sequence
  sgRNA
gagcccaaacgcaacactga

SEQ ID NO: 8568 - DNA, 20 bp, Artificial Sequence
  sgRNA
tcccacttcccgctgtggat

SEQ ID NO: 8569 - DNA, 20 bp, Artificial Sequence
  sgRNA
aatcatggagtaagaagccc

SEQ ID NO: 8570 - DNA, 20 bp, Artificial Sequence
  sgRNA
tgagttgccaccatcagagg

SEQ ID NO: 8571 - DNA, 20 bp, Artificial Sequence
  sgRNA
gaccttgcgggctaccattg

SEQ ID NO: 8572 - DNA, 20 bp, Artificial Sequence
  sgRNA
tcgcccgccgccgaggagaa

SEQ ID NO: 8573 - DNA, 20 bp, Artificial Sequence
  sgRNA
ccgcctggcacgtgatcggt

SEQ ID NO: 8574 - DNA, 20 bp, Artificial Sequence
  sgRNA
ccaacatctcgtgaggtggg

SEQ ID NO: 8575 - DNA, 20 bp, Artificial Sequence
  sgRNA
ggcgtgatgattggacggca

SEQ ID NO: 8576 - DNA, 20 bp, Artificial Sequence
  sgRNA
agagtcaagaaggttggcag

SEQ ID NO: 8577 - DNA, 20 bp, Artificial Sequence
  sgRNA
agaggtgaccagatctcaag

SEQ ID NO: 8578 - DNA, 20 bp, Artificial Sequence
  sgRNA
acataggcgaccacgcatgc

SEQ ID NO: 8579 - DNA, 20 bp, Artificial Sequence
  sgRNA
ggtgggtagaagattgacag

SEQ ID NO: 8580 - DNA, 20 bp, Artificial Sequence
  sgRNA
gaggcagtatttacggtaac

SEQ ID NO: 8581 - DNA, 20 bp, Artificial Sequence
  sgRNA
tgggcggagcatccgcctcg

SEQ ID NO: 8582 - DNA, 20 bp, Artificial Sequence
  sgRNA
gtggttgattagcaaagtct

SEQ ID NO: 8583 - DNA, 20 bp, Artificial Sequence
  sgRNA
ggaactgggtgttcctcacc

SEQ ID NO: 8584 - DNA, 20 bp, Artificial Sequence
  sgRNA
tttgtcttactttgctaagt

SEQ ID NO: 8585 - DNA, 20 bp, Artificial Sequence
  sgRNA
cggcgggctctggccagacc

SEQ ID NO: 8586 - DNA, 20 bp, Artificial Sequence
  sgRNA
tagcaaactattcatttcag

SEQ ID NO: 8587 - DNA, 20 bp, Artificial Sequence
  sgRNA
tttatgagaattgagggcct

SEQ ID NO: 8588 - DNA, 20 bp, Artificial Sequence
  sgRNA
gaaagagctacaatgtgatg

SEQ ID NO: 8589 - DNA, 20 bp, Artificial Sequence
  sgRNA
gcgcttaccgcctcttatgc

SEQ ID NO: 8590 - DNA, 20 bp, Artificial Sequence
  sgRNA
cctgcgctgggaggaccgaa

SEQ ID NO: 8591 - DNA, 20 bp, Artificial Sequence
  sgRNA
gaggttgctaagaattctgc

SEQ ID NO: 8592 - DNA, 20 bp, Artificial Sequence
  sgRNA
ctgccgctcgcccaggcttt

SEQ ID NO: 8593 - DNA, 20 bp, Artificial Sequence
  sgRNA
gagggtaggaagtgccgccg

SEQ ID NO: 8594 - DNA, 20 bp, Artificial Sequence
  sgRNA
ggagtctaatagggaagggc

SEQ ID NO: 8595 - DNA, 20 bp, Artificial Sequence
  sgRNA
cgaggagcaggctgactccg

SEQ ID NO: 8596 - DNA, 20 bp, Artificial Sequence
  sgRNA
aatgtggatgggtttctgta

SEQ ID NO: 8597 - DNA, 20 bp, Artificial Sequence
  sgRNA
ggagcctgccagagttggtg

SEQ ID NO: 8598 - DNA, 20 bp, Artificial Sequence
  sgRNA
gtccctcagacttgtttgct

SEQ ID NO: 8599 - DNA, 20 bp, Artificial Sequence
  sgRNA
gctcacgctggattatgtct

SEQ ID NO: 8600 - DNA, 20 bp, Artificial Sequence
  sgRNA
gctttgtagatgggtgacat

SEQ ID NO: 8601 - DNA, 20 bp, Artificial Sequence
  sgRNA
gccattgttacgagacagcc

SEQ ID NO: 8602 - DNA, 20 bp, Artificial Sequence
  sgRNA
catcagcaccacggcggcag

SEQ ID NO: 8603 - DNA, 20 bp, Artificial Sequence
  sgRNA
cgtcggacgttctccgtgac

SEQ ID NO: 8604 - DNA, 20 bp, Artificial Sequence
  sgRNA
tcccagattggctgagaccc

SEQ ID NO: 8605 - DNA, 20 bp, Artificial Sequence
  sgRNA
gcgcgagcgggagcgggagc

SEQ ID NO: 8606 - DNA, 20 bp, Artificial Sequence
  sgRNA
aagcaatgtattagttagcc

SEQ ID NO: 8607 - DNA, 20 bp, Artificial Sequence
  sgRNA
actcgctagctacgagacgt

SEQ ID NO: 8608 - DNA, 20 bp, Artificial Sequence
  sgRNA
gtcatggcctttgacatcag

SEQ ID NO: 8609 - DNA, 20 bp, Artificial Sequence
  sgRNA
ttcctccagctaacgccaag

SEQ ID NO: 8610 - DNA, 20 bp, Artificial Sequence
  sgRNA
agatgcaacgtcatcacgcc

SEQ ID NO: 8611 - DNA, 20 bp, Artificial Sequence
  sgRNA
ggcctcctgatcagatctac

SEQ ID NO: 8612 - DNA, 20 bp, Artificial Sequence
  sgRNA
tcccaaaggctggagggact

SEQ ID NO: 8613 - DNA, 20 bp, Artificial Sequence
  sgRNA
caataaggaggagcttcccg

SEQ ID NO: 8614 - DNA, 20 bp, Artificial Sequence
  sgRNA
taggccttggtgcagatgcc

SEQ ID NO: 8615 - DNA, 20 bp, Artificial Sequence
  sgRNA
gctcgacccttgcaccgaaa

SEQ ID NO: 8616 - DNA, 20 bp, Artificial Sequence
  sgRNA
aggttaagaagatgtctcaa

SEQ ID NO: 8617 - DNA, 20 bp, Artificial Sequence
  sgRNA
tgtccgtggtgctaaatatt

SEQ ID NO: 8618 - DNA, 20 bp, Artificial Sequence
  sgRNA
gcgggaggtgacggccaatg

SEQ ID NO: 8619 - DNA, 20 bp, Artificial Sequence
  sgRNA
gctgtttgtttggcaacacc

SEQ ID NO: 8620 - DNA, 20 bp, Artificial Sequence
  sgRNA
cgcgcgtgcagcctcggagc

SEQ ID NO: 8621 - DNA, 20 bp, Artificial Sequence
  sgRNA
agtttcctgaatagtgagcg

SEQ ID NO: 8622 - DNA, 20 bp, Artificial Sequence
  sgRNA
ggaaacgtagctgtgggtga

SEQ ID NO: 8623 - DNA, 20 bp, Artificial Sequence
  sgRNA
ccgagcccagaggacgcgtc

SEQ ID NO: 8624 - DNA, 20 bp, Artificial Sequence
  sgRNA
gttcgagtgcaagcttgagc

SEQ ID NO: 8625 - DNA, 20 bp, Artificial Sequence
  sgRNA
cggatgtctgtgcgcatgct

SEQ ID NO: 8626 - DNA, 20 bp, Artificial Sequence
  sgRNA
gctctggatgttcgctcttc

SEQ ID NO: 8627 - DNA, 20 bp, Artificial Sequence
  sgRNA
agcggctctacggtccaagg

SEQ ID NO: 8628 - DNA, 20 bp, Artificial Sequence
  sgRNA
gctccttcagagcctgtagg

SEQ ID NO: 8629 - DNA, 20 bp, Artificial Sequence
  sgRNA
tgccagcaagaaagaagccc

SEQ ID NO: 8630 - DNA, 20 bp, Artificial Sequence
  sgRNA
agttgcgcaggcgcaaccgc

SEQ ID NO: 8631 - DNA, 20 bp, Artificial Sequence
  sgRNA
cgtcccatggttgcagtcag

SEQ ID NO: 8632 - DNA, 20 bp, Artificial Sequence
  sgRNA
cccgcctgtccgaggacgtc

SEQ ID NO: 8633 - DNA, 20 bp, Artificial Sequence
  sgRNA
ggcagcatctggactgcagc

SEQ ID NO: 8634 - DNA, 20 bp, Artificial Sequence
  sgRNA
cggtgcgagttcttgcgagt

SEQ ID NO: 8635 - DNA, 20 bp, Artificial Sequence
  sgRNA
atcactcttgtggtgccctg

SEQ ID NO: 8636 - DNA, 20 bp, Artificial Sequence
  sgRNA
gagcgattgtaaatgtgtga

SEQ ID NO: 8637 - DNA, 20 bp, Artificial Sequence
  sgRNA
tctgcagcacagatgtgcta

SEQ ID NO: 8638 - DNA, 20 bp, Artificial Sequence
  sgRNA
attagcctactttgcaatcc

SEQ ID NO: 8639 - DNA, 20 bp, Artificial Sequence
  sgRNA
gcagtctttcagtggattta

SEQ ID NO: 8640 - DNA, 20 bp, Artificial Sequence
  sgRNA
gtgctttgattggttgcctg

SEQ ID NO: 8641 - DNA, 20 bp, Artificial Sequence
  sgRNA
ccaccagatcctgttaagaa

SEQ ID NO: 8642 - DNA, 20 bp, Artificial Sequence
  sgRNA
ccgtcccttccctggactgc

SEQ ID NO: 8643 - DNA, 20 bp, Artificial Sequence
  sgRNA
actaagacagcgcagccgat

SEQ ID NO: 8644 - DNA, 20 bp, Artificial Sequence
  sgRNA
tcccagtactcctccaggca

SEQ ID NO: 8645 - DNA, 20 bp, Artificial Sequence
  sgRNA
atctagagcttatccatgta

SEQ ID NO: 8646 - DNA, 20 bp, Artificial Sequence
  sgRNA
gcaggatatcgagacagccc

SEQ ID NO: 8647 - DNA, 20 bp, Artificial Sequence
  sgRNA
gtgtagtcttccgcaagcgc

SEQ ID NO: 8648 - DNA, 20 bp, Artificial Sequence
  sgRNA
ttcgcccagtttcttgggag

SEQ ID NO: 8649 - DNA, 20 bp, Artificial Sequence
  sgRNA
acgaagaaacgccatacttc

SEQ ID NO: 8650 - DNA, 20 bp, Artificial Sequence
  sgRNA
ctgagcactgggcggagtca

SEQ ID NO: 8651 - DNA, 20 bp, Artificial Sequence
  sgRNA
ctgcggctcactagcttggc

SEQ ID NO: 8652 - DNA, 20 bp, Artificial Sequence
  sgRNA
tttctgatcgtgactgtccc

SEQ ID NO: 8653 - DNA, 20 bp, Artificial Sequence
  sgRNA
cctaaagctcggttaatgcc

SEQ ID NO: 8654 - DNA, 20 bp, Artificial Sequence
  sgRNA
gggtaatggttaacagcaat

SEQ ID NO: 8655 - DNA, 20 bp, Artificial Sequence
  sgRNA
ttgggttctataagaagagc

SEQ ID NO: 8656 - DNA, 20 bp, Artificial Sequence
  sgRNA
ggtgtgagtcttggagctaa

SEQ ID NO: 8657 - DNA, 20 bp, Artificial Sequence
  sgRNA
agaacgcgttgggagaaagc

SEQ ID NO: 8658 - DNA, 20 bp, Artificial Sequence
  sgRNA
acgttgctcctggaaggagg

SEQ ID NO: 8659 - DNA, 20 bp, Artificial Sequence
  sgRNA
ggctttgcggcacttccgat

SEQ ID NO: 8660 - DNA, 20 bp, Artificial Sequence
  sgRNA
aacattaacactgcgtggtc

SEQ ID NO: 8661 - DNA, 20 bp, Artificial Sequence
  sgRNA
ctgtgacctcatagagtact

SEQ ID NO: 8662 - DNA, 20 bp, Artificial Sequence
  sgRNA
cctttctaccctactcatta

SEQ ID NO: 8663 - DNA, 20 bp, Artificial Sequence
  sgRNA
gggaaacactgtctaggttc

SEQ ID NO: 8664 - DNA, 20 bp, Artificial Sequence
  sgRNA
gcagagggtaaattgatgtc

SEQ ID NO: 8665 - DNA, 20 bp, Artificial Sequence
  sgRNA
ccaggcgagaagctgcagac

SEQ ID NO: 8666 - DNA, 20 bp, Artificial Sequence
  sgRNA
gttgtttgttcctgccgtct

SEQ ID NO: 8667 - DNA, 20 bp, Artificial Sequence
  sgRNA
caatgaaccagagacctgaa

SEQ ID NO: 8668 - DNA, 20 bp, Artificial Sequence
  sgRNA
aatgctcgcatacgtggaaa

SEQ ID NO: 8669 - DNA, 20 bp, Artificial Sequence
  sgRNA
ctgagagtccatcctttccc

SEQ ID NO: 8670 - DNA, 20 bp, Artificial Sequence
  sgRNA
ttctcccgaggcgccctgtg

SEQ ID NO: 8671 - DNA, 20 bp, Artificial Sequence
  sgRNA
gccgcgctgaggcagctccg

SEQ ID NO: 8672 - DNA, 20 bp, Artificial Sequence
  sgRNA
cagcacagctgtcacacagc

SEQ ID NO: 8673 - DNA, 20 bp, Artificial Sequence
  sgRNA
aactttctctggatttgtac

SEQ ID NO: 8674 - DNA, 20 bp, Artificial Sequence
  sgRNA
gggtcaacttccgttccgag

SEQ ID NO: 8675 - DNA, 20 bp, Artificial Sequence
  sgRNA
tgggagctacagccaagaag

SEQ ID NO: 8676 - DNA, 20 bp, Artificial Sequence
  sgRNA
tctaggttgccaagcgacgc

SEQ ID NO: 8677 - DNA, 20 bp, Artificial Sequence
  sgRNA
cctcgcttgcacgctatcat

SEQ ID NO: 8678 - DNA, 20 bp, Artificial Sequence
  sgRNA
cgagctcacacgtgacggca

SEQ ID NO: 8679 - DNA, 20 bp, Artificial Sequence
  sgRNA
tctagtaggaggcaatagca

SEQ ID NO: 8680 - DNA, 20 bp, Artificial Sequence
  sgRNA
ccattcctgaagtcatgccg

SEQ ID NO: 8681 - DNA, 20 bp, Artificial Sequence
  sgRNA
tgcacgagcgagcgcgcttg

SEQ ID NO: 8682 - DNA, 20 bp, Artificial Sequence
  sgRNA
gagccgtaacctgctcttgc

SEQ ID NO: 8683 - DNA, 20 bp, Artificial Sequence
  sgRNA
gaagtgactcaactcggtta

SEQ ID NO: 8684 - DNA, 20 bp, Artificial Sequence
  sgRNA
gtgggacttctctcttgctg

SEQ ID NO: 8685 - DNA, 20 bp, Artificial Sequence
  sgRNA
gactgcagcgatactaaccc

SEQ ID NO: 8686 - DNA, 20 bp, Artificial Sequence
  sgRNA
catgcgtagtgtccattcca

SEQ ID NO: 8687 - DNA, 20 bp, Artificial Sequence
  sgRNA
actccaaagtgtaaggtact

SEQ ID NO: 8688 - DNA, 20 bp, Artificial Sequence
  sgRNA
acatcgctcacgtccgccag

SEQ ID NO: 8689 - DNA, 20 bp, Artificial Sequence
  sgRNA
gcggaagaaggtgacgtcaa

SEQ ID NO: 8690 - DNA, 20 bp, Artificial Sequence
  sgRNA
tgatccctctagatgctccc

SEQ ID NO: 8691 - DNA, 20 bp, Artificial Sequence
  sgRNA
tcgagtgagcgatctggcag

SEQ ID NO: 8692 - DNA, 20 bp, Artificial Sequence
  sgRNA
cttcagagcgcatcctccag

SEQ ID NO: 8693 - DNA, 20 bp, Artificial Sequence
  sgRNA
atctctcggagagcagcgat

SEQ ID NO: 8694 - DNA, 20 bp, Artificial Sequence
  sgRNA
agtggtttcccggaccctgc

SEQ ID NO: 8695 - DNA, 20 bp, Artificial Sequence
  sgRNA
tgtacagaccctaagatcta

SEQ ID NO: 8696 - DNA, 20 bp, Artificial Sequence
  sgRNA
tggaaacaggatcctgcaag

SEQ ID NO: 8697 - DNA, 20 bp, Artificial Sequence
  sgRNA
cgctccagcagcgtcacgtg

SEQ ID NO: 8698 - DNA, 20 bp, Artificial Sequence
  sgRNA
ggtcctgcgggttagaggcg

SEQ ID NO: 8699 - DNA, 20 bp, Artificial Sequence
  sgRNA
aggagccttagccaggtgcc

SEQ ID NO: 8700 - DNA, 20 bp, Artificial Sequence
  sgRNA
gaagcaacatttattcagta

SEQ ID NO: 8701 - DNA, 20 bp, Artificial Sequence
  sgRNA
ggacaggaagtgccttgcgc

SEQ ID NO: 8702 - DNA, 20 bp, Artificial Sequence
  sgRNA
ggcagcgccagtctctgcgg

SEQ ID NO: 8703 - DNA, 20 bp, Artificial Sequence
  sgRNA
ccctgagaggctcggagcgg

SEQ ID NO: 8704 - DNA, 20 bp, Artificial Sequence
  sgRNA
gagaggtgtgaacgaggtgt

SEQ ID NO: 8705 - DNA, 20 bp, Artificial Sequence
  sgRNA
atgagcaagccacagtcctg

SEQ ID NO: 8706 - DNA, 20 bp, Artificial Sequence
  sgRNA
ctggatagcattcttggttt

SEQ ID NO: 8707 - DNA, 20 bp, Artificial Sequence
  sgRNA
tcagtatgtgtcaccaaagg

SEQ ID NO: 8708 - DNA, 20 bp, Artificial Sequence
  sgRNA
aacgcctcgcttaaagtaac

SEQ ID NO: 8709 - DNA, 20 bp, Artificial Sequence
  sgRNA
agctgtttatcaactgcacc

SEQ ID NO: 8710 - DNA, 20 bp, Artificial Sequence
  sgRNA
ttctggaaacagcctataca

SEQ ID NO: 8711 - DNA, 20 bp, Artificial Sequence
  sgRNA
tgccctggtgcagggtcatc

SEQ ID NO: 8712 - DNA, 20 bp, Artificial Sequence
  sgRNA
gccctcctgcggagcgatct

SEQ ID NO: 8713 - DNA, 20 bp, Artificial Sequence
  sgRNA
gctaatttccgcgggtacat

SEQ ID NO: 8714 - DNA, 20 bp, Artificial Sequence
  sgRNA
gggtgacaggagcccgacgt

SEQ ID NO: 8715 - DNA, 20 bp, Artificial Sequence
  sgRNA
cttaacctcgtgtttgcacg

SEQ ID NO: 8716 - DNA, 20 bp, Artificial Sequence
  sgRNA
actgtgtgtgatgtctgcca

SEQ ID NO: 8717 - DNA, 20 bp, Artificial Sequence
  sgRNA
tgtagtccacggacgcttgt

SEQ ID NO: 8718 - DNA, 20 bp, Artificial Sequence
  sgRNA
caagagcctccctatcctcc

SEQ ID NO: 8719 - DNA, 20 bp, Artificial Sequence
  sgRNA
attaccatgtattagcatac

SEQ ID NO: 8720 - DNA, 20 bp, Artificial Sequence
  sgRNA
caggaggagagagcgacgtg

SEQ ID NO: 8721 - DNA, 20 bp, Artificial Sequence
  sgRNA
tgagagcctgcccaccgctc

SEQ ID NO: 8722 - DNA, 20 bp, Artificial Sequence
  sgRNA
cactaaccctgagccaagag

SEQ ID NO: 8723 - DNA, 20 bp, Artificial Sequence
  sgRNA
gcacaaaggagaaatcatac

SEQ ID NO: 8724 - DNA, 20 bp, Artificial Sequence
  sgRNA
ttctagaaacttggattcca

SEQ ID NO: 8725 - DNA, 20 bp, Artificial Sequence
  sgRNA
taaagtggtatttgtgaaag

SEQ ID NO: 8726 - DNA, 20 bp, Artificial Sequence
  sgRNA
atcggcatattgaggatgag

SEQ ID NO: 8727 - DNA, 20 bp, Artificial Sequence
  sgRNA
gatgttgcaggttagtggaa

SEQ ID NO: 8728 - DNA, 20 bp, Artificial Sequence
  sgRNA
gaagccgcggtgccaaatta

SEQ ID NO: 8729 - DNA, 20 bp, Artificial Sequence
  sgRNA
ttgagttacaggaaggaccg

SEQ ID NO: 8730 - DNA, 20 bp, Artificial Sequence
  sgRNA
acaacccagacttacagacc

SEQ ID NO: 8731 - DNA, 20 bp, Artificial Sequence
  sgRNA
catgcgtacttcaagagccc

SEQ ID NO: 8732 - DNA, 20 bp, Artificial Sequence
  sgRNA
gctcgggttgccctgacaac

SEQ ID NO: 8733 - DNA, 20 bp, Artificial Sequence
  sgRNA
aagcaggcagccctagtgtc

SEQ ID NO: 8734 - DNA, 20 bp, Artificial Sequence
  sgRNA
cttaaagctcttcccaagct

SEQ ID NO: 8735 - DNA, 20 bp, Artificial Sequence
  sgRNA
taggtgaatgccaccattcc

SEQ ID NO: 8736 - DNA, 20 bp, Artificial Sequence
  sgRNA
ccggactgctggagctggac

SEQ ID NO: 8737 - DNA, 20 bp, Artificial Sequence
  sgRNA
gcagggaggaggatactgcc

SEQ ID NO: 8738 - DNA, 20 bp, Artificial Sequence
  sgRNA
tggccatcctggtggaggtg

SEQ ID NO: 8739 - DNA, 20 bp, Artificial Sequence
  sgRNA
gggaaccgggtacggagagg

SEQ ID NO: 8740 - DNA, 20 bp, Artificial Sequence
  sgRNA
aagagcaggcattaggagtc

SEQ ID NO: 8741 - DNA, 20 bp, Artificial Sequence
  sgRNA
agacatgctgaataacaaag

SEQ ID NO: 8742 - DNA, 20 bp, Artificial Sequence
  sgRNA
ctgagacaaccttactgcgc

SEQ ID NO: 8743 - DNA, 20 bp, Artificial Sequence
  sgRNA
gaggcgcttctagcgacacg

SEQ ID NO: 8744 - DNA, 20 bp, Artificial Sequence
  sgRNA
cagagattcaaagctaacct

SEQ ID NO: 8745 - DNA, 20 bp, Artificial Sequence
  sgRNA
cgagccttccggaggacgcg

SEQ ID NO: 8746 - DNA, 20 bp, Artificial Sequence
  sgRNA
ggctccactttggcgcctga

SEQ ID NO: 8747 - DNA, 20 bp, Artificial Sequence
  sgRNA
tggccgcggatccattgcac

SEQ ID NO: 8748 - DNA, 20 bp, Artificial Sequence
  sgRNA
gtgtgttcctattggtcagg

SEQ ID NO: 8749 - DNA, 20 bp, Artificial Sequence
  sgRNA
gaactgatggacaccgagtg

SEQ ID NO: 8750 - DNA, 20 bp, Artificial Sequence
  sgRNA
tactgtagatataacaccac

SEQ ID NO: 8751 - DNA, 20 bp, Artificial Sequence
  sgRNA
gttctcgtggcgcactgagc

SEQ ID NO: 8752 - DNA, 20 bp, Artificial Sequence
  sgRNA
gcactctggaagccatgact

SEQ ID NO: 8753 - DNA, 20 bp, Artificial Sequence
  sgRNA
actgcaaactgacgccgacg

SEQ ID NO: 8754 - DNA, 20 bp, Artificial Sequence
  sgRNA
acgtcgacgtccgcacgctg

SEQ ID NO: 8755 - DNA, 20 bp, Artificial Sequence
  sgRNA
gactctcaaattaagtgggc

SEQ ID NO: 8756 - DNA, 20 bp, Artificial Sequence
  sgRNA
gggcggtggagctttaggag

SEQ ID NO: 8757 - DNA, 20 bp, Artificial Sequence
  sgRNA
gagacttgtttgtctgggcc

SEQ ID NO: 8758 - DNA, 20 bp, Artificial Sequence
  sgRNA
gggacagggaggcctcccgg

SEQ ID NO: 8759 - DNA, 20 bp, Artificial Sequence
  sgRNA
gtcgctacaaacttcgccga

SEQ ID NO: 8760 - DNA, 20 bp, Artificial Sequence
  sgRNA
cgactctcgagcgtctccat

SEQ ID NO: 8761 - DNA, 20 bp, Artificial Sequence
  sgRNA
gagacccttagtcatggtgg

SEQ ID NO: 8762 - DNA, 20 bp, Artificial Sequence
  sgRNA
aactcatatgggttggaggg

SEQ ID NO: 8763 - DNA, 20 bp, Artificial Sequence
  sgRNA
acgcgccctttgaaactcag

SEQ ID NO: 8764 - DNA, 20 bp, Artificial Sequence
  sgRNA
taatcactagggtatgtctt

SEQ ID NO: 8765 - DNA, 20 bp, Artificial Sequence
  sgRNA
ggtgagggcaggaaatcatc

SEQ ID NO: 8766 - DNA, 20 bp, Artificial Sequence
  sgRNA
aactgggcagcctagcagag

SEQ ID NO: 8767 - DNA, 20 bp, Artificial Sequence
  sgRNA
atggacacaacggcagggcg

SEQ ID NO: 8768 - DNA, 20 bp, Artificial Sequence
  sgRNA
cggaacttaatagacaccaa

SEQ ID NO: 8769 - DNA, 20 bp, Artificial Sequence
  sgRNA
tcatttctatgctagggctt

SEQ ID NO: 8770 - DNA, 20 bp, Artificial Sequence
  sgRNA
agattgaatctcagagttta

SEQ ID NO: 8771 - DNA, 20 bp, Artificial Sequence
  sgRNA
ctggccatgtggctgtataa

SEQ ID NO: 8772 - DNA, 20 bp, Artificial Sequence
  sgRNA
tcggagagcaagcattctgc

SEQ ID NO: 8773 - DNA, 20 bp, Artificial Sequence
  sgRNA
gccttgcacgccgcccattc

SEQ ID NO: 8774 - DNA, 20 bp, Artificial Sequence
  sgRNA
ggagctgcggctaagcgcgc

SEQ ID NO: 8775 - DNA, 20 bp, Artificial Sequence
  sgRNA
ggctatcagccgggtaggac

SEQ ID NO: 8776 - DNA, 20 bp, Artificial Sequence
  sgRNA
ggctgctgagcccacgtcag

SEQ ID NO: 8777 - DNA, 20 bp, Artificial Sequence
  sgRNA
tatcccagagtgctcgagtc

SEQ ID NO: 8778 - DNA, 20 bp, Artificial Sequence
  sgRNA
ctgcagtcttagcagctata

SEQ ID NO: 8779 - DNA, 20 bp, Artificial Sequence
  sgRNA
ctgactcaactccacgaaca

SEQ ID NO: 8780 - DNA, 20 bp, Artificial Sequence
  sgRNA
ataaattaatgctcctgcgc

SEQ ID NO: 8781 - DNA, 20 bp, Artificial Sequence
  sgRNA
cagtgggcgtggctaggcgt

SEQ ID NO: 8782 - DNA, 20 bp, Artificial Sequence
  sgRNA
aattgctaacaatcagatag

SEQ ID NO: 8783 - DNA, 20 bp, Artificial Sequence
  sgRNA
cggaggctgagcgatcgctg

SEQ ID NO: 8784 - DNA, 20 bp, Artificial Sequence
  sgRNA
aagtggcttgttcatgcaca

SEQ ID NO: 8785 - DNA, 20 bp, Artificial Sequence
  sgRNA
aagcaaagatgagcatctgc

SEQ ID NO: 8786 - DNA, 20 bp, Artificial Sequence
  sgRNA
atgccgtgtcctctgaacgg

SEQ ID NO: 8787 - DNA, 20 bp, Artificial Sequence
  sgRNA
cgctagaggctgcttgttcc

SEQ ID NO: 8788 - DNA, 20 bp, Artificial Sequence
  sgRNA
agagctgcaagtcgattgtc

SEQ ID NO: 8789 - DNA, 20 bp, Artificial Sequence
  sgRNA
gagacacaggtcctgcggac

SEQ ID NO: 8790 - DNA, 20 bp, Artificial Sequence
  sgRNA
aactcgtctaagttcacgaa

SEQ ID NO: 8791 - DNA, 20 bp, Artificial Sequence
  sgRNA
agagcattctcacatggccc

SEQ ID NO: 8792 - DNA, 20 bp, Artificial Sequence
  sgRNA
cccactgaagggctcgggag

SEQ ID NO: 8793 - DNA, 20 bp, Artificial Sequence
  sgRNA
gactggtgagacccgcctcc

SEQ ID NO: 8794 - DNA, 20 bp, Artificial Sequence
  sgRNA
attgtcacctaggcgtcctt

SEQ ID NO: 8795 - DNA, 20 bp, Artificial Sequence
  sgRNA
caggcgcgggtgctgatgtc

SEQ ID NO: 8796 - DNA, 20 bp, Artificial Sequence
  sgRNA
ggccaggagcaccggcggca

SEQ ID NO: 8797 - DNA, 20 bp, Artificial Sequence
  sgRNA
aattgcctcagtgatgccac

SEQ ID NO: 8798 - DNA, 20 bp, Artificial Sequence
  sgRNA
tagcgccagcaaagcactgc

SEQ ID NO: 8799 - DNA, 20 bp, Artificial Sequence
  sgRNA
cctgaaactaaggatttaga

SEQ ID NO: 8800 - DNA, 20 bp, Artificial Sequence
  sgRNA
agctgcgcgcagtgccctcg

SEQ ID NO: 8801 - DNA, 20 bp, Artificial Sequence
  sgRNA
taaactcttccctacttcgc

SEQ ID NO: 8802 - DNA, 20 bp, Artificial Sequence
  sgRNA
caatactaaagaaagcatcc

SEQ ID NO: 8803 - DNA, 20 bp, Artificial Sequence
  sgRNA
ttgacagcgagagcgcctcc

SEQ ID NO: 8804 - DNA, 20 bp, Artificial Sequence
  sgRNA
ggccgcattgaggctgcgct

SEQ ID NO: 8805 - DNA, 20 bp, Artificial Sequence
  sgRNA
ctgaacgctcgctttatcag

SEQ ID NO: 8806 - DNA, 20 bp, Artificial Sequence
  sgRNA
tctcgaggctcacgccctcg

SEQ ID NO: 8807 - DNA, 20 bp, Artificial Sequence
  sgRNA
gtcatagaggactcagtcct

SEQ ID NO: 8808 - DNA, 20 bp, Artificial Sequence
  sgRNA
ttaaacacttaggcctaacg

SEQ ID NO: 8809 - DNA, 20 bp, Artificial Sequence
  sgRNA
cctggagggcgtcctggcgg

SEQ ID NO: 8810 - DNA, 20 bp, Artificial Sequence
  sgRNA
agggaataaaggcactagtg

SEQ ID NO: 8811 - DNA, 20 bp, Artificial Sequence
  sgRNA
cctagaaatctcccacaccc

SEQ ID NO: 8812 - DNA, 20 bp, Artificial Sequence
  sgRNA
tcaccgtcctctagggactc

SEQ ID NO: 8813 - DNA, 20 bp, Artificial Sequence
  sgRNA
gggctgtgcagcctctagcg

SEQ ID NO: 8814 - DNA, 20 bp, Artificial Sequence
  sgRNA
atagggcttgattctcatcc

SEQ ID NO: 8815 - DNA, 20 bp, Artificial Sequence
  sgRNA
atcaaaccagcccgctctat

SEQ ID NO: 8816 - DNA, 20 bp, Artificial Sequence
  sgRNA
cacgacttccgctcacgacg

SEQ ID NO: 8817 - DNA, 20 bp, Artificial Sequence
  sgRNA
ctgcccgcgaagcgaccgcc

SEQ ID NO: 8818 - DNA, 20 bp, Artificial Sequence
  sgRNA
ggcggctccgcataaccacg

SEQ ID NO: 8819 - DNA, 20 bp, Artificial Sequence
  sgRNA
cgggaaagttggttccactc

SEQ ID NO: 8820 - DNA, 20 bp, Artificial Sequence
  sgRNA
tgcgcatgcgcggaagtcga

SEQ ID NO: 8821 - DNA, 20 bp, Artificial Sequence
  sgRNA
gtttgggtgtcaccggctgc

SEQ ID NO: 8822 - DNA, 20 bp, Artificial Sequence
  sgRNA
aggcgcccggacaggcatcg

SEQ ID NO: 8823 - DNA, 20 bp, Artificial Sequence
  sgRNA
tggacgctaactacgactcc

SEQ ID NO: 8824 - DNA, 20 bp, Artificial Sequence
  sgRNA
gctggaggcgggacgacgac

SEQ ID NO: 8825 - DNA, 20 bp, Artificial Sequence
  sgRNA
acggagggtggcgcattgaa

SEQ ID NO: 8826 - DNA, 20 bp, Artificial Sequence
  sgRNA
tccaaagcaagatccagata

SEQ ID NO: 8827 - DNA, 20 bp, Artificial Sequence
  sgRNA
gcaagctctttagctgtacg

SEQ ID NO: 8828 - DNA, 20 bp, Artificial Sequence
  sgRNA
aaccttctctgccttagtca

SEQ ID NO: 8829 - DNA, 20 bp, Artificial Sequence
  sgRNA
gggcccagccctttcccgac

SEQ ID NO: 8830 - DNA, 20 bp, Artificial Sequence
  sgRNA
tgttgacataaacgcaggac

SEQ ID NO: 8831 - DNA, 20 bp, Artificial Sequence
  sgRNA
gctagacagttgccttcttt

SEQ ID NO: 8832 - DNA, 20 bp, Artificial Sequence
  sgRNA
agttctagttgcccaactat

SEQ ID NO: 8833 - DNA, 20 bp, Artificial Sequence
  sgRNA
cgggaccctcggcacccatt

SEQ ID NO: 8834 - DNA, 20 bp, Artificial Sequence
  sgRNA
tagggctatttctgccaggc

SEQ ID NO: 8835 - DNA, 20 bp, Artificial Sequence
  sgRNA
tgcgcgagacacaggtcctg

SEQ ID NO: 8836 - DNA, 20 bp, Artificial Sequence
  sgRNA
ggtctagggagaacctgaag

SEQ ID NO: 8837 - DNA, 20 bp, Artificial Sequence
  sgRNA
aaaggagctctggaccacta

SEQ ID NO: 8838 - DNA, 20 bp, Artificial Sequence
  sgRNA
ggaatcctctgcttccgttt

SEQ ID NO: 8839 - DNA, 20 bp, Artificial Sequence
  sgRNA
tctagagcccttgccgggcg

SEQ ID NO: 8840 - DNA, 20 bp, Artificial Sequence
  sgRNA
tgccaaactccagaaatacc

SEQ ID NO: 8841 - DNA, 20 bp, Artificial Sequence
  sgRNA
ctcgttctgaacagcagtat

SEQ ID NO: 8842 - DNA, 20 bp, Artificial Sequence
  sgRNA
atagagtttggttacttgaa

SEQ ID NO: 8843 - DNA, 20 bp, Artificial Sequence
  sgRNA
agactaccaccgtagacaag

SEQ ID NO: 8844 - DNA, 20 bp, Artificial Sequence
  sgRNA
gcgccgctgcccttgtagcc

SEQ ID NO: 8845 - DNA, 20 bp, Artificial Sequence
  sgRNA
tcactttgagaagagagata

SEQ ID NO: 8846 - DNA, 20 bp, Artificial Sequence
  sgRNA
tgcgcatgttccacccgctc

SEQ ID NO: 8847 - DNA, 20 bp, Artificial Sequence
  sgRNA
gaacccgcggagcctccggt

SEQ ID NO: 8848 - DNA, 20 bp, Artificial Sequence
  sgRNA
gaggtgtttctgccttccac

SEQ ID NO: 8849 - DNA, 20 bp, Artificial Sequence
  sgRNA
gcaagtcacagagcacaaca

SEQ ID NO: 8850 - DNA, 20 bp, Artificial Sequence
  sgRNA
tattgtcctcctccgagaca

SEQ ID NO: 8851 - DNA, 20 bp, Artificial Sequence
  sgRNA
ggcaagaggcagagcattgt

SEQ ID NO: 8852 - DNA, 20 bp, Artificial Sequence
  sgRNA
aaactgaccaatagaagaag

SEQ ID NO: 8853 - DNA, 20 bp, Artificial Sequence
  sgRNA
gaagcctgagagcgaggctg

SEQ ID NO: 8854 - DNA, 20 bp, Artificial Sequence
  sgRNA
gcaatcggctcgtgtctctc

SEQ ID NO: 8855 - DNA, 20 bp, Artificial Sequence
  sgRNA
gccaaatgcttgatctctga

SEQ ID NO: 8856 - DNA, 20 bp, Artificial Sequence
  sgRNA
gcgttggtatattcctatac

SEQ ID NO: 8857 - DNA, 20 bp, Artificial Sequence
  sgRNA
agaggtcaaagggcgttgag

SEQ ID NO: 8858 - DNA, 20 bp, Artificial Sequence
  sgRNA
gtagagctggctggagtcca

SEQ ID NO: 8859 - DNA, 20 bp, Artificial Sequence
  sgRNA
agttctcagtatttacatac

SEQ ID NO: 8860 - DNA, 20 bp, Artificial Sequence
  sgRNA
tacactaaacccatacctcc

SEQ ID NO: 8861 - DNA, 20 bp, Artificial Sequence
  sgRNA
ggagccaaacatggcgtcta

SEQ ID NO: 8862 - DNA, 20 bp, Artificial Sequence
  sgRNA
agcggtgactgagagaaggg

SEQ ID NO: 8863 - DNA, 20 bp, Artificial Sequence
  sgRNA
tgcgcagagccagcacaaat

SEQ ID NO: 8864 - DNA, 20 bp, Artificial Sequence
  sgRNA
cctttcgggcttcggtggag

SEQ ID NO: 8865 - DNA, 20 bp, Artificial Sequence
  sgRNA
agtatgcaaaggatagtgat

SEQ ID NO: 8866 - DNA, 20 bp, Artificial Sequence
  sgRNA
cctaggccactaccgcgaaa

SEQ ID NO: 8867 - DNA, 20 bp, Artificial Sequence
  sgRNA
tttcggttctactcctgcag

SEQ ID NO: 8868 - DNA, 20 bp, Artificial Sequence
  sgRNA
acctcccttggatctcgccc

SEQ ID NO: 8869 - DNA, 20 bp, Artificial Sequence
  sgRNA
catcactaccagcaggcgga

SEQ ID NO: 8870 - DNA, 20 bp, Artificial Sequence
  sgRNA
cttcgttggcgcggcggccc

SEQ ID NO: 8871 - DNA, 20 bp, Artificial Sequence
  sgRNA
agagacagggacaggacgtg

SEQ ID NO: 8872 - DNA, 20 bp, Artificial Sequence
  sgRNA
tacgcatgtgcctcccagct

SEQ ID NO: 8873 - DNA, 20 bp, Artificial Sequence
  sgRNA
gagaggagatggatgtccct

SEQ ID NO: 8874 - DNA, 20 bp, Artificial Sequence
  sgRNA
agcacaatctgggcgggtcc

SEQ ID NO: 8875 - DNA, 20 bp, Artificial Sequence
  sgRNA
ggtaccggaacaaatcttgc

SEQ ID NO: 8876 - DNA, 20 bp, Artificial Sequence
  sgRNA
ggtgtccatgcaggtgggcg

SEQ ID NO: 8877 - DNA, 20 bp, Artificial Sequence
  sgRNA
atgccctctctgacctcctg

SEQ ID NO: 8878 - DNA, 20 bp, Artificial Sequence
  sgRNA
ggtgggctggctctgcgacc

SEQ ID NO: 8879 - DNA, 20 bp, Artificial Sequence
  sgRNA
cttgggctccagcaccacaa

SEQ ID NO: 8880 - DNA, 20 bp, Artificial Sequence
  sgRNA
ggttcgctctgtttaagtct

SEQ ID NO: 8881 - DNA, 20 bp, Artificial Sequence
  sgRNA
gcctctcagaggacctggca

SEQ ID NO: 8882 - DNA, 20 bp, Artificial Sequence
  sgRNA
ggaaggaacgggagaactag

SEQ ID NO: 8883 - DNA, 20 bp, Artificial Sequence
  sgRNA
attgctcaggttatgacacc

SEQ ID NO: 8884 - DNA, 20 bp, Artificial Sequence
  sgRNA
gagtgggatgcaaagcctct

SEQ ID NO: 8885 - DNA, 20 bp, Artificial Sequence
  sgRNA
tttctctgggtcgggtagga

SEQ ID NO: 8886 - DNA, 20 bp, Artificial Sequence
  sgRNA
gtttgcagagccggcgggac

SEQ ID NO: 8887 - DNA, 20 bp, Artificial Sequence
  sgRNA
gcgagggaggatcaagaaga

SEQ ID NO: 8888 - DNA, 20 bp, Artificial Sequence
  sgRNA
gagcgctcgaggagaagtca

SEQ ID NO: 8889 - DNA, 20 bp, Artificial Sequence
  sgRNA
ggcctgttcggagggagtgg

SEQ ID NO: 8890 - DNA, 20 bp, Artificial Sequence
  sgRNA
gggtccggaaccggtttggg

SEQ ID NO: 8891 - DNA, 20 bp, Artificial Sequence
  sgRNA
gcagagcagcttctcctatg

SEQ ID NO: 8892 - DNA, 20 bp, Artificial Sequence
  sgRNA
tccggagcaggaccgacttt

SEQ ID NO: 8893 - DNA, 20 bp, Artificial Sequence
  sgRNA
tcgtcagagcctgagttccc

SEQ ID NO: 8894 - DNA, 20 bp, Artificial Sequence
  sgRNA
cggtgattctcctcagcgct

SEQ ID NO: 8895 - DNA, 20 bp, Artificial Sequence
  sgRNA
ggcggagtttagggaagcag

SEQ ID NO: 8896 - DNA, 20 bp, Artificial Sequence
  sgRNA
gcgaggactgcgcgctaccc

SEQ ID NO: 8897 - DNA, 20 bp, Artificial Sequence
  sgRNA
gggacccgggcggcgtgggc

SEQ ID NO: 8898 - DNA, 20 bp, Artificial Sequence
  sgRNA
tttagggtggagatagaact

SEQ ID NO: 8899 - DNA, 20 bp, Artificial Sequence
  sgRNA
aagacccgacattcctcttc

SEQ ID NO: 8900 - DNA, 20 bp, Artificial Sequence
  sgRNA
agacagaattcgagggcacg

SEQ ID NO: 8901 - DNA, 20 bp, Artificial Sequence
  sgRNA
gactcttccagagctgctga

SEQ ID NO: 8902 - DNA, 20 bp, Artificial Sequence
  sgRNA
atcacgtgatccatagtggg

SEQ ID NO: 8903 - DNA, 20 bp, Artificial Sequence
  sgRNA
ttgatcctggaaggcaatcc

SEQ ID NO: 8904 - DNA, 20 bp, Artificial Sequence
  sgRNA
cgtcagaggaaatagaggcg

SEQ ID NO: 8905 - DNA, 20 bp, Artificial Sequence
  sgRNA
ggatactctccgctgatcca

SEQ ID NO: 8906 - DNA, 20 bp, Artificial Sequence
  sgRNA
cccgtttggccaatgacaat

SEQ ID NO: 8907 - DNA, 20 bp, Artificial Sequence
  sgRNA
aagtcagagcctggaaggat

SEQ ID NO: 8908 - DNA, 20 bp, Artificial Sequence
  sgRNA
tgcgcccagaggcgctacgg

SEQ ID NO: 8909 - DNA, 20 bp, Artificial Sequence
  sgRNA
gaggcagtctccagggaagt

SEQ ID NO: 8910 - DNA, 20 bp, Artificial Sequence
  sgRNA
gatgaggcagcccgtccact

SEQ ID NO: 8911 - DNA, 20 bp, Artificial Sequence
  sgRNA
aggaatcggttggcgggcaa

SEQ ID NO: 8912 - DNA, 20 bp, Artificial Sequence
  sgRNA
atctggttctgttactctgc

SEQ ID NO: 8913 - DNA, 20 bp, Artificial Sequence
  sgRNA
tgggctcagataaggaggcg

SEQ ID NO: 8914 - DNA, 20 bp, Artificial Sequence
  sgRNA
gaggcagtggagggttatcc

SEQ ID NO: 8915 - DNA, 20 bp, Artificial Sequence
  sgRNA
agagctgtccagaaatacgc

SEQ ID NO: 8916 - DNA, 20 bp, Artificial Sequence
  sgRNA
attgccaaccacagctcatc

SEQ ID NO: 8917 - DNA, 20 bp, Artificial Sequence
  sgRNA
ctgggtttctctctgagtta

SEQ ID NO: 8918 - DNA, 20 bp, Artificial Sequence
  sgRNA
gagatcaggaaattctgcgt

SEQ ID NO: 8919 - DNA, 20 bp, Artificial Sequence
  sgRNA
ggcttagtggctagggttgg

SEQ ID NO: 8920 - DNA, 20 bp, Artificial Sequence
  sgRNA
agataggcaagaagccatac

SEQ ID NO: 8921 - DNA, 20 bp, Artificial Sequence
  sgRNA
gggtcagaggtccgggtggc

SEQ ID NO: 8922 - DNA, 20 bp, Artificial Sequence
  sgRNA
gggtctgtttactcctataa

SEQ ID NO: 8923 - DNA, 20 bp, Artificial Sequence
  sgRNA
gctgtacaactggtgccaag

SEQ ID NO: 8924 - DNA, 20 bp, Artificial Sequence
  sgRNA
agaaagtacttggaggaaga

SEQ ID NO: 8925 - DNA, 20 bp, Artificial Sequence
  sgRNA
gcagctagaagcaaagcctc

SEQ ID NO: 8926 - DNA, 20 bp, Artificial Sequence
  sgRNA
caattaacgctaggattcat

SEQ ID NO: 8927 - DNA, 20 bp, Artificial Sequence
  sgRNA
cgcaaatagaaggacacgga

SEQ ID NO: 8928 - DNA, 20 bp, Artificial Sequence
  sgRNA
aagaaccaagtattcagcca

SEQ ID NO: 8929 - DNA, 20 bp, Artificial Sequence
  sgRNA
tgagagagagagagagagag

SEQ ID NO: 8930 - DNA, 20 bp, Artificial Sequence
  sgRNA
agaaccatctgtggctcctg

SEQ ID NO: 8931 - DNA, 20 bp, Artificial Sequence
  sgRNA
ccctatcagcttgtgtgcaa

SEQ ID NO: 8932 - DNA, 20 bp, Artificial Sequence
  sgRNA
atttcttctttggttctttg

SEQ ID NO: 8933 - DNA, 20 bp, Artificial Sequence
  sgRNA
ctggagtaaggcagtgggca

SEQ ID NO: 8934 - DNA, 20 bp, Artificial Sequence
  sgRNA
aactgctgccctcacccagc

SEQ ID NO: 8935 - DNA, 20 bp, Artificial Sequence
  sgRNA
aatcacgctcatcgacctat

SEQ ID NO: 8936 - DNA, 20 bp, Artificial Sequence
  sgRNA
caacccgtgtagctcttgac

SEQ ID NO: 8937 - DNA, 20 bp, Artificial Sequence
  sgRNA
gtgtgggcgtctcttcgccg

SEQ ID NO: 8938 - DNA, 20 bp, Artificial Sequence
  sgRNA
ccgcgagctgccgcgaactc

SEQ ID NO: 8939 - DNA, 20 bp, Artificial Sequence
  sgRNA
cggacctgtggaccggatca

SEQ ID NO: 8940 - DNA, 20 bp, Artificial Sequence
  sgRNA
gtgaggtgcgcgaggcatgc

SEQ ID NO: 8941 - DNA, 20 bp, Artificial Sequence
  sgRNA
tctcttcctgccagcactgc

SEQ ID NO: 8942 - DNA, 20 bp, Artificial Sequence
  sgRNA
cgagccttatgccctggaga

SEQ ID NO: 8943 - DNA, 20 bp, Artificial Sequence
  sgRNA
gaattctattaggcacactc

SEQ ID NO: 8944 - DNA, 20 bp, Artificial Sequence
  sgRNA
taggtaacaacataatcatc

SEQ ID NO: 8945 - DNA, 20 bp, Artificial Sequence
  sgRNA
agctcgcagactatgagctg

SEQ ID NO: 8946 - DNA, 20 bp, Artificial Sequence
  sgRNA
gtatctgacaggaacctgag

SEQ ID NO: 8947 - DNA, 20 bp, Artificial Sequence
  sgRNA
gggcccgccgactttgaaag

SEQ ID NO: 8948 - DNA, 20 bp, Artificial Sequence
  sgRNA
tgccaaactcctcaggtctg

SEQ ID NO: 8949 - DNA, 20 bp, Artificial Sequence
  sgRNA
ctcaattggtcccgcctgtc

SEQ ID NO: 8950 - DNA, 20 bp, Artificial Sequence
  sgRNA
ggcgggaactggtcggagaa

SEQ ID NO: 8951 - DNA, 20 bp, Artificial Sequence
  sgRNA
agcttcggacacgtgactcg

SEQ ID NO: 8952 - DNA, 20 bp, Artificial Sequence
  sgRNA
ctatgatcggcagcgggatg

SEQ ID NO: 8953 - DNA, 20 bp, Artificial Sequence
  sgRNA
ggcttgtgtcaccgtcgccc

SEQ ID NO: 8954 - DNA, 20 bp, Artificial Sequence
  sgRNA
gggcacagctgtaacaatgg

SEQ ID NO: 8955 - DNA, 20 bp, Artificial Sequence
  sgRNA
cccgataggtagaccctccc

SEQ ID NO: 8956 - DNA, 20 bp, Artificial Sequence
  sgRNA
aagtggaatcccaaagagca

SEQ ID NO: 8957 - DNA, 20 bp, Artificial Sequence
  sgRNA
cttgcaaggaccacgaggag

SEQ ID NO: 8958 - DNA, 20 bp, Artificial Sequence
  sgRNA
tctgagaggctcgtctcctc

SEQ ID NO: 8959 - DNA, 20 bp, Artificial Sequence
  sgRNA
taaagtcccggcgctgcccg

SEQ ID NO: 8960 - DNA, 20 bp, Artificial Sequence
  sgRNA
acagaacacaaccaacccaa

SEQ ID NO: 8961 - DNA, 20 bp, Artificial Sequence
  sgRNA
gtcgtgtcgtgtcgcggcgc

SEQ ID NO: 8962 - DNA, 20 bp, Artificial Sequence
  sgRNA
ccagcggactttggatctgg

SEQ ID NO: 8963 - DNA, 20 bp, Artificial Sequence
  sgRNA
gaagggtcttctgccaccga

SEQ ID NO: 8964 - DNA, 20 bp, Artificial Sequence
  sgRNA
ctggccgctctcccagtgcc

SEQ ID NO: 8965 - DNA, 20 bp, Artificial Sequence
  sgRNA
gtgtgagtcacgggcgtgag

SEQ ID NO: 8966 - DNA, 20 bp, Artificial Sequence
  sgRNA
tttctggctgcagtgagtgg

SEQ ID NO: 8967 - DNA, 20 bp, Artificial Sequence
  sgRNA
gctcagccctcggaagccct

SEQ ID NO: 8968 - DNA, 20 bp, Artificial Sequence
  sgRNA
gtgtccttcagtgggtaaag

SEQ ID NO: 8969 - DNA, 20 bp, Artificial Sequence
  sgRNA
tcagctggcaaccatgagaa

SEQ ID NO: 8970 - DNA, 20 bp, Artificial Sequence
  sgRNA
cgaggagttacagctggagc

SEQ ID NO: 8971 - DNA, 20 bp, Artificial Sequence
  sgRNA
ttcttctaggcagacaaacg

SEQ ID NO: 8972 - DNA, 20 bp, Artificial Sequence
  sgRNA
cttgtcgccgaatctgggag

SEQ ID NO: 8973 - DNA, 20 bp, Artificial Sequence
  sgRNA
catttccacttggcctgtga

SEQ ID NO: 8974 - DNA, 20 bp, Artificial Sequence
  sgRNA
gctggacggccatttataag

SEQ ID NO: 8975 - DNA, 20 bp, Artificial Sequence
  sgRNA
gaacaaaggactggagttgg

SEQ ID NO: 8976 - DNA, 20 bp, Artificial Sequence
  sgRNA
gtgaagtctgacctcacagg

SEQ ID NO: 8977 - DNA, 20 bp, Artificial Sequence
  sgRNA
tgtgcgcatgagattagagg

SEQ ID NO: 8978 - DNA, 20 bp, Artificial Sequence
  sgRNA
aattagacttgtcatacagg

SEQ ID NO: 8979 - DNA, 20 bp, Artificial Sequence
  sgRNA
gggtggacccgtgacctgag

SEQ ID NO: 8980 - DNA, 20 bp, Artificial Sequence
  sgRNA
cgggttgtgcgtctctctcc

SEQ ID NO: 8981 - DNA, 20 bp, Artificial Sequence
  sgRNA
tccgcgtgggccggatggcg

SEQ ID NO: 8982 - DNA, 20 bp, Artificial Sequence
  sgRNA
gggtttaaactcacctcctc

SEQ ID NO: 8983 - DNA, 20 bp, Artificial Sequence
  sgRNA
tgcagctataaatatcagag

SEQ ID NO: 8984 - DNA, 20 bp, Artificial Sequence
  sgRNA
gaacagatactatcggcaaa

SEQ ID NO: 8985 - DNA, 20 bp, Artificial Sequence
  sgRNA
ggaagtgactacagagtcta

SEQ ID NO: 8986 - DNA, 20 bp, Artificial Sequence
  sgRNA
tttctaataacttcctccaa

SEQ ID NO: 8987 - DNA, 20 bp, Artificial Sequence
  sgRNA
tgtgtgcctgcctggcaatc

SEQ ID NO: 8988 - DNA, 20 bp, Artificial Sequence
  sgRNA
ctaaggcatgagggccaggc

SEQ ID NO: 8989 - DNA, 20 bp, Artificial Sequence
  sgRNA
agcacagtgcacacctgcta

SEQ ID NO: 8990 - DNA, 20 bp, Artificial Sequence
  sgRNA
gggagcagccgcggcccacg

SEQ ID NO: 8991 - DNA, 20 bp, Artificial Sequence
  sgRNA
cgcaactcttcactgcggta

SEQ ID NO: 8992 - DNA, 20 bp, Artificial Sequence
  sgRNA
cagcaatcctgactcagcag

SEQ ID NO: 8993 - DNA, 20 bp, Artificial Sequence
  sgRNA
ggatggcctacaactcccat

SEQ ID NO: 8994 - DNA, 20 bp, Artificial Sequence
  sgRNA
gacttggtgacatattgttc

SEQ ID NO: 8995 - DNA, 20 bp, Artificial Sequence
  sgRNA
tgtttccgattgggcagaat

SEQ ID NO: 8996 - DNA, 20 bp, Artificial Sequence
  sgRNA
cccaggcgcgctcggccgag

SEQ ID NO: 8997 - DNA, 20 bp, Artificial Sequence
  sgRNA
ttcctcagaggctgccagtg

SEQ ID NO: 8998 - DNA, 20 bp, Artificial Sequence
  sgRNA
gggacacagcgcggcacgat

SEQ ID NO: 8999 - DNA, 20 bp, Artificial Sequence
  sgRNA
cccgtcttgccaatttatgt

SEQ ID NO: 9000 - DNA, 20 bp, Artificial Sequence
  sgRNA
gactgaggtggaggcctggg

SEQ ID NO: 9001 - DNA, 20 bp, Artificial Sequence
  sgRNA
cacgtgtcatgttccatatt

SEQ ID NO: 9002 - DNA, 20 bp, Artificial Sequence
  sgRNA
ggtggtaacaagccttcctg

SEQ ID NO: 9003 - DNA, 20 bp, Artificial Sequence
  sgRNA
cctagtcttccaagactcca

SEQ ID NO: 9004 - DNA, 20 bp, Artificial Sequence
  sgRNA
gaagcgtgcgagtacttatg

SEQ ID NO: 9005 - DNA, 20 bp, Artificial Sequence
  sgRNA
gcagttgggaaacttgatat

SEQ ID NO: 9006 - DNA, 20 bp, Artificial Sequence
  sgRNA
agcggcaggcatggtggacc

SEQ ID NO: 9007 - DNA, 20 bp, Artificial Sequence
  sgRNA
ttgcacactgggttgctagc

SEQ ID NO: 9008 - DNA, 20 bp, Artificial Sequence
  sgRNA
ttcaccgggagctctgaccc

SEQ ID NO: 9009 - DNA, 20 bp, Artificial Sequence
  sgRNA
cacagaactagggacagatc

SEQ ID NO: 9010 - DNA, 20 bp, Artificial Sequence
  sgRNA
aatgagggagggatggaagc

SEQ ID NO: 9011 - DNA, 20 bp, Artificial Sequence
  sgRNA
ttatcccaccaatcggtctc

SEQ ID NO: 9012 - DNA, 20 bp, Artificial Sequence
  sgRNA
tcgtgcgtcatcgcgaggcg

SEQ ID NO: 9013 - DNA, 20 bp, Artificial Sequence
  sgRNA
ggcttctctgggattacgtt

SEQ ID NO: 9014 - DNA, 20 bp, Artificial Sequence
  sgRNA
atggtgggattgggcttctg

SEQ ID NO: 9015 - DNA, 20 bp, Artificial Sequence
  sgRNA
ggtgatcgcgaccggtgccg

SEQ ID NO: 9016 - DNA, 20 bp, Artificial Sequence
  sgRNA
ctctacaaaggcttgtgtta

SEQ ID NO: 9017 - DNA, 20 bp, Artificial Sequence
  sgRNA
ccatggaatcgaaagggtct

SEQ ID NO: 9018 - DNA, 20 bp, Artificial Sequence
  sgRNA
gggagagctacgcacaagcg

SEQ ID NO: 9019 - DNA, 20 bp, Artificial Sequence
  sgRNA
atgctgggctggtatagact

SEQ ID NO: 9020 - DNA, 20 bp, Artificial Sequence
  sgRNA
ctcgagacggcggcgcgcct

SEQ ID NO: 9021 - DNA, 20 bp, Artificial Sequence
  sgRNA
cgggtccgattgtgattgga

SEQ ID NO: 9022 - DNA, 20 bp, Artificial Sequence
  sgRNA
tgcaggacagcatacacccg

SEQ ID NO: 9023 - DNA, 20 bp, Artificial Sequence
  sgRNA
ggtcgctcgggccaacttcc

SEQ ID NO: 9024 - DNA, 20 bp, Artificial Sequence
  sgRNA
cgcgtgcgcacaggacggga

SEQ ID NO: 9025 - DNA, 20 bp, Artificial Sequence
  sgRNA
gagatcgggtctagctctgt

SEQ ID NO: 9026 - DNA, 20 bp, Artificial Sequence
  sgRNA
tggcttcttgtctggctagc

SEQ ID NO: 9027 - DNA, 20 bp, Artificial Sequence
  sgRNA
ggtggctggagggacagcag

SEQ ID NO: 9028 - DNA, 20 bp, Artificial Sequence
  sgRNA
tttcagaacgcgcctggccc

SEQ ID NO: 9029 - DNA, 20 bp, Artificial Sequence
  sgRNA
aaggcgggatgcaaagcact

SEQ ID NO: 9030 - DNA, 20 bp, Artificial Sequence
  sgRNA
ttgaggacatcagcctcgcg

SEQ ID NO: 9031 - DNA, 20 bp, Artificial Sequence
  sgRNA
ggactgcggacacgatcaca

SEQ ID NO: 9032 - DNA, 20 bp, Artificial Sequence
  sgRNA
ctgtgtgccggccgccaccg

SEQ ID NO: 9033 - DNA, 20 bp, Artificial Sequence
  sgRNA
atggatgattgggctaaact

SEQ ID NO: 9034 - DNA, 20 bp, Artificial Sequence
  sgRNA
ggagcaggagcacctgctgg

SEQ ID NO: 9035 - DNA, 20 bp, Artificial Sequence
  sgRNA
caggaagctgtcaagtggcc

SEQ ID NO: 9036 - DNA, 20 bp, Artificial Sequence
  sgRNA
ttaatgtgagttgtctgaat

SEQ ID NO: 9037 - DNA, 20 bp, Artificial Sequence
  sgRNA
caagggaatcgctggctctc

SEQ ID NO: 9038 - DNA, 20 bp, Artificial Sequence
  sgRNA
cactctggagtccgcagagt

SEQ ID NO: 9039 - DNA, 20 bp, Artificial Sequence
  sgRNA
ggctgctgcgaactctcttc

SEQ ID NO: 9040 - DNA, 20 bp, Artificial Sequence
  sgRNA
gtcaccaaaccggtggccgg

SEQ ID NO: 9041 - DNA, 20 bp, Artificial Sequence
  sgRNA
ggatgtacgtgcaaagatat

SEQ ID NO: 9042 - DNA, 20 bp, Artificial Sequence
  sgRNA
taggtgtgtttgactgattg

SEQ ID NO: 9043 - DNA, 20 bp, Artificial Sequence
  sgRNA
caggcgccctgggagcgccc

SEQ ID NO: 9044 - DNA, 20 bp, Artificial Sequence
  sgRNA
gccgctgtcgtgaggcatgc

SEQ ID NO: 9045 - DNA, 20 bp, Artificial Sequence
  sgRNA
caccgctgtgtaggatgcca

SEQ ID NO: 9046 - DNA, 20 bp, Artificial Sequence
  sgRNA
cccggactacggaagacatg

SEQ ID NO: 9047 - DNA, 20 bp, Artificial Sequence
  sgRNA
tgcaaagagcaggagagacg

SEQ ID NO: 9048 - DNA, 20 bp, Artificial Sequence
  sgRNA
tgttaagtgccgtggcagta

SEQ ID NO: 9049 - DNA, 20 bp, Artificial Sequence
  sgRNA
gaagctgtcagagcatttga

SEQ ID NO: 9050 - DNA, 20 bp, Artificial Sequence
  sgRNA
agtgtccattggtcaattgt

SEQ ID NO: 9051 - DNA, 20 bp, Artificial Sequence
  sgRNA
cccgagcgtggccattagtg

SEQ ID NO: 9052 - DNA, 20 bp, Artificial Sequence
  sgRNA
ggtgcagcgcggcgaacccg

SEQ ID NO: 9053 - DNA, 20 bp, Artificial Sequence
  sgRNA
tcggaatcaagagtcctcac

SEQ ID NO: 9054 - DNA, 20 bp, Artificial Sequence
  sgRNA
gggttagagactaagagttt

SEQ ID NO: 9055 - DNA, 20 bp, Artificial Sequence
  sgRNA
gcccggagcggaccctatgc

SEQ ID NO: 9056 - DNA, 20 bp, Artificial Sequence
  sgRNA
gctgggacagactccgccca

SEQ ID NO: 9057 - DNA, 20 bp, Artificial Sequence
  sgRNA
ttgtttcagtgtcggaacac

SEQ ID NO: 9058 - DNA, 20 bp, Artificial Sequence
  sgRNA
aggtcttagaactggcaggt

SEQ ID NO: 9059 - DNA, 20 bp, Artificial Sequence
  sgRNA
acggcttccgggttggcggg

SEQ ID NO: 9060 - DNA, 20 bp, Artificial Sequence
  sgRNA
ttcttcgaattcgttcttcg

SEQ ID NO: 9061 - DNA, 20 bp, Artificial Sequence
  sgRNA
tgtgctccaatcagatacta

SEQ ID NO: 9062 - DNA, 20 bp, Artificial Sequence
  sgRNA
ctagttcttaggcagatgga

SEQ ID NO: 9063 - DNA, 20 bp, Artificial Sequence
  sgRNA
cgcaccatagagacgtggcg

SEQ ID NO: 9064 - DNA, 20 bp, Artificial Sequence
  sgRNA
aagaggcatctcacagaatt

SEQ ID NO: 9065 - DNA, 20 bp, Artificial Sequence
  sgRNA
ggtggcatgtcattggcagc

SEQ ID NO: 9066 - DNA, 20 bp, Artificial Sequence
  sgRNA
ggctcttgagtaggcctgcc

SEQ ID NO: 9067 - DNA, 20 bp, Artificial Sequence
  sgRNA
aagtttgtgtcatggacggg

SEQ ID NO: 9068 - DNA, 20 bp, Artificial Sequence
  sgRNA
tcagcccgcacccgctccct

SEQ ID NO: 9069 - DNA, 20 bp, Artificial Sequence
  sgRNA
gggtttccgaatccgggtct

SEQ ID NO: 9070 - DNA, 20 bp, Artificial Sequence
  sgRNA
ctcgtagaccgaccgtctct

SEQ ID NO: 9071 - DNA, 20 bp, Artificial Sequence
  sgRNA
tcagggctgggtctgtgttg

SEQ ID NO: 9072 - DNA, 20 bp, Artificial Sequence
  sgRNA
ccggcctgacgcgcgcaccg

SEQ ID NO: 9073 - DNA, 20 bp, Artificial Sequence
  sgRNA
aagccacagctacctcacaa

SEQ ID NO: 9074 - DNA, 20 bp, Artificial Sequence
  sgRNA
gcgagggtcctgcggtgtcc

SEQ ID NO: 9075 - DNA, 20 bp, Artificial Sequence
  sgRNA
aggcgtgacttcgacttctc

SEQ ID NO: 9076 - DNA, 20 bp, Artificial Sequence
  sgRNA
ctgatgtggctaatgctgat

SEQ ID NO: 9077 - DNA, 20 bp, Artificial Sequence
  sgRNA
ggcagcgagctcctggagtg

SEQ ID NO: 9078 - DNA, 20 bp, Artificial Sequence
  sgRNA
tccttcccggtcacgtgcgc

SEQ ID NO: 9079 - DNA, 20 bp, Artificial Sequence
  sgRNA
gtttctatttcccagatccc

SEQ ID NO: 9080 - DNA, 20 bp, Artificial Sequence
  sgRNA
ggtaagttatcacttggtgc

SEQ ID NO: 9081 - DNA, 20 bp, Artificial Sequence
  sgRNA
gaaagctgctgggctcagtc

SEQ ID NO: 9082 - DNA, 20 bp, Artificial Sequence
  sgRNA
tctccctcccgctcccgtag

SEQ ID NO: 9083 - DNA, 20 bp, Artificial Sequence
  sgRNA
tgtgattctgattggcgttt

SEQ ID NO: 9084 - DNA, 20 bp, Artificial Sequence
  sgRNA
gagctaaggaggaaaggtgc

SEQ ID NO: 9085 - DNA, 20 bp, Artificial Sequence
  sgRNA
acactcagaaactatcttgc

SEQ ID NO: 9086 - DNA, 20 bp, Artificial Sequence
  sgRNA
ggaaatgggcgggccacagc

SEQ ID NO: 9087 - DNA, 20 bp, Artificial Sequence
  sgRNA
tcatcacaactcccgctctg

SEQ ID NO: 9088 - DNA, 20 bp, Artificial Sequence
  sgRNA
ctgacgcgcgggctgacgtg

SEQ ID NO: 9089 - DNA, 20 bp, Artificial Sequence
  sgRNA
catgggtgtgctgcgacctc

SEQ ID NO: 9090 - DNA, 20 bp, Artificial Sequence
  sgRNA
ttcgggcacagcccagggag

SEQ ID NO: 9091 - DNA, 20 bp, Artificial Sequence
  sgRNA
tcaagaccagctgctcttct

SEQ ID NO: 9092 - DNA, 20 bp, Artificial Sequence
  sgRNA
ctgagaccaccacagagcta

SEQ ID NO: 9093 - DNA, 20 bp, Artificial Sequence
  sgRNA
catttactcattccgtcacc

SEQ ID NO: 9094 - DNA, 20 bp, Artificial Sequence
  sgRNA
caatctcaggttaacgtgta

SEQ ID NO: 9095 - DNA, 20 bp, Artificial Sequence
  sgRNA
agcctttccgcgtggagctc

SEQ ID NO: 9096 - DNA, 20 bp, Artificial Sequence
  sgRNA
cggagcaaggataaacaccg

SEQ ID NO: 9097 - DNA, 20 bp, Artificial Sequence
  sgRNA
acaagcaggtgtttgattcc

SEQ ID NO: 9098 - DNA, 20 bp, Artificial Sequence
  sgRNA
cgctgccgttcattggctcc

SEQ ID NO: 9099 - DNA, 20 bp, Artificial Sequence
  sgRNA
cccgcaggctcacctggctg

SEQ ID NO: 9100 - DNA, 20 bp, Artificial Sequence
  sgRNA
aatggtcattaataatgcag

SEQ ID NO: 9101 - DNA, 20 bp, Artificial Sequence
  sgRNA
gggcgtcccggtttgctcgt

SEQ ID NO: 9102 - DNA, 20 bp, Artificial Sequence
  sgRNA
tgagggtttgcaccaatccg

SEQ ID NO: 9103 - DNA, 20 bp, Artificial Sequence
  sgRNA
ggaattgtagtccgggccag

SEQ ID NO: 9104 - DNA, 20 bp, Artificial Sequence
  sgRNA
acttggtgtaatgctatccg

SEQ ID NO: 9105 - DNA, 20 bp, Artificial Sequence
  sgRNA
caatgctccgctcgagggcg

SEQ ID NO: 9106 - DNA, 20 bp, Artificial Sequence
  sgRNA
gcgtggcgagggagagggcg

SEQ ID NO: 9107 - DNA, 20 bp, Artificial Sequence
  sgRNA
gatgattcaggaagctgcct

SEQ ID NO: 9108 - DNA, 20 bp, Artificial Sequence
  sgRNA
gtggccgaggcggagcgccc

SEQ ID NO: 9109 - DNA, 20 bp, Artificial Sequence
  sgRNA
accggatacgctccagaact

SEQ ID NO: 9110 - DNA, 20 bp, Artificial Sequence
  sgRNA
aatggttcttcccagcccgg

SEQ ID NO: 9111 - DNA, 20 bp, Artificial Sequence
  sgRNA
tctgttggcgtccttcctgt

SEQ ID NO: 9112 - DNA, 20 bp, Artificial Sequence
  sgRNA
gggagtgcgcttgcgcacag

SEQ ID NO: 9113 - DNA, 20 bp, Artificial Sequence
  sgRNA
tagtaatcgagaatctaaca

SEQ ID NO: 9114 - DNA, 20 bp, Artificial Sequence
  sgRNA
cgtagcttctgctatgtggc

SEQ ID NO: 9115 - DNA, 20 bp, Artificial Sequence
  sgRNA
gtgtgcttgaaatggctttg

SEQ ID NO: 9116 - DNA, 20 bp, Artificial Sequence
  sgRNA
ctagtactgttcaacttgtg

SEQ ID NO: 9117 - DNA, 20 bp, Artificial Sequence
  sgRNA
gagtatgacgatgtcattcc

SEQ ID NO: 9118 - DNA, 20 bp, Artificial Sequence
  sgRNA
gctccatttataggaggagc

SEQ ID NO: 9119 - DNA, 20 bp, Artificial Sequence
  sgRNA
cgtgatagcccagctgcctg

SEQ ID NO: 9120 - DNA, 20 bp, Artificial Sequence
  sgRNA
tgaggcaaaggtcattctcg

SEQ ID NO: 9121 - DNA, 20 bp, Artificial Sequence
  sgRNA
tcaatgggcaccgatgggcg

SEQ ID NO: 9122 - DNA, 20 bp, Artificial Sequence
  sgRNA
cacccgtcaccatagcaacg

SEQ ID NO: 9123 - DNA, 20 bp, Artificial Sequence
  sgRNA
gatcccgtagctagagaacg

SEQ ID NO: 9124 - DNA, 20 bp, Artificial Sequence
  sgRNA
aaccacacccaacttgggag

SEQ ID NO: 9125 - DNA, 20 bp, Artificial Sequence
  sgRNA
gtgttgaaagcatactcagc

SEQ ID NO: 9126 - DNA, 20 bp, Artificial Sequence
  sgRNA
gtcgccgagccgggttgcta

SEQ ID NO: 9127 - DNA, 20 bp, Artificial Sequence
  sgRNA
gagcagttcttccagccaat

SEQ ID NO: 9128 - DNA, 20 bp, Artificial Sequence
  sgRNA
agggaatttatgcaaccaat

SEQ ID NO: 9129 - DNA, 20 bp, Artificial Sequence
  sgRNA
cagaagtgctctgcagcgcc

SEQ ID NO: 9130 - DNA, 20 bp, Artificial Sequence
  sgRNA
acactatcccagagtctccc

SEQ ID NO: 9131 - DNA, 20 bp, Artificial Sequence
  sgRNA
cactagttacaactcctgca

SEQ ID NO: 9132 - DNA, 20 bp, Artificial Sequence
  sgRNA
gatcaccgagtatcacgaaa

SEQ ID NO: 9133 - DNA, 20 bp, Artificial Sequence
  sgRNA
ctaactcgcggcgccgagtg

SEQ ID NO: 9134 - DNA, 20 bp, Artificial Sequence
  sgRNA
gagcaatacagcaggagtcg

SEQ ID NO: 9135 - DNA, 20 bp, Artificial Sequence
  sgRNA
gggcagcacgagatgcgcgc

SEQ ID NO: 9136 - DNA, 20 bp, Artificial Sequence
  sgRNA
cctgaatgtatgaatcccac

SEQ ID NO: 9137 - DNA, 20 bp, Artificial Sequence
  sgRNA
atcgctctccgcagaccagt

SEQ ID NO: 9138 - DNA, 20 bp, Artificial Sequence
  sgRNA
gctcgtatatccaacctcag

SEQ ID NO: 9139 - DNA, 20 bp, Artificial Sequence
  sgRNA
tcaggacagacagttaggca

SEQ ID NO: 9140 - DNA, 20 bp, Artificial Sequence
  sgRNA
tgaacaagcacatccgcccg

SEQ ID NO: 9141 - DNA, 20 bp, Artificial Sequence
  sgRNA
cgaaacgcgtgttcccaagg

SEQ ID NO: 9142 - DNA, 20 bp, Artificial Sequence
  sgRNA
agggagggagaagggacctt

SEQ ID NO: 9143 - DNA, 20 bp, Artificial Sequence
  sgRNA
gccacagttagaggaggttg

SEQ ID NO: 9144 - DNA, 20 bp, Artificial Sequence
  sgRNA
gtgttggagagggcccaggg

SEQ ID NO: 9145 - DNA, 20 bp, Artificial Sequence
  sgRNA
gctgctctacacctgccgcg

SEQ ID NO: 9146 - DNA, 20 bp, Artificial Sequence
  sgRNA
gcaggtaacgcgataccggc

SEQ ID NO: 9147 - DNA, 20 bp, Artificial Sequence
  sgRNA
aacggattcctggcagcctc

SEQ ID NO: 9148 - DNA, 20 bp, Artificial Sequence
  sgRNA
cgatctaaagcaacaggtgg

SEQ ID NO: 9149 - DNA, 20 bp, Artificial Sequence
  sgRNA
aggccacctgcgggtgggcg

SEQ ID NO: 9150 - DNA, 20 bp, Artificial Sequence
  sgRNA
ggtcgatccgcgcgcgagtg

SEQ ID NO: 9151 - DNA, 20 bp, Artificial Sequence
  sgRNA
ggcgtgtctcaacagagaat

SEQ ID NO: 9152 - DNA, 20 bp, Artificial Sequence
  sgRNA
agctaatttgatgtcgcaaa

SEQ ID NO: 9153 - DNA, 20 bp, Artificial Sequence
  sgRNA
gccacccgggatgcgagcac

SEQ ID NO: 9154 - DNA, 20 bp, Artificial Sequence
  sgRNA
ccaggtgaccggcagggctc

SEQ ID NO: 9155 - DNA, 20 bp, Artificial Sequence
  sgRNA
ttaatctgtgagagttaatc

SEQ ID NO: 9156 - DNA, 20 bp, Artificial Sequence
  sgRNA
tggatgtgcaggcgtggccc

SEQ ID NO: 9157 - DNA, 20 bp, Artificial Sequence
  sgRNA
ggtaaatggatttgacaggc

SEQ ID NO: 9158 - DNA, 20 bp, Artificial Sequence
  sgRNA
cactgaacagagggcggacg

SEQ ID NO: 9159 - DNA, 20 bp, Artificial Sequence
  sgRNA
ggaatcacctagaacaggcc

SEQ ID NO: 9160 - DNA, 20 bp, Artificial Sequence
  sgRNA
gggaggccggcgagattgta

SEQ ID NO: 9161 - DNA, 20 bp, Artificial Sequence
  sgRNA
gggcgttgcttctacgggct

SEQ ID NO: 9162 - DNA, 20 bp, Artificial Sequence
  sgRNA
tgctaggagctaaagaaaca

SEQ ID NO: 9163 - DNA, 20 bp, Artificial Sequence
  sgRNA
tggcatctcaggttgcagcc

SEQ ID NO: 9164 - DNA, 20 bp, Artificial Sequence
  sgRNA
ggaccatccatcaagaagaa

SEQ ID NO: 9165 - DNA, 20 bp, Artificial Sequence
  sgRNA
ggcttgggattccagtgctg

SEQ ID NO: 9166 - DNA, 20 bp, Artificial Sequence
  sgRNA
ctcagcttactgtcagtaca

SEQ ID NO: 9167 - DNA, 20 bp, Artificial Sequence
  sgRNA
ttattccatggaatctcatt

SEQ ID NO: 9168 - DNA, 20 bp, Artificial Sequence
  sgRNA
gggctggctgaaagacactc

SEQ ID NO: 9169 - DNA, 20 bp, Artificial Sequence
  sgRNA
gggctaactgccaatcgcaa

SEQ ID NO: 9170 - DNA, 20 bp, Artificial Sequence
  sgRNA
gagaacgtggctgagcagcg

SEQ ID NO: 9171 - DNA, 20 bp, Artificial Sequence
  sgRNA
tagtgataacacttagaagc

SEQ ID NO: 9172 - DNA, 20 bp, Artificial Sequence
  sgRNA
tggattcagatggaaatgtc

SEQ ID NO: 9173 - DNA, 20 bp, Artificial Sequence
  sgRNA
ttggactgggtcctgatggg

SEQ ID NO: 9174 - DNA, 20 bp, Artificial Sequence
  sgRNA
gccggatccaaattccaggg

SEQ ID NO: 9175 - DNA, 20 bp, Artificial Sequence
  sgRNA
agcttggcctaatcccacag

SEQ ID NO: 9176 - DNA, 20 bp, Artificial Sequence
  sgRNA
tgccaggaggatattcaaac

SEQ ID NO: 9177 - DNA, 20 bp, Artificial Sequence
  sgRNA
tgtggctttagccttgcaca

SEQ ID NO: 9178 - DNA, 20 bp, Artificial Sequence
  sgRNA
gtgcgcggcacggcgcgctc

SEQ ID NO: 9179 - DNA, 20 bp, Artificial Sequence
  sgRNA
gactagagcccaccgggtca

SEQ ID NO: 9180 - DNA, 20 bp, Artificial Sequence
  sgRNA
cttcgtctccagaagcgaca

SEQ ID NO: 9181 - DNA, 20 bp, Artificial Sequence
  sgRNA
ctgcgtcacgccctccttaa

SEQ ID NO: 9182 - DNA, 20 bp, Artificial Sequence
  sgRNA
cggctgcaagccggtcaccc

SEQ ID NO: 9183 - DNA, 20 bp, Artificial Sequence
  sgRNA
ggctttcatcggagcacgct

SEQ ID NO: 9184 - DNA, 20 bp, Artificial Sequence
  sgRNA
ttggtcgagagccgccggct

SEQ ID NO: 9185 - DNA, 20 bp, Artificial Sequence
  sgRNA
tgcaccgtctttgtgaggtg

SEQ ID NO: 9186 - DNA, 20 bp, Artificial Sequence
  sgRNA
gccctgggcgagcagcttgg

SEQ ID NO: 9187 - DNA, 20 bp, Artificial Sequence
  sgRNA
ccgcatctgcctataactga

SEQ ID NO: 9188 - DNA, 20 bp, Artificial Sequence
  sgRNA
agagagggtggcggccctcg

SEQ ID NO: 9189 - DNA, 20 bp, Artificial Sequence
  sgRNA
ttagttcctgattcaatccc

SEQ ID NO: 9190 - DNA, 20 bp, Artificial Sequence
  sgRNA
gccctgccgtaaagtgaaga

SEQ ID NO: 9191 - DNA, 20 bp, Artificial Sequence
  sgRNA
gtcagaaccgcgttccctca

SEQ ID NO: 9192 - DNA, 20 bp, Artificial Sequence
  sgRNA
ttacgtgctaaatctgaact

SEQ ID NO: 9193 - DNA, 20 bp, Artificial Sequence
  sgRNA
atcccaaccgtcagctcgag

SEQ ID NO: 9194 - DNA, 20 bp, Artificial Sequence
  sgRNA
tataggcaccaacgagtagc

SEQ ID NO: 9195 - DNA, 20 bp, Artificial Sequence
  sgRNA
cgcttgtggagcgcgcagcg

SEQ ID NO: 9196 - DNA, 20 bp, Artificial Sequence
  sgRNA
tgctatggtcaccagatacc

SEQ ID NO: 9197 - DNA, 20 bp, Artificial Sequence
  sgRNA
gcatgatggtgttaaattac

SEQ ID NO: 9198 - DNA, 20 bp, Artificial Sequence
  sgRNA
accgcggtgcgtgctgtacc

SEQ ID NO: 9199 - DNA, 20 bp, Artificial Sequence
  sgRNA
gggctcagaatgaatatgat

SEQ ID NO: 9200 - DNA, 20 bp, Artificial Sequence
  sgRNA
agggaagggtgctatggtgc

SEQ ID NO: 9201 - DNA, 20 bp, Artificial Sequence
  sgRNA
gggacgccacctccggaggt

SEQ ID NO: 9202 - DNA, 20 bp, Artificial Sequence
  sgRNA
gacgcttgggaacctgcagg

SEQ ID NO: 9203 - DNA, 20 bp, Artificial Sequence
  sgRNA
aaacgtagcatgtttaactt

SEQ ID NO: 9204 - DNA, 20 bp, Artificial Sequence
  sgRNA
cgtgtggaatatttcacaac

SEQ ID NO: 9205 - DNA, 20 bp, Artificial Sequence
  sgRNA
ggcatttacagactggcaag

SEQ ID NO: 9206 - DNA, 20 bp, Artificial Sequence
  sgRNA
ggtcccttagttagagcaag

SEQ ID NO: 9207 - DNA, 20 bp, Artificial Sequence
  sgRNA
aaagaggaactttatagagc

SEQ ID NO: 9208 - DNA, 20 bp, Artificial Sequence
  sgRNA
gggaccacattggatgaagc

SEQ ID NO: 9209 - DNA, 20 bp, Artificial Sequence
  sgRNA
gtggattcttgctccgctcg

SEQ ID NO: 9210 - DNA, 20 bp, Artificial Sequence
  sgRNA
cgtccggaaagcctgctatg

SEQ ID NO: 9211 - DNA, 20 bp, Artificial Sequence
  sgRNA
cctccctttccctctggctc

SEQ ID NO: 9212 - DNA, 20 bp, Artificial Sequence
  sgRNA
acaggcagtggttgaaattc

SEQ ID NO: 9213 - DNA, 20 bp, Artificial Sequence
  sgRNA
ggctctggtaactaggcaac

SEQ ID NO: 9214 - DNA, 20 bp, Artificial Sequence
  sgRNA
ttcgggaagcaggtatggca

SEQ ID NO: 9215 - DNA, 20 bp, Artificial Sequence
  sgRNA
ctgagcctttgttaataggt

SEQ ID NO: 9216 - DNA, 20 bp, Artificial Sequence
  sgRNA
ggttaagggtgatggccttt

SEQ ID NO: 9217 - DNA, 20 bp, Artificial Sequence
  sgRNA
ccagagcccttcagcaccat

SEQ ID NO: 9218 - DNA, 20 bp, Artificial Sequence
  sgRNA
ggcactaaatatagacttca

SEQ ID NO: 9219 - DNA, 20 bp, Artificial Sequence
  sgRNA
cgttggacagtaggtgggag

SEQ ID NO: 9220 - DNA, 20 bp, Artificial Sequence
  sgRNA
ggtaggctaaggtgagcgaa

SEQ ID NO: 9221 - DNA, 20 bp, Artificial Sequence
  sgRNA
tcgttcagtaaattgctctt

SEQ ID NO: 9222 - DNA, 20 bp, Artificial Sequence
  sgRNA
cgtacttccgccaatttgct

SEQ ID NO: 9223 - DNA, 20 bp, Artificial Sequence
  sgRNA
aattgctaacaggcttcctt

SEQ ID NO: 9224 - DNA, 20 bp, Artificial Sequence
  sgRNA
taacagtcactgggtgtggc

SEQ ID NO: 9225 - DNA, 20 bp, Artificial Sequence
  sgRNA
agggaaggagcgaggctaag

SEQ ID NO: 9226 - DNA, 20 bp, Artificial Sequence
  sgRNA
acctaccgggtgcacttcac

SEQ ID NO: 9227 - DNA, 20 bp, Artificial Sequence
  sgRNA
tatgcactgtctggagggtg

SEQ ID NO: 9228 - DNA, 20 bp, Artificial Sequence
  sgRNA
gacaagctggcgggagccaa

SEQ ID NO: 9229 - DNA, 20 bp, Artificial Sequence
  sgRNA
tcagacaagaaatccagttc

SEQ ID NO: 9230 - DNA, 20 bp, Artificial Sequence
  sgRNA
gggaggaccaatctggaaga

SEQ ID NO: 9231 - DNA, 20 bp, Artificial Sequence
  sgRNA
gcgagttctctgtcgaaacc

SEQ ID NO: 9232 - DNA, 20 bp, Artificial Sequence
  sgRNA
gccgggtgaatgcaacaccc

SEQ ID NO: 9233 - DNA, 20 bp, Artificial Sequence
  sgRNA
gacttggaatatgagcttgc

SEQ ID NO: 9234 - DNA, 20 bp, Artificial Sequence
  sgRNA
gcgtattcttgtgggatggc

SEQ ID NO: 9235 - DNA, 20 bp, Artificial Sequence
  sgRNA
gagagagtgtcagagtcact

SEQ ID NO: 9236 - DNA, 20 bp, Artificial Sequence
  sgRNA
gtgtccggctgcgagcgagc

SEQ ID NO: 9237 - DNA, 20 bp, Artificial Sequence
  sgRNA
gttcggcaagaatcctcacg

SEQ ID NO: 9238 - DNA, 20 bp, Artificial Sequence
  sgRNA
accctgtaatttgaacagcc

SEQ ID NO: 9239 - DNA, 20 bp, Artificial Sequence
  sgRNA
gggaatgtgttcgctccgcg

SEQ ID NO: 9240 - DNA, 20 bp, Artificial Sequence
  sgRNA
ggagcgagaggaggagcagg

SEQ ID NO: 9241 - DNA, 20 bp, Artificial Sequence
  sgRNA
gggtctgtctacacgggctc

SEQ ID NO: 9242 - DNA, 20 bp, Artificial Sequence
  sgRNA
gagaggtgtttactatcact

SEQ ID NO: 9243 - DNA, 20 bp, Artificial Sequence
  sgRNA
ggagaagcgtcatcagtatc

SEQ ID NO: 9244 - DNA, 20 bp, Artificial Sequence
  sgRNA
accctattgatttcttcttc

SEQ ID NO: 9245 - DNA, 20 bp, Artificial Sequence
  sgRNA
agcacattggctcaggcttc

SEQ ID NO: 9246 - DNA, 20 bp, Artificial Sequence
  sgRNA
gtctgttaattgcatcactt

SEQ ID NO: 9247 - DNA, 20 bp, Artificial Sequence
  sgRNA
ggtggagatggagataagga

SEQ ID NO: 9248 - DNA, 20 bp, Artificial Sequence
  sgRNA
gtacgcgactgtcctccttg

SEQ ID NO: 9249 - DNA, 20 bp, Artificial Sequence
  sgRNA
cggctttataaatacagagc

SEQ ID NO: 9250 - DNA, 20 bp, Artificial Sequence
  sgRNA
attgtgtatctttagttacc

SEQ ID NO: 9251 - DNA, 20 bp, Artificial Sequence
  sgRNA
gagcccatcctcagctaaga

SEQ ID NO: 9252 - DNA, 20 bp, Artificial Sequence
  sgRNA
catggcaacagtcagtgcgc

SEQ ID NO: 9253 - DNA, 20 bp, Artificial Sequence
  sgRNA
ggagggtgaagtgatgtgac

SEQ ID NO: 9254 - DNA, 20 bp, Artificial Sequence
  sgRNA
gggcgctaaccagtccttga

SEQ ID NO: 9255 - DNA, 20 bp, Artificial Sequence
  sgRNA
ttatttattcttcctcctgt

SEQ ID NO: 9256 - DNA, 20 bp, Artificial Sequence
  sgRNA
cgaatgcttatgtgagctct

SEQ ID NO: 9257 - DNA, 20 bp, Artificial Sequence
  sgRNA
tggtaaggtctaggaggctt

SEQ ID NO: 9258 - DNA, 20 bp, Artificial Sequence
  sgRNA
gggcgcgggcggaggctcgg

SEQ ID NO: 9259 - DNA, 20 bp, Artificial Sequence
  sgRNA
agatgacggctctcatatgg

SEQ ID NO: 9260 - DNA, 20 bp, Artificial Sequence
  sgRNA
caggcactggtgccaagcga

SEQ ID NO: 9261 - DNA, 20 bp, Artificial Sequence
  sgRNA
gtggtccaaggccaacagta

SEQ ID NO: 9262 - DNA, 20 bp, Artificial Sequence
  sgRNA
aaacttacaaaccttccgat

SEQ ID NO: 9263 - DNA, 20 bp, Artificial Sequence
  sgRNA
gttggtttgacccttgacct

SEQ ID NO: 9264 - DNA, 20 bp, Artificial Sequence
  sgRNA
aggagacggagggtgggacc

SEQ ID NO: 9265 - DNA, 20 bp, Artificial Sequence
  sgRNA
agggagttaccagcgagtcg

SEQ ID NO: 9266 - DNA, 20 bp, Artificial Sequence
  sgRNA
aagcagagacaggttgagtt

SEQ ID NO: 9267 - DNA, 20 bp, Artificial Sequence
  sgRNA
tggcaatgcttccgggtcct

SEQ ID NO: 9268 - DNA, 20 bp, Artificial Sequence
  sgRNA
aaggtcggccggcgtttgaa

SEQ ID NO: 9269 - DNA, 20 bp, Artificial Sequence
  sgRNA
tcccgactgcggcgtgactg

SEQ ID NO: 9270 - DNA, 20 bp, Artificial Sequence
  sgRNA
ttggattcgcgcgccggccc

SEQ ID NO: 9271 - DNA, 20 bp, Artificial Sequence
  sgRNA
ataaaccagtttacccggca

SEQ ID NO: 9272 - DNA, 20 bp, Artificial Sequence
  sgRNA
attggtcggtgttggcgcga

SEQ ID NO: 9273 - DNA, 20 bp, Artificial Sequence
  sgRNA
cagggatgtgtttactaagc

SEQ ID NO: 9274 - DNA, 20 bp, Artificial Sequence
  sgRNA
tatgtatgagctccctccct

SEQ ID NO: 9275 - DNA, 20 bp, Artificial Sequence
  sgRNA
ggtcactaccaagtttggtt

SEQ ID NO: 9276 - DNA, 20 bp, Artificial Sequence
  sgRNA
cacgtgacagtcggaggcgc

SEQ ID NO: 9277 - DNA, 20 bp, Artificial Sequence
  sgRNA
gaaagctgaagtcttaactg

SEQ ID NO: 9278 - DNA, 20 bp, Artificial Sequence
  sgRNA
gggtccagcgagcctgaccg

SEQ ID NO: 9279 - DNA, 20 bp, Artificial Sequence
  sgRNA
aaacggattagtgggcatct

SEQ ID NO: 9280 - DNA, 20 bp, Artificial Sequence
  sgRNA
ggagggtcacgtgaacggga

SEQ ID NO: 9281 - DNA, 20 bp, Artificial Sequence
  sgRNA
aggaatgggaaatgggatct

SEQ ID NO: 9282 - DNA, 20 bp, Artificial Sequence
  sgRNA
ccaccagactctactatata

SEQ ID NO: 9283 - DNA, 20 bp, Artificial Sequence
  sgRNA
cccggtagtgctccattctc

SEQ ID NO: 9284 - DNA, 20 bp, Artificial Sequence
  sgRNA
tagttgactagaaggttgac

SEQ ID NO: 9285 - DNA, 20 bp, Artificial Sequence
  sgRNA
ctgtgcttagccactacgag

SEQ ID NO: 9286 - DNA, 20 bp, Artificial Sequence
  sgRNA
catcctaacctcatgcaagg

SEQ ID NO: 9287 - DNA, 20 bp, Artificial Sequence
  sgRNA
tggaccgagcagttagaatg

SEQ ID NO: 9288 - DNA, 20 bp, Artificial Sequence
  sgRNA
gaaagcgtgagatcaccggg

SEQ ID NO: 9289 - DNA, 20 bp, Artificial Sequence
  sgRNA
cctcagttccacctttcact

SEQ ID NO: 9290 - DNA, 20 bp, Artificial Sequence
  sgRNA
tcctacaggagatgtgccga

SEQ ID NO: 9291 - DNA, 20 bp, Artificial Sequence
  sgRNA
atggacattgaggctctaag

SEQ ID NO: 9292 - DNA, 20 bp, Artificial Sequence
  sgRNA
tctctaagatgattgcagaa

SEQ ID NO: 9293 - DNA, 20 bp, Artificial Sequence
  sgRNA
tgagatgcagttagacttac

SEQ ID NO: 9294 - DNA, 20 bp, Artificial Sequence
  sgRNA
tgcacccgccaatgaggagc

SEQ ID NO: 9295 - DNA, 20 bp, Artificial Sequence
  sgRNA
tcagcagcccaggagcctag

SEQ ID NO: 9296 - DNA, 20 bp, Artificial Sequence
  sgRNA
acgaaacttcaagtaccaaa

SEQ ID NO: 9297 - DNA, 20 bp, Artificial Sequence
  sgRNA
gatttcctggtccacttccc

SEQ ID NO: 9298 - DNA, 20 bp, Artificial Sequence
  sgRNA
gcgctgacgtccgacgttcc

SEQ ID NO: 9299 - DNA, 20 bp, Artificial Sequence
  sgRNA
cgcgggcactgtcagcctcg

SEQ ID NO: 9300 - DNA, 20 bp, Artificial Sequence
  sgRNA
ctgtcacgtagggcaggact

SEQ ID NO: 9301 - DNA, 20 bp, Artificial Sequence
  sgRNA
taagcgacgttcctagttca

SEQ ID NO: 9302 - DNA, 20 bp, Artificial Sequence
  sgRNA
cccaagtgcttgtggtgttg

SEQ ID NO: 9303 - DNA, 20 bp, Artificial Sequence
  sgRNA
ggcggacctcgtcgcgaatc

SEQ ID NO: 9304 - DNA, 20 bp, Artificial Sequence
  sgRNA
caagtgtccgagtggcgcgg

SEQ ID NO: 9305 - DNA, 20 bp, Artificial Sequence
  sgRNA
tgccggcttccggcggaaac

SEQ ID NO: 9306 - DNA, 20 bp, Artificial Sequence
  sgRNA
ccatttgggagcccatgtta

SEQ ID NO: 9307 - DNA, 20 bp, Artificial Sequence
  sgRNA
gtagaatttgtggaaggaaa

SEQ ID NO: 9308 - DNA, 20 bp, Artificial Sequence
  sgRNA
tagatgtcggagagtgtgcc

SEQ ID NO: 9309 - DNA, 20 bp, Artificial Sequence
  sgRNA
gactaagaaatgtgggctgg

SEQ ID NO: 9310 - DNA, 20 bp, Artificial Sequence
  sgRNA
acgcctacctgacttctcgc

SEQ ID NO: 9311 - DNA, 20 bp, Artificial Sequence
  sgRNA
agggccagagctcgtaccaa

SEQ ID NO: 9312 - DNA, 20 bp, Artificial Sequence
  sgRNA
atccgggtccctcggcagag

SEQ ID NO: 9313 - DNA, 20 bp, Artificial Sequence
  sgRNA
ttgtcaaatcggaacgtctg

SEQ ID NO: 9314 - DNA, 20 bp, Artificial Sequence
  sgRNA
tgcctaactcttggcccacg

SEQ ID NO: 9315 - DNA, 20 bp, Artificial Sequence
  sgRNA
aaactgccgagctttcccga

SEQ ID NO: 9316 - DNA, 20 bp, Artificial Sequence
  sgRNA
agagaggcatagcgccatat

SEQ ID NO: 9317 - DNA, 20 bp, Artificial Sequence
  sgRNA
ggcaagggctggtcgtccat

SEQ ID NO: 9318 - DNA, 20 bp, Artificial Sequence
  sgRNA
cccttcggccaccgtcggag

SEQ ID NO: 9319 - DNA, 20 bp, Artificial Sequence
  sgRNA
actgcctgccagtcccaagc

SEQ ID NO: 9320 - DNA, 20 bp, Artificial Sequence
  sgRNA
agcccaagaggtcacagtgc

SEQ ID NO: 9321 - DNA, 20 bp, Artificial Sequence
  sgRNA
tgcgagtcccaaaggccgcc

SEQ ID NO: 9322 - DNA, 20 bp, Artificial Sequence
  sgRNA
gagcttagtggcacttaaca

SEQ ID NO: 9323 - DNA, 20 bp, Artificial Sequence
  sgRNA
gggtcccacgggcgggcgcg

SEQ ID NO: 9324 - DNA, 20 bp, Artificial Sequence
  sgRNA
caatctagggaaggcgggcc

SEQ ID NO: 9325 - DNA, 20 bp, Artificial Sequence
  sgRNA
tagaagccgcgcgttgccaa

SEQ ID NO: 9326 - DNA, 20 bp, Artificial Sequence
  sgRNA
ctctggttgagagtgccttg

SEQ ID NO: 9327 - DNA, 20 bp, Artificial Sequence
  sgRNA
cgcagatgccgccgagtcgg

SEQ ID NO: 9328 - DNA, 20 bp, Artificial Sequence
  sgRNA
gcggatcgggctcgccgaac

SEQ ID NO: 9329 - DNA, 20 bp, Artificial Sequence
  sgRNA
atctgatactgtttctttag

SEQ ID NO: 9330 - DNA, 20 bp, Artificial Sequence
  sgRNA
gaaatacgtcacgggaggcg

SEQ ID NO: 9331 - DNA, 20 bp, Artificial Sequence
  sgRNA
gaacagggaaccctagaacc

SEQ ID NO: 9332 - DNA, 20 bp, Artificial Sequence
  sgRNA
gtatcttagggaatactact

SEQ ID NO: 9333 - DNA, 20 bp, Artificial Sequence
  sgRNA
caccctcgaccagcccagtc

SEQ ID NO: 9334 - DNA, 20 bp, Artificial Sequence
  sgRNA
gaggcacctgcctcgctaat

SEQ ID NO: 9335 - DNA, 20 bp, Artificial Sequence
  sgRNA
cgctggactcctcagtctcc

SEQ ID NO: 9336 - DNA, 20 bp, Artificial Sequence
  sgRNA
tcttctgtgcctcctcattc

SEQ ID NO: 9337 - DNA, 20 bp, Artificial Sequence
  sgRNA
ccactaactagagtgattat

SEQ ID NO: 9338 - DNA, 20 bp, Artificial Sequence
  sgRNA
gtttgaactctgtgagttca

SEQ ID NO: 9339 - DNA, 20 bp, Artificial Sequence
  sgRNA
tgaggttccggcttctttaa

SEQ ID NO: 9340 - DNA, 20 bp, Artificial Sequence
  sgRNA
tattcagagggaagttggca

SEQ ID NO: 9341 - DNA, 20 bp, Artificial Sequence
  sgRNA
ggatcaatatcactcacatg

SEQ ID NO: 9342 - DNA, 20 bp, Artificial Sequence
  sgRNA
aggctatgagggtaagagcc

SEQ ID NO: 9343 - DNA, 20 bp, Artificial Sequence
  sgRNA
tccgccgtgactttcgcccg

SEQ ID NO: 9344 - DNA, 20 bp, Artificial Sequence
  sgRNA
tgcaccaaatctctcgagtt

SEQ ID NO: 9345 - DNA, 20 bp, Artificial Sequence
  sgRNA
gcagcgagcacacctgggcg

SEQ ID NO: 9346 - DNA, 20 bp, Artificial Sequence
  sgRNA
agagatttggtttgttaaag

SEQ ID NO: 9347 - DNA, 20 bp, Artificial Sequence
  sgRNA
ccgtcctgggccacttgtcc

SEQ ID NO: 9348 - DNA, 20 bp, Artificial Sequence
  sgRNA
agcaggttagtgggcgccac

SEQ ID NO: 9349 - DNA, 20 bp, Artificial Sequence
  sgRNA
tgggaagctaagaccagaag

SEQ ID NO: 9350 - DNA, 20 bp, Artificial Sequence
  sgRNA
caccacctccctgagcctag

SEQ ID NO: 9351 - DNA, 20 bp, Artificial Sequence
  sgRNA
ctttacatatgcagtcccac

SEQ ID NO: 9352 - DNA, 20 bp, Artificial Sequence
  sgRNA
ctggcaggcgcacctggagc

SEQ ID NO: 9353 - DNA, 20 bp, Artificial Sequence
  sgRNA
tttctgacttcctgtcagag

SEQ ID NO: 9354 - DNA, 20 bp, Artificial Sequence
  sgRNA
gggtgaaccaaaccagtttg

SEQ ID NO: 9355 - DNA, 20 bp, Artificial Sequence
  sgRNA
cgggaatgccgcgccgtggg

SEQ ID NO: 9356 - DNA, 20 bp, Artificial Sequence
  sgRNA
ctttgtctggttctgttgtg

SEQ ID NO: 9357 - DNA, 20 bp, Artificial Sequence
  sgRNA
gccaggactggctcggtcgc

SEQ ID NO: 9358 - DNA, 20 bp, Artificial Sequence
  sgRNA
aaacttatcccatcaaatag

SEQ ID NO: 9359 - DNA, 20 bp, Artificial Sequence
  sgRNA
tcttctctcggttaatgtct

SEQ ID NO: 9360 - DNA, 20 bp, Artificial Sequence
  sgRNA
aggactggacgactgagaga

SEQ ID NO: 9361 - DNA, 20 bp, Artificial Sequence
  sgRNA
ggtacttggagctgaaacct

SEQ ID NO: 9362 - DNA, 20 bp, Artificial Sequence
  sgRNA
atgtgtgagcacagacttcc

SEQ ID NO: 9363 - DNA, 20 bp, Artificial Sequence
  sgRNA
ccgcccaatctcgggtgtcc

SEQ ID NO: 9364 - DNA, 20 bp, Artificial Sequence
  sgRNA
ccagattggtgttaagagga

SEQ ID NO: 9365 - DNA, 20 bp, Artificial Sequence
  sgRNA
agcttcggaggacaggctgt

SEQ ID NO: 9366 - DNA, 20 bp, Artificial Sequence
  sgRNA
gcagctttggtgtccgggag

SEQ ID NO: 9367 - DNA, 20 bp, Artificial Sequence
  sgRNA
ccttcagagtgtatcctcta

SEQ ID NO: 9368 - DNA, 20 bp, Artificial Sequence
  sgRNA
tcagctgacctgagtcaagc

SEQ ID NO: 9369 - DNA, 20 bp, Artificial Sequence
  sgRNA
gggcaatgcgggtccagcca

SEQ ID NO: 9370 - DNA, 20 bp, Artificial Sequence
  sgRNA
aaacggcgagagggcgggac

SEQ ID NO: 9371 - DNA, 20 bp, Artificial Sequence
  sgRNA
gcagtgtgatggttggagcg

SEQ ID NO: 9372 - DNA, 20 bp, Artificial Sequence
  sgRNA
gcccggatctcatttcgtac

SEQ ID NO: 9373 - DNA, 20 bp, Artificial Sequence
  sgRNA
caaagcccattaagaagtgt

SEQ ID NO: 9374 - DNA, 20 bp, Artificial Sequence
  sgRNA
cccacctccgcgattgcggg

SEQ ID NO: 9375 - DNA, 20 bp, Artificial Sequence
  sgRNA
acctaacaagtgtaaggccc

SEQ ID NO: 9376 - DNA, 20 bp, Artificial Sequence
  sgRNA
aggagagaatccgcagcact

SEQ ID NO: 9377 - DNA, 20 bp, Artificial Sequence
  sgRNA
cccgagccagaggtgaggga

SEQ ID NO: 9378 - DNA, 20 bp, Artificial Sequence
  sgRNA
ccaagcggaccctattctgg

SEQ ID NO: 9379 - DNA, 20 bp, Artificial Sequence
  sgRNA
aggctaatcagccttgggtg

SEQ ID NO: 9380 - DNA, 20 bp, Artificial Sequence
  sgRNA
ctcggagaacgagggaagcc

SEQ ID NO: 9381 - DNA, 20 bp, Artificial Sequence
  sgRNA
gtggccacgcctctcctcag

SEQ ID NO: 9382 - DNA, 20 bp, Artificial Sequence
  sgRNA
ttagcatgtgagcgcgaccc

SEQ ID NO: 9383 - DNA, 20 bp, Artificial Sequence
  sgRNA
ctgatggtttggcttctgat

SEQ ID NO: 9384 - DNA, 20 bp, Artificial Sequence
  sgRNA
gggtaaggcggccgggtagc

SEQ ID NO: 9385 - DNA, 20 bp, Artificial Sequence
  sgRNA
gcaggcggtgggtgtagcaa

SEQ ID NO: 9386 - DNA, 20 bp, Artificial Sequence
  sgRNA
cgtacaacatcctcgctgct

SEQ ID NO: 9387 - DNA, 20 bp, Artificial Sequence
  sgRNA
gccgaccagccgctacgaag

SEQ ID NO: 9388 - DNA, 20 bp, Artificial Sequence
  sgRNA
agatgtgaggtcctgtgtcc

SEQ ID NO: 9389 - DNA, 20 bp, Artificial Sequence
  sgRNA
gggagtccggtgggaagtta

SEQ ID NO: 9390 - DNA, 20 bp, Artificial Sequence
  sgRNA
tttggatgtgggctggcagc

SEQ ID NO: 9391 - DNA, 20 bp, Artificial Sequence
  sgRNA
agatctagcatgccaagcct

SEQ ID NO: 9392 - DNA, 20 bp, Artificial Sequence
  sgRNA
gtggaaagttgctttcgttg

SEQ ID NO: 9393 - DNA, 20 bp, Artificial Sequence
  sgRNA
gctgctggatgggaaaggaa

SEQ ID NO: 9394 - DNA, 20 bp, Artificial Sequence
  sgRNA
gaaggaagcgtacaattggc

SEQ ID NO: 9395 - DNA, 20 bp, Artificial Sequence
  sgRNA
tgtgcaagtgcctatagcga

SEQ ID NO: 9396 - DNA, 20 bp, Artificial Sequence
  sgRNA
cagctgatgtgagctccttc

SEQ ID NO: 9397 - DNA, 20 bp, Artificial Sequence
  sgRNA
gggcgggctctagctcgaag

SEQ ID NO: 9398 - DNA, 20 bp, Artificial Sequence
  sgRNA
gtcagagaccagagcagtgg

SEQ ID NO: 9399 - DNA, 20 bp, Artificial Sequence
  sgRNA
tctgtcctgccctcacatgt

SEQ ID NO: 9400 - DNA, 20 bp, Artificial Sequence
  sgRNA
cggaggaaatagcggtcccg

SEQ ID NO: 9401 - DNA, 20 bp, Artificial Sequence
  sgRNA
tagcaaagaaccagacagaa

SEQ ID NO: 9402 - DNA, 20 bp, Artificial Sequence
  sgRNA
ctgtgcaactgtagagttgg

SEQ ID NO: 9403 - DNA, 20 bp, Artificial Sequence
  sgRNA
ctcgtctctctcggcggcaa

SEQ ID NO: 9404 - DNA, 20 bp, Artificial Sequence
  sgRNA
agacacgggtgccagcagct

SEQ ID NO: 9405 - DNA, 20 bp, Artificial Sequence
  sgRNA
cctcgcgcgcatgcgtgaca

SEQ ID NO: 9406 - DNA, 20 bp, Artificial Sequence
  sgRNA
actggagatgtccggatgcg

SEQ ID NO: 9407 - DNA, 20 bp, Artificial Sequence
  sgRNA
atttgtcacccgtcttgggc

SEQ ID NO: 9408 - DNA, 20 bp, Artificial Sequence
  sgRNA
cctgggaactcagcattcgt

SEQ ID NO: 9409 - DNA, 20 bp, Artificial Sequence
  sgRNA
ttcttcttgcggtgtcccgg

SEQ ID NO: 9410 - DNA, 20 bp, Artificial Sequence
  sgRNA
cactccttcgtcagatttag

SEQ ID NO: 9411 - DNA, 20 bp, Artificial Sequence
  sgRNA
ccagaactaccatgagcaag

SEQ ID NO: 9412 - DNA, 20 bp, Artificial Sequence
  sgRNA
gcttgcagttcacgtcatca

SEQ ID NO: 9413 - DNA, 20 bp, Artificial Sequence
  sgRNA
gacaaagatctgaacgttat

SEQ ID NO: 9414 - DNA, 20 bp, Artificial Sequence
  sgRNA
agtggctggtgcagaattca

SEQ ID NO: 9415 - DNA, 20 bp, Artificial Sequence
  sgRNA
ttccggctcctggcgtacta

SEQ ID NO: 9416 - DNA, 20 bp, Artificial Sequence
  sgRNA
gggaggaagctctatcaagt

SEQ ID NO: 9417 - DNA, 20 bp, Artificial Sequence
  sgRNA
gggaaatgggaaggcacttc

SEQ ID NO: 9418 - DNA, 20 bp, Artificial Sequence
  sgRNA
agcgctgaattgaacgctgg

SEQ ID NO: 9419 - DNA, 20 bp, Artificial Sequence
  sgRNA
gggacctgcggctccttgcg

SEQ ID NO: 9420 - DNA, 20 bp, Artificial Sequence
  sgRNA
tcgcacgcctgagggtcact

SEQ ID NO: 9421 - DNA, 20 bp, Artificial Sequence
  sgRNA
aacgccactagtgagatgca

SEQ ID NO: 9422 - DNA, 20 bp, Artificial Sequence
  sgRNA
ggctccaccagaccgctccc

SEQ ID NO: 9423 - DNA, 20 bp, Artificial Sequence
  sgRNA
gaagcagcttcggcttgtgt

SEQ ID NO: 9424 - DNA, 20 bp, Artificial Sequence
  sgRNA
caccggcgcttcacccgctg

SEQ ID NO: 9425 - DNA, 20 bp, Artificial Sequence
  sgRNA
ccttgtctctcgcggctgag

SEQ ID NO: 9426 - DNA, 20 bp, Artificial Sequence
  sgRNA
tacgtcagcgtgctgctttc

SEQ ID NO: 9427 - DNA, 20 bp, Artificial Sequence
  sgRNA
gtttggaaggatcactggta

SEQ ID NO: 9428 - DNA, 20 bp, Artificial Sequence
  sgRNA
agttgcacaagacatctaca

SEQ ID NO: 9429 - DNA, 20 bp, Artificial Sequence
  sgRNA
aaagcagatgtcacgagttt

SEQ ID NO: 9430 - DNA, 20 bp, Artificial Sequence
  sgRNA
gatcgcagctgcaagcttgg

SEQ ID NO: 9431 - DNA, 20 bp, Artificial Sequence
  sgRNA
agcagacggttgggcgctgc

SEQ ID NO: 9432 - DNA, 20 bp, Artificial Sequence
  sgRNA
cctaatttctcccttaaatc

SEQ ID NO: 9433 - DNA, 20 bp, Artificial Sequence
  sgRNA
agtgtggctctggaggtttg

SEQ ID NO: 9434 - DNA, 20 bp, Artificial Sequence
  sgRNA
ttcaagcaatcgactgacgt

SEQ ID NO: 9435 - DNA, 20 bp, Artificial Sequence
  sgRNA
ccagtaccgccgagcccaga

SEQ ID NO: 9436 - DNA, 20 bp, Artificial Sequence
  sgRNA
cgcagaacaatgcaagcttg

SEQ ID NO: 9437 - DNA, 20 bp, Artificial Sequence
  sgRNA
gctcaccatgtggcccacac

SEQ ID NO: 9438 - DNA, 20 bp, Artificial Sequence
  sgRNA
aggtttggaaaggttactgg

SEQ ID NO: 9439 - DNA, 20 bp, Artificial Sequence
  sgRNA
acgcgaaaccggataaggac

SEQ ID NO: 9440 - DNA, 20 bp, Artificial Sequence
  sgRNA
cggttaccttcccaggtctg

SEQ ID NO: 9441 - DNA, 20 bp, Artificial Sequence
  sgRNA
ggtctgttctcggcgttgag

SEQ ID NO: 9442 - DNA, 20 bp, Artificial Sequence
  sgRNA
ctgaagaaggcgtgcaggga

SEQ ID NO: 9443 - DNA, 20 bp, Artificial Sequence
  sgRNA
acgtccgggccctcagcctt

SEQ ID NO: 9444 - DNA, 20 bp, Artificial Sequence
  sgRNA
agagccgagagagatgcttg

SEQ ID NO: 9445 - DNA, 20 bp, Artificial Sequence
  sgRNA
tttctgtaaactcgtgctga

SEQ ID NO: 9446 - DNA, 20 bp, Artificial Sequence
  sgRNA
gggctagaaagataggcttg

SEQ ID NO: 9447 - DNA, 20 bp, Artificial Sequence
  sgRNA
cagcaaagcgcccagtctct

SEQ ID NO: 9448 - DNA, 20 bp, Artificial Sequence
  sgRNA
cttcaattctctaggtttgc

SEQ ID NO: 9449 - DNA, 20 bp, Artificial Sequence
  sgRNA
gcctgggagggtctacctat

SEQ ID NO: 9450 - DNA, 20 bp, Artificial Sequence
  sgRNA
cagagtctgtagaacaaagg

SEQ ID NO: 9451 - DNA, 20 bp, Artificial Sequence
  sgRNA
gaggagctcgggcagaaccg

SEQ ID NO: 9452 - DNA, 20 bp, Artificial Sequence
  sgRNA
cccgtgtttggctctgggac

SEQ ID NO: 9453 - DNA, 20 bp, Artificial Sequence
  sgRNA
ataaatatcaggaagtcttg

SEQ ID NO: 9454 - DNA, 20 bp, Artificial Sequence
  sgRNA
tttgggcacatttgttggtg

SEQ ID NO: 9455 - DNA, 20 bp, Artificial Sequence
  sgRNA
gaccaagctccagaaagtga

SEQ ID NO: 9456 - DNA, 20 bp, Artificial Sequence
  sgRNA
gagtctgaatgtgttagctg

SEQ ID NO: 9457 - DNA, 20 bp, Artificial Sequence
  sgRNA
gttccggcagcctttgaatt

SEQ ID NO: 9458 - DNA, 20 bp, Artificial Sequence
  sgRNA
tttctaacagtctcccgctg

SEQ ID NO: 9459 - DNA, 20 bp, Artificial Sequence
  sgRNA
agagtgctcagaagtcaacg

SEQ ID NO: 9460 - DNA, 20 bp, Artificial Sequence
  sgRNA
ctctctggtcctcagcttgg

SEQ ID NO: 9461 - DNA, 20 bp, Artificial Sequence
  sgRNA
gcaagcccagctttgagagc

SEQ ID NO: 9462 - DNA, 20 bp, Artificial Sequence
  sgRNA
tacatttcccagaagcgcgg

SEQ ID NO: 9463 - DNA, 20 bp, Artificial Sequence
  sgRNA
gcgcctcaacagacgatgac

SEQ ID NO: 9464 - DNA, 20 bp, Artificial Sequence
  sgRNA
ttgcccgaccaactacatcc

SEQ ID NO: 9465 - DNA, 20 bp, Artificial Sequence
  sgRNA
tttgtgcaatgctctgtaca

SEQ ID NO: 9466 - DNA, 20 bp, Artificial Sequence
  sgRNA
tttaatcaagcagaacaggg

SEQ ID NO: 9467 - DNA, 20 bp, Artificial Sequence
  sgRNA
gggcccatccagaccacact

SEQ ID NO: 9468 - DNA, 20 bp, Artificial Sequence
  sgRNA
caggtaaacaggtcactcaa

SEQ ID NO: 9469 - DNA, 20 bp, Artificial Sequence
  sgRNA
tcggagaatggaatcttctt

SEQ ID NO: 9470 - DNA, 20 bp, Artificial Sequence
  sgRNA
aatagcaagattcctccgaa

SEQ ID NO: 9471 - DNA, 20 bp, Artificial Sequence
  sgRNA
agcgcaatggccagagcccg

SEQ ID NO: 9472 - DNA, 20 bp, Artificial Sequence
  sgRNA
aataaacgaacttgaccttc

SEQ ID NO: 9473 - DNA, 20 bp, Artificial Sequence
  sgRNA
aagggagccttggtgaagag

SEQ ID NO: 9474 - DNA, 20 bp, Artificial Sequence
  sgRNA
tcagagtagactatgcagag

SEQ ID NO: 9475 - DNA, 20 bp, Artificial Sequence
  sgRNA
aataaggaccaattcatgct

SEQ ID NO: 9476 - DNA, 20 bp, Artificial Sequence
  sgRNA
cacagtctctgagcattcat

SEQ ID NO: 9477 - DNA, 20 bp, Artificial Sequence
  sgRNA
cctgcagcataaacatttcc

SEQ ID NO: 9478 - DNA, 20 bp, Artificial Sequence
  sgRNA
gcgctacggcaagccggagg

SEQ ID NO: 9479 - DNA, 20 bp, Artificial Sequence
  sgRNA
ccctcagggagagccagtcc

SEQ ID NO: 9480 - DNA, 20 bp, Artificial Sequence
  sgRNA
aggcttctcagtaacagatc

SEQ ID NO: 9481 - DNA, 20 bp, Artificial Sequence
  sgRNA
gtgagggccagccggagcct

SEQ ID NO: 9482 - DNA, 20 bp, Artificial Sequence
  sgRNA
atctggcctcattcatgaaa

SEQ ID NO: 9483 - DNA, 20 bp, Artificial Sequence
  sgRNA
agcctcagaggcagatgacg

SEQ ID NO: 9484 - DNA, 20 bp, Artificial Sequence
  sgRNA
gaagaaggcgctagaaccgg

SEQ ID NO: 9485 - DNA, 20 bp, Artificial Sequence
  sgRNA
cccaggctgaggaggcgaaa

SEQ ID NO: 9486 - DNA, 20 bp, Artificial Sequence
  sgRNA
caccggctcaggtggcagag

SEQ ID NO: 9487 - DNA, 20 bp, Artificial Sequence
  sgRNA
agaggtcagggcgcaaactc

SEQ ID NO: 9488 - DNA, 20 bp, Artificial Sequence
  sgRNA
gctgtccaatcatagccaag

SEQ ID NO: 9489 - DNA, 20 bp, Artificial Sequence
  sgRNA
gccgagtctaagctcgctgc

SEQ ID NO: 9490 - DNA, 20 bp, Artificial Sequence
  sgRNA
cccgaatcccgtggtctctg

SEQ ID NO: 9491 - DNA, 20 bp, Artificial Sequence
  sgRNA
aggcggagcaggaggcgagt

SEQ ID NO: 9492 - DNA, 20 bp, Artificial Sequence
  sgRNA
gggctcttcctgaattcggc

SEQ ID NO: 9493 - DNA, 20 bp, Artificial Sequence
  sgRNA
gcagttgtgcaggtctcacg

SEQ ID NO: 9494 - DNA, 20 bp, Artificial Sequence
  sgRNA
acagggagagagcccagcat

SEQ ID NO: 9495 - DNA, 20 bp, Artificial Sequence
  sgRNA
gggcctgcgcgcgaatgcaa

SEQ ID NO: 9496 - DNA, 20 bp, Artificial Sequence
  sgRNA
gcgcgtggtgggagctccct

SEQ ID NO: 9497 - DNA, 20 bp, Artificial Sequence
  sgRNA
aagtccctcgcgccctctgg

SEQ ID NO: 9498 - DNA, 20 bp, Artificial Sequence
  sgRNA
tcagtggtaccgttcaagcg

SEQ ID NO: 9499 - DNA, 20 bp, Artificial Sequence
  sgRNA
atgtccagcactttaactct

SEQ ID NO: 9500 - DNA, 20 bp, Artificial Sequence
  sgRNA
tcagaagagaatacaagtcg

SEQ ID NO: 9501 - DNA, 20 bp, Artificial Sequence
  sgRNA
gaaggcgggcgcgcgcccat

SEQ ID NO: 9502 - DNA, 20 bp, Artificial Sequence
  sgRNA
tcctatcctcccagaggagc

SEQ ID NO: 9503 - DNA, 20 bp, Artificial Sequence
  sgRNA
catgaagggactgcttctac

SEQ ID NO: 9504 - DNA, 20 bp, Artificial Sequence
  sgRNA
gggatgctgctgctttattt

SEQ ID NO: 9505 - DNA, 20 bp, Artificial Sequence
  sgRNA
gggcccggcggacggcgaga

SEQ ID NO: 9506 - DNA, 20 bp, Artificial Sequence
  sgRNA
agagagagagagagagaatg

SEQ ID NO: 9507 - DNA, 20 bp, Artificial Sequence
  sgRNA
ctatatttaagacggttaca

SEQ ID NO: 9508 - DNA, 20 bp, Artificial Sequence
  sgRNA
acataccgctcatgcctcac

SEQ ID NO: 9509 - DNA, 20 bp, Artificial Sequence
  sgRNA
tcgtcagctctggtaggtag

SEQ ID NO: 9510 - DNA, 20 bp, Artificial Sequence
  sgRNA
cagttgcggagagatggttg

SEQ ID NO: 9511 - DNA, 20 bp, Artificial Sequence
  sgRNA
acttagagcgctatgtgccc

SEQ ID NO: 9512 - DNA, 20 bp, Artificial Sequence
  sgRNA
gtgtccgcactgcccttcgc

SEQ ID NO: 9513 - DNA, 20 bp, Artificial Sequence
  sgRNA
gcgcagcgcgaggcgcctcg

SEQ ID NO: 9514 - DNA, 20 bp, Artificial Sequence
  sgRNA
gcccagatagcgcaacttcg

SEQ ID NO: 9515 - DNA, 20 bp, Artificial Sequence
  sgRNA
atcaaattgtagcctcgccc

SEQ ID NO: 9516 - DNA, 20 bp, Artificial Sequence
  sgRNA
tgtcatagagattcagtgct

SEQ ID NO: 9517 - DNA, 20 bp, Artificial Sequence
  sgRNA
ggatgctctgaggacggctc

SEQ ID NO: 9518 - DNA, 20 bp, Artificial Sequence
  sgRNA
gcggcgggctgagtggagag

SEQ ID NO: 9519 - DNA, 20 bp, Artificial Sequence
  sgRNA
cactgtgttcctccagaagt

SEQ ID NO: 9520 - DNA, 20 bp, Artificial Sequence
  sgRNA
ccggtcctgggcgttcacag

SEQ ID NO: 9521 - DNA, 20 bp, Artificial Sequence
  sgRNA
ccttattggtctgggcctcg

SEQ ID NO: 9522 - DNA, 20 bp, Artificial Sequence
  sgRNA
gcgcagtgcggaccaatcag

SEQ ID NO: 9523 - DNA, 20 bp, Artificial Sequence
  sgRNA
gggttggagctgacagcatg

SEQ ID NO: 9524 - DNA, 20 bp, Artificial Sequence
  sgRNA
ctagggcattggaaccacta

SEQ ID NO: 9525 - DNA, 20 bp, Artificial Sequence
  sgRNA
ctataagagtcggccgctgc

SEQ ID NO: 9526 - DNA, 20 bp, Artificial Sequence
  sgRNA
tggtggcaacccgcactgct

SEQ ID NO: 9527 - DNA, 20 bp, Artificial Sequence
  sgRNA
gcgcgctcccgactccctct

SEQ ID NO: 9528 - DNA, 20 bp, Artificial Sequence
  sgRNA
ctttatattcagggtctccc

SEQ ID NO: 9529 - DNA, 20 bp, Artificial Sequence
  sgRNA
gggagcccggcgaaccaata

SEQ ID NO: 9530 - DNA, 20 bp, Artificial Sequence
  sgRNA
cagctggctgaggcacttgg

SEQ ID NO: 9531 - DNA, 20 bp, Artificial Sequence
  sgRNA
gggagctgcgcggttgtgct

SEQ ID NO: 9532 - DNA, 20 bp, Artificial Sequence
  sgRNA
aaatgcgccaagtagccaga

SEQ ID NO: 9533 - DNA, 20 bp, Artificial Sequence
  sgRNA
cgaggagtatgccgcacttc

SEQ ID NO: 9534 - DNA, 20 bp, Artificial Sequence
  sgRNA
gggctgctttacctcccacc

SEQ ID NO: 9535 - DNA, 20 bp, Artificial Sequence
  sgRNA
cttgtcactcagaactgccc

SEQ ID NO: 9536 - DNA, 20 bp, Artificial Sequence
  sgRNA
tccattaattacttggaggg

SEQ ID NO: 9537 - DNA, 20 bp, Artificial Sequence
  sgRNA
ttcgcagacaggcgtgcgga

SEQ ID NO: 9538 - DNA, 20 bp, Artificial Sequence
  sgRNA
agagcggaagttatggcgcg

SEQ ID NO: 9539 - DNA, 20 bp, Artificial Sequence
  sgRNA
tggcctgaccttcgtgtagc

SEQ ID NO: 9540 - DNA, 20 bp, Artificial Sequence
  sgRNA
tccgtcatatcccgtcctcg

SEQ ID NO: 9541 - DNA, 20 bp, Artificial Sequence
  sgRNA
gtcgccgcctccgtgcgcgc

SEQ ID NO: 9542 - DNA, 20 bp, Artificial Sequence
  sgRNA
tttgtcgtggcaggatcatg

SEQ ID NO: 9543 - DNA, 20 bp, Artificial Sequence
  sgRNA
ggaagggtcagggtaggcta

SEQ ID NO: 9544 - DNA, 20 bp, Artificial Sequence
  sgRNA
taactggcaccgccctgcgg

SEQ ID NO: 9545 - DNA, 20 bp, Artificial Sequence
  sgRNA
ccggacaaggatgctgcagc

SEQ ID NO: 9546 - DNA, 20 bp, Artificial Sequence
  sgRNA
ccagacacattgatgtaggg

SEQ ID NO: 9547 - DNA, 20 bp, Artificial Sequence
  sgRNA
ggcgcgagcgaagggacctg

SEQ ID NO: 9548 - DNA, 20 bp, Artificial Sequence
  sgRNA
ttgaacaggatcgtccaagg

SEQ ID NO: 9549 - DNA, 20 bp, Artificial Sequence
  sgRNA
cgccgcggcgcgtcactgcc

SEQ ID NO: 9550 - DNA, 20 bp, Artificial Sequence
  sgRNA
agccctcagctggcggcgtg

SEQ ID NO: 9551 - DNA, 20 bp, Artificial Sequence
  sgRNA
gacagtttgatatgagctcc

SEQ ID NO: 9552 - DNA, 20 bp, Artificial Sequence
  sgRNA
agcggcggtgacgaagcgcc

SEQ ID NO: 9553 - DNA, 20 bp, Artificial Sequence
  sgRNA
cccatgagcccagtgactcc

SEQ ID NO: 9554 - DNA, 20 bp, Artificial Sequence
  sgRNA
tcctgctagaccgccatctg

SEQ ID NO: 9555 - DNA, 20 bp, Artificial Sequence
  sgRNA
tgctacttctggtctatcag

SEQ ID NO: 9556 - DNA, 20 bp, Artificial Sequence
  sgRNA
tcacaaggagcacgagctct

SEQ ID NO: 9557 - DNA, 20 bp, Artificial Sequence
  sgRNA
ctggatcgccggccgaagaa

SEQ ID NO: 9558 - DNA, 20 bp, Artificial Sequence
  sgRNA
agacgtgctctgaagactac

SEQ ID NO: 9559 - DNA, 20 bp, Artificial Sequence
  sgRNA
ctcaagctagaagctatata

SEQ ID NO: 9560 - DNA, 20 bp, Artificial Sequence
  sgRNA
tatataaagagttgtgggtc

SEQ ID NO: 9561 - DNA, 20 bp, Artificial Sequence
  sgRNA
tcaggctacaggctgggcct

SEQ ID NO: 9562 - DNA, 20 bp, Artificial Sequence
  sgRNA
gaggttgccaagaactctct

SEQ ID NO: 9563 - DNA, 20 bp, Artificial Sequence
  sgRNA
tcctgcactcaggaagtggg

SEQ ID NO: 9564 - DNA, 20 bp, Artificial Sequence
  sgRNA
aaatgacaccagggcaacgt

SEQ ID NO: 9565 - DNA, 20 bp, Artificial Sequence
  sgRNA
ggagctaaatccctctgctg

SEQ ID NO: 9566 - DNA, 20 bp, Artificial Sequence
  sgRNA
cagatcatgagtcagcgcgg

SEQ ID NO: 9567 - DNA, 20 bp, Artificial Sequence
  sgRNA
gatgcttccagggcagcccg

SEQ ID NO: 9568 - DNA, 20 bp, Artificial Sequence
  sgRNA
aatgttcttcggtccaatag

SEQ ID NO: 9569 - DNA, 20 bp, Artificial Sequence
  sgRNA
atctgacctggtgacacgtg

SEQ ID NO: 9570 - DNA, 20 bp, Artificial Sequence
  sgRNA
ttcagaggcacgtgcgaagt

SEQ ID NO: 9571 - DNA, 20 bp, Artificial Sequence
  sgRNA
gaagcagcataagaagagag

SEQ ID NO: 9572 - DNA, 20 bp, Artificial Sequence
  sgRNA
cgagcacgacaagagcgcct

SEQ ID NO: 9573 - DNA, 20 bp, Artificial Sequence
  sgRNA
gcatctccaccttgggaggt

SEQ ID NO: 9574 - DNA, 20 bp, Artificial Sequence
  sgRNA
ttgcttccctggtccagaca

SEQ ID NO: 9575 - DNA, 20 bp, Artificial Sequence
  sgRNA
gcgcccgtcgtctaggcgag

SEQ ID NO: 9576 - DNA, 20 bp, Artificial Sequence
  sgRNA
tctttctctgagtttgggag

SEQ ID NO: 9577 - DNA, 20 bp, Artificial Sequence
  sgRNA
aagactggctgagtcaatcc

SEQ ID NO: 9578 - DNA, 20 bp, Artificial Sequence
  sgRNA
ggcccaggagcgcctctgat

SEQ ID NO: 9579 - DNA, 20 bp, Artificial Sequence
  sgRNA
cagggcgaggaagctcggga

SEQ ID NO: 9580 - DNA, 20 bp, Artificial Sequence
  sgRNA
accatcgggccaggcctcgg

SEQ ID NO: 9581 - DNA, 20 bp, Artificial Sequence
  sgRNA
tcagaagcgcagaaacttca

SEQ ID NO: 9582 - DNA, 20 bp, Artificial Sequence
  sgRNA
ctttctgcatacagtggtgg

SEQ ID NO: 9583 - DNA, 20 bp, Artificial Sequence
  sgRNA
atccagggaggcgtgtccag

SEQ ID NO: 9584 - DNA, 20 bp, Artificial Sequence
  sgRNA
gtaatccatcctgagatttg

SEQ ID NO: 9585 - DNA, 20 bp, Artificial Sequence
  sgRNA
tctgggagttgagacacagg

SEQ ID NO: 9586 - DNA, 20 bp, Artificial Sequence
  sgRNA
tgggagggcgcggtacagaa

SEQ ID NO: 9587 - DNA, 20 bp, Artificial Sequence
  sgRNA
ctgctcacagcaggtagaac

SEQ ID NO: 9588 - DNA, 20 bp, Artificial Sequence
  sgRNA
attggcctacagcgtgccgg

SEQ ID NO: 9589 - DNA, 20 bp, Artificial Sequence
  sgRNA
gcggtcggctccaagctggt

SEQ ID NO: 9590 - DNA, 20 bp, Artificial Sequence
  sgRNA
gattgccacgtcgccagcag

SEQ ID NO: 9591 - DNA, 20 bp, Artificial Sequence
  sgRNA
ctgagctcgtgggacagcct

SEQ ID NO: 9592 - DNA, 20 bp, Artificial Sequence
  sgRNA
ttctataccagctgttgctc

SEQ ID NO: 9593 - DNA, 20 bp, Artificial Sequence
  sgRNA
gtcattcaggatgaaggaac

SEQ ID NO: 9594 - DNA, 20 bp, Artificial Sequence
  sgRNA
ggtgaccaccgggcaggaag

SEQ ID NO: 9595 - DNA, 20 bp, Artificial Sequence
  sgRNA
ggctggcaatctgctaacag

SEQ ID NO: 9596 - DNA, 20 bp, Artificial Sequence
  sgRNA
gttctgcggcttgagagtca

SEQ ID NO: 9597 - DNA, 20 bp, Artificial Sequence
  sgRNA
ttcttcctgaaggcagagac

SEQ ID NO: 9598 - DNA, 20 bp, Artificial Sequence
  sgRNA
ctttggcgattggtccagcg

SEQ ID NO: 9599 - DNA, 20 bp, Artificial Sequence
  sgRNA
tcaccgcgggaatcccaggg

SEQ ID NO: 9600 - DNA, 20 bp, Artificial Sequence
  sgRNA
atggcacctgcccacgtgcc

SEQ ID NO: 9601 - DNA, 20 bp, Artificial Sequence
  sgRNA
cggaaccgtggtcccacttc

SEQ ID NO: 9602 - DNA, 20 bp, Artificial Sequence
  sgRNA
cacctgcgcagtacgctgcg

SEQ ID NO: 9603 - DNA, 20 bp, Artificial Sequence
  sgRNA
agttaaagttgctgaaacca

SEQ ID NO: 9604 - DNA, 20 bp, Artificial Sequence
  sgRNA
aagtaagaaggtaaacacct

SEQ ID NO: 9605 - DNA, 20 bp, Artificial Sequence
  sgRNA
gcgcgaagagagacagaagc

SEQ ID NO: 9606 - DNA, 20 bp, Artificial Sequence
  sgRNA
gcctggaaactctggcacca

SEQ ID NO: 9607 - DNA, 20 bp, Artificial Sequence
  sgRNA
cctggccatatgagaagtcc

SEQ ID NO: 9608 - DNA, 20 bp, Artificial Sequence
  sgRNA
ttgaaagggaagctggcgag

SEQ ID NO: 9609 - DNA, 20 bp, Artificial Sequence
  sgRNA
gaggaactaggtaggcgagg

SEQ ID NO: 9610 - DNA, 20 bp, Artificial Sequence
  sgRNA
ttcacttggaagtcccttta

SEQ ID NO: 9611 - DNA, 20 bp, Artificial Sequence
  sgRNA
gccgtgggcggtctagggag

SEQ ID NO: 9612 - DNA, 20 bp, Artificial Sequence
  sgRNA
tgcgagctagacggcggcga

SEQ ID NO: 9613 - DNA, 20 bp, Artificial Sequence
  sgRNA
ccgtagccgccgtgcccttt

SEQ ID NO: 9614 - DNA, 20 bp, Artificial Sequence
  sgRNA
tctttaagcaagaggaggcg

SEQ ID NO: 9615 - DNA, 20 bp, Artificial Sequence
  sgRNA
ccaccggctacccttccggc

SEQ ID NO: 9616 - DNA, 20 bp, Artificial Sequence
  sgRNA
ctcaggcgtgcgacgtgaac

SEQ ID NO: 9617 - DNA, 20 bp, Artificial Sequence
  sgRNA
aaacatacatttgaaggacc

SEQ ID NO: 9618 - DNA, 20 bp, Artificial Sequence
  sgRNA
ctgtgaggatttcacaccca

SEQ ID NO: 9619 - DNA, 20 bp, Artificial Sequence
  sgRNA
cactgcccatcacaaactgc

SEQ ID NO: 9620 - DNA, 20 bp, Artificial Sequence
  sgRNA
accgatccgtctctaggcag

SEQ ID NO: 9621 - DNA, 20 bp, Artificial Sequence
  sgRNA
atcgcctaggactaagggat

SEQ ID NO: 9622 - DNA, 20 bp, Artificial Sequence
  sgRNA
tgggtggagcccaaccacag

SEQ ID NO: 9623 - DNA, 20 bp, Artificial Sequence
  sgRNA
ggctgaggtgagaaccgcga

SEQ ID NO: 9624 - DNA, 20 bp, Artificial Sequence
  sgRNA
tagcaggcgtcaggcaatcc

SEQ ID NO: 9625 - DNA, 20 bp, Artificial Sequence
  sgRNA
gtgcgagcacgagcagtttg

SEQ ID NO: 9626 - DNA, 20 bp, Artificial Sequence
  sgRNA
ttgtgtgcttacgggctccc

SEQ ID NO: 9627 - DNA, 20 bp, Artificial Sequence
  sgRNA
agtggactacaagtcccgtg

SEQ ID NO: 9628 - DNA, 20 bp, Artificial Sequence
  sgRNA
cggtacccattcttccttcc

SEQ ID NO: 9629 - DNA, 20 bp, Artificial Sequence
  sgRNA
tctcgccatgactcagcacg

SEQ ID NO: 9630 - DNA, 20 bp, Artificial Sequence
  sgRNA
ggaacaggtagaagaataca

SEQ ID NO: 9631 - DNA, 20 bp, Artificial Sequence
  sgRNA
gccgctggtccctgaagtcc

SEQ ID NO: 9632 - DNA, 20 bp, Artificial Sequence
  sgRNA
cagacctctaggctccactg

SEQ ID NO: 9633 - DNA, 20 bp, Artificial Sequence
  sgRNA
cccgagggagcggtgggagg

SEQ ID NO: 9634 - DNA, 20 bp, Artificial Sequence
  sgRNA
cccagcgcgtagcctccact

SEQ ID NO: 9635 - DNA, 20 bp, Artificial Sequence
  sgRNA
ccttcacaaacgacacccaa

SEQ ID NO: 9636 - DNA, 20 bp, Artificial Sequence
  sgRNA
gactggctagagagcgactc

SEQ ID NO: 9637 - DNA, 20 bp, Artificial Sequence
  sgRNA
ccctactgcagtgggatacg

SEQ ID NO: 9638 - DNA, 20 bp, Artificial Sequence
  sgRNA
ccgacgtcgctttcacttcc

SEQ ID NO: 9639 - DNA, 20 bp, Artificial Sequence
  sgRNA
agtagcttgctgcatttctc

SEQ ID NO: 9640 - DNA, 20 bp, Artificial Sequence
  sgRNA
aatgtagcattgaaagggcc

SEQ ID NO: 9641 - DNA, 20 bp, Artificial Sequence
  sgRNA
gtgtgtgttggttagtgact

SEQ ID NO: 9642 - DNA, 20 bp, Artificial Sequence
  sgRNA
cttatcaacacatctacctc

SEQ ID NO: 9643 - DNA, 20 bp, Artificial Sequence
  sgRNA
aaccttcctagtttcagaga

SEQ ID NO: 9644 - DNA, 20 bp, Artificial Sequence
  sgRNA
gtaggactgaatatagtttc

SEQ ID NO: 9645 - DNA, 20 bp, Artificial Sequence
  sgRNA
gaccattgggcgtgcggcgg

SEQ ID NO: 9646 - DNA, 20 bp, Artificial Sequence
  sgRNA
ttgccaggaatggcaaacgc

SEQ ID NO: 9647 - DNA, 20 bp, Artificial Sequence
  sgRNA
cggaggagtctagcaaatag

SEQ ID NO: 9648 - DNA, 20 bp, Artificial Sequence
  sgRNA
acttaagttctatgtgattc

SEQ ID NO: 9649 - DNA, 20 bp, Artificial Sequence
  sgRNA
tattacaggagtgtcatcca

SEQ ID NO: 9650 - DNA, 20 bp, Artificial Sequence
  sgRNA
gccgcggaccgtgagacgcg

SEQ ID NO: 9651 - DNA, 20 bp, Artificial Sequence
  sgRNA
tattgtgtggaattgcaggc

SEQ ID NO: 9652 - DNA, 20 bp, Artificial Sequence
  sgRNA
gcgggacggccgcgtgcccg

SEQ ID NO: 9653 - DNA, 20 bp, Artificial Sequence
  sgRNA
aatgcgcggaattctgattc

SEQ ID NO: 9654 - DNA, 20 bp, Artificial Sequence
  sgRNA
ccgcctctgggctgactgca

SEQ ID NO: 9655 - DNA, 20 bp, Artificial Sequence
  sgRNA
atcaaactctcagaacccag

SEQ ID NO: 9656 - DNA, 20 bp, Artificial Sequence
  sgRNA
aaacagtgtaggtggagctg

SEQ ID NO: 9657 - DNA, 20 bp, Artificial Sequence
  sgRNA
ttaacagtttgactaatccg

SEQ ID NO: 9658 - DNA, 20 bp, Artificial Sequence
  sgRNA
gcctttggtaaactcaccaa

SEQ ID NO: 9659 - DNA, 20 bp, Artificial Sequence
  sgRNA
gcctagtgggcaatgaacca

SEQ ID NO: 9660 - DNA, 20 bp, Artificial Sequence
  sgRNA
tgacagcagcaactcaagtc

SEQ ID NO: 9661 - DNA, 20 bp, Artificial Sequence
  sgRNA
cagatgtgctgagttcagca

SEQ ID NO: 9662 - DNA, 20 bp, Artificial Sequence
  sgRNA
catttacatcacaattgggc

SEQ ID NO: 9663 - DNA, 20 bp, Artificial Sequence
  sgRNA
gctcagctttgttggtttcg

SEQ ID NO: 9664 - DNA, 20 bp, Artificial Sequence
  sgRNA
ctctgcctactgtgcagccc

SEQ ID NO: 9665 - DNA, 20 bp, Artificial Sequence
  sgRNA
ggcgtaaggaaggcgtcccg

SEQ ID NO: 9666 - DNA, 20 bp, Artificial Sequence
  sgRNA
tgaggatgaccaacacagca

SEQ ID NO: 9667 - DNA, 20 bp, Artificial Sequence
  sgRNA
agacggacttaagcgacagc

SEQ ID NO: 9668 - DNA, 20 bp, Artificial Sequence
  sgRNA
tttcccgccattgtgagaag

SEQ ID NO: 9669 - DNA, 20 bp, Artificial Sequence
  sgRNA
tttaatgttgggtggtgatg

SEQ ID NO: 9670 - DNA, 20 bp, Artificial Sequence
  sgRNA
acttgagaaataactaggag

SEQ ID NO: 9671 - DNA, 20 bp, Artificial Sequence
  sgRNA
aaactatatgccgccaaatt

SEQ ID NO: 9672 - DNA, 20 bp, Artificial Sequence
  sgRNA
tgggtcttccgcggttgcca

SEQ ID NO: 9673 - DNA, 20 bp, Artificial Sequence
  sgRNA
ctcaggagctgttactctag

SEQ ID NO: 9674 - DNA, 20 bp, Artificial Sequence
  sgRNA
ggacagacaggacatatgag

SEQ ID NO: 9675 - DNA, 20 bp, Artificial Sequence
  sgRNA
tttctgtaagaacagaggaa

SEQ ID NO: 9676 - DNA, 20 bp, Artificial Sequence
  sgRNA
atacagatagattggctaag

SEQ ID NO: 9677 - DNA, 20 bp, Artificial Sequence
  sgRNA
aaatgggcgtggtcgagggc

SEQ ID NO: 9678 - DNA, 20 bp, Artificial Sequence
  sgRNA
tctgctcacgctacatggtg

SEQ ID NO: 9679 - DNA, 20 bp, Artificial Sequence
  sgRNA
gttcatgcatgtgcccactc

SEQ ID NO: 9680 - DNA, 20 bp, Artificial Sequence
  sgRNA
agggcgaggtgtgcgcgaag

SEQ ID NO: 9681 - DNA, 20 bp, Artificial Sequence
  sgRNA
aagtgcggactgcacaggca

SEQ ID NO: 9682 - DNA, 20 bp, Artificial Sequence
  sgRNA
gttatgatggcagaccagaa

SEQ ID NO: 9683 - DNA, 20 bp, Artificial Sequence
  sgRNA
ctgccagcttctccaggttt

SEQ ID NO: 9684 - DNA, 20 bp, Artificial Sequence
  sgRNA
gatctgcgccgctccgccct

SEQ ID NO: 9685 - DNA, 20 bp, Artificial Sequence
  sgRNA
cgccctgagccgaagactcc

SEQ ID NO: 9686 - DNA, 20 bp, Artificial Sequence
  sgRNA
ctccaagtggccaggaaacg

SEQ ID NO: 9687 - DNA, 20 bp, Artificial Sequence
  sgRNA
cgaagaccacacttccgtag

SEQ ID NO: 9688 - DNA, 20 bp, Artificial Sequence
  sgRNA
ggctgcctatcataagtgcc

SEQ ID NO: 9689 - DNA, 20 bp, Artificial Sequence
  sgRNA
cactgggccgcgaccctccc

SEQ ID NO: 9690 - DNA, 20 bp, Artificial Sequence
  sgRNA
gtggaaataggcgcgctccc

SEQ ID NO: 9691 - DNA, 20 bp, Artificial Sequence
  sgRNA
gcaagatcttgtcaataacc

SEQ ID NO: 9692 - DNA, 20 bp, Artificial Sequence
  sgRNA
attgggccgcgccagtgact

SEQ ID NO: 9693 - DNA, 20 bp, Artificial Sequence
  sgRNA
cggaccctaggcgcgggcgg

SEQ ID NO: 9694 - DNA, 20 bp, Artificial Sequence
  sgRNA
caagcccacttattagccag

SEQ ID NO: 9695 - DNA, 20 bp, Artificial Sequence
  sgRNA
aattgcccttctggctagag

SEQ ID NO: 9696 - DNA, 20 bp, Artificial Sequence
  sgRNA
aatctagtgcgcatgctctt

SEQ ID NO: 9697 - DNA, 20 bp, Artificial Sequence
  sgRNA
atatatcccgtggcggagcg

SEQ ID NO: 9698 - DNA, 20 bp, Artificial Sequence
  sgRNA
tcccagttcctcttccactg

SEQ ID NO: 9699 - DNA, 20 bp, Artificial Sequence
  sgRNA
tcggcgaggctggaggacgc

SEQ ID NO: 9700 - DNA, 20 bp, Artificial Sequence
  sgRNA
caactaagaaagctggtgca

SEQ ID NO: 9701 - DNA, 20 bp, Artificial Sequence
  sgRNA
tgggcaagccgatcaaagca

SEQ ID NO: 9702 - DNA, 20 bp, Artificial Sequence
  sgRNA
gggaaatcttcctagggcca

SEQ ID NO: 9703 - DNA, 20 bp, Artificial Sequence
  sgRNA
agtctgtgcgcgcatcccgc

SEQ ID NO: 9704 - DNA, 20 bp, Artificial Sequence
  sgRNA
aaggatgcagggttaggaaa

SEQ ID NO: 9705 - DNA, 20 bp, Artificial Sequence
  sgRNA
aaggcgtggcctcaccagag

SEQ ID NO: 9706 - DNA, 20 bp, Artificial Sequence
  sgRNA
tgcactaatctggcttccaa

SEQ ID NO: 9707 - DNA, 20 bp, Artificial Sequence
  sgRNA
gggaacctgttgcgtcctct

SEQ ID NO: 9708 - DNA, 20 bp, Artificial Sequence
  sgRNA
gaaacgggcttctgtctgat

SEQ ID NO: 9709 - DNA, 20 bp, Artificial Sequence
  sgRNA
tgggctcagaacctatgccc

SEQ ID NO: 9710 - DNA, 20 bp, Artificial Sequence
  sgRNA
aaatcagcgtccgggcacgc

SEQ ID NO: 9711 - DNA, 20 bp, Artificial Sequence
  sgRNA
acctgatacccaacaaagac

SEQ ID NO: 9712 - DNA, 20 bp, Artificial Sequence
  sgRNA
cgccgccgggcaggaaagag

SEQ ID NO: 9713 - DNA, 20 bp, Artificial Sequence
  sgRNA
agttggaacttcagagatga

SEQ ID NO: 9714 - DNA, 20 bp, Artificial Sequence
  sgRNA
tgataagtagggcttcaatc

SEQ ID NO: 9715 - DNA, 20 bp, Artificial Sequence
  sgRNA
accaaagcatccaccctaaa

SEQ ID NO: 9716 - DNA, 20 bp, Artificial Sequence
  sgRNA
gcccgacttccgcttaaccc

SEQ ID NO: 9717 - DNA, 20 bp, Artificial Sequence
  sgRNA
aagccacgcccatcctcaga

SEQ ID NO: 9718 - DNA, 20 bp, Artificial Sequence
  sgRNA
agttgtggtttattgggctt

SEQ ID NO: 9719 - DNA, 20 bp, Artificial Sequence
  sgRNA
gcttgttgctcccgagaagg

SEQ ID NO: 9720 - DNA, 20 bp, Artificial Sequence
  sgRNA
tgtttggatgacacgccttt

SEQ ID NO: 9721 - DNA, 20 bp, Artificial Sequence
  sgRNA
cctactgcagaggcagcacc

SEQ ID NO: 9722 - DNA, 20 bp, Artificial Sequence
  sgRNA
ctggtgattatagagaaata

SEQ ID NO: 9723 - DNA, 20 bp, Artificial Sequence
  sgRNA
tccacctcttcttcctaaca

SEQ ID NO: 9724 - DNA, 20 bp, Artificial Sequence
  sgRNA
tctgaagcaaagtccagaac

SEQ ID NO: 9725 - DNA, 20 bp, Artificial Sequence
  sgRNA
cggccgcgcttggcggctgc

SEQ ID NO: 9726 - DNA, 20 bp, Artificial Sequence
  sgRNA
ttggaggcgactcttactcg

SEQ ID NO: 9727 - DNA, 20 bp, Artificial Sequence
  sgRNA
ttcttagatcttgcgcaaag

SEQ ID NO: 9728 - DNA, 20 bp, Artificial Sequence
  sgRNA
atgggcagggccaaactccc

SEQ ID NO: 9729 - DNA, 20 bp, Artificial Sequence
  sgRNA
tcaggtgagaactcatgtat

SEQ ID NO: 9730 - DNA, 20 bp, Artificial Sequence
  sgRNA
gggtctctctaggtgttagc

SEQ ID NO: 9731 - DNA, 20 bp, Artificial Sequence
  sgRNA
aggtagaactatcaagtctc

SEQ ID NO: 9732 - DNA, 20 bp, Artificial Sequence
  sgRNA
gcccatagcatctgtaaagc

SEQ ID NO: 9733 - DNA, 20 bp, Artificial Sequence
  sgRNA
aagctatttagaaagcgatg

SEQ ID NO: 9734 - DNA, 20 bp, Artificial Sequence
  sgRNA
gggtatcgatgtcagccgga

SEQ ID NO: 9735 - DNA, 20 bp, Artificial Sequence
  sgRNA
agtgggcacgtgacactctc

SEQ ID NO: 9736 - DNA, 20 bp, Artificial Sequence
  sgRNA
cacctttgtaggctccggct

SEQ ID NO: 9737 - DNA, 20 bp, Artificial Sequence
  sgRNA
aagagggatctagtaggagc

SEQ ID NO: 9738 - DNA, 20 bp, Artificial Sequence
  sgRNA
ctcttcttccatgggcctgt

SEQ ID NO: 9739 - DNA, 20 bp, Artificial Sequence
  sgRNA
tgtataacaggtgcaaagtg

SEQ ID NO: 9740 - DNA, 20 bp, Artificial Sequence
  sgRNA
agaagacagcagtggagacg

SEQ ID NO: 9741 - DNA, 20 bp, Artificial Sequence
  sgRNA
ggcatagagcccggtctccg

SEQ ID NO: 9742 - DNA, 20 bp, Artificial Sequence
  sgRNA
ctgtggcttgctcgtcattg

SEQ ID NO: 9743 - DNA, 20 bp, Artificial Sequence
  sgRNA
agcagtggttccactctgcg

SEQ ID NO: 9744 - DNA, 20 bp, Artificial Sequence
  sgRNA
aaagactcatttgtcagtcc

SEQ ID NO: 9745 - DNA, 20 bp, Artificial Sequence
  sgRNA
ggcgttaggtcgccgtcctc

SEQ ID NO: 9746 - DNA, 20 bp, Artificial Sequence
  sgRNA
tgtgtgaatgtgattactcc

SEQ ID NO: 9747 - DNA, 20 bp, Artificial Sequence
  sgRNA
tcactccgcactctgaccaa

SEQ ID NO: 9748 - DNA, 20 bp, Artificial Sequence
  sgRNA
cagtgcagctagggccctaa

SEQ ID NO: 9749 - DNA, 20 bp, Artificial Sequence
  sgRNA
cgcgagagttgaggaagttg

SEQ ID NO: 9750 - DNA, 20 bp, Artificial Sequence
  sgRNA
cctgccaaagctcagctaag

SEQ ID NO: 9751 - DNA, 20 bp, Artificial Sequence
  sgRNA
actaacaacagtggctgagt

SEQ ID NO: 9752 - DNA, 20 bp, Artificial Sequence
  sgRNA
aatagtccagctgtcaactt

SEQ ID NO: 9753 - DNA, 20 bp, Artificial Sequence
  sgRNA
gaaccctgtttgctagggaa

SEQ ID NO: 9754 - DNA, 20 bp, Artificial Sequence
  sgRNA
ctaaggagcacaacgcttgc

SEQ ID NO: 9755 - DNA, 20 bp, Artificial Sequence
  sgRNA
ggaagacgcagccgaccacc

SEQ ID NO: 9756 - DNA, 20 bp, Artificial Sequence
  sgRNA
gacagaaggacacaccaatc

SEQ ID NO: 9757 - DNA, 20 bp, Artificial Sequence
  sgRNA
tctgtttgctttctcctaac

SEQ ID NO: 9758 - DNA, 20 bp, Artificial Sequence
  sgRNA
gggcgtgaccagggagttag

SEQ ID NO: 9759 - DNA, 20 bp, Artificial Sequence
  sgRNA
atcagtgcgtccatcccgcg

SEQ ID NO: 9760 - DNA, 20 bp, Artificial Sequence
  sgRNA
aggctaccatagtaactgag

SEQ ID NO: 9761 - DNA, 20 bp, Artificial Sequence
  sgRNA
tgatgagtcaagtctcaatc

SEQ ID NO: 9762 - DNA, 20 bp, Artificial Sequence
  sgRNA
gaagagagaattcaaccgca

SEQ ID NO: 9763 - DNA, 20 bp, Artificial Sequence
  sgRNA
aagtcttgcaactgttgtga

SEQ ID NO: 9764 - DNA, 20 bp, Artificial Sequence
  sgRNA
agcacatctggaagcgtttc

SEQ ID NO: 9765 - DNA, 20 bp, Artificial Sequence
  sgRNA
tactatggaaatcagagtac

SEQ ID NO: 9766 - DNA, 20 bp, Artificial Sequence
  sgRNA
ggtggcagcgcaacgagggc

SEQ ID NO: 9767 - DNA, 20 bp, Artificial Sequence
  sgRNA
cttcgaaatatctgtctgat

SEQ ID NO: 9768 - DNA, 20 bp, Artificial Sequence
  sgRNA
gccctcagcttcggctgccc

SEQ ID NO: 9769 - DNA, 20 bp, Artificial Sequence
  sgRNA
agcaacggagtctgtttctc

SEQ ID NO: 9770 - DNA, 20 bp, Artificial Sequence
  sgRNA
ttgtgctcgctgtctcatgg

SEQ ID NO: 9771 - DNA, 20 bp, Artificial Sequence
  sgRNA
gaagtgaacagcaggcgacc

SEQ ID NO: 9772 - DNA, 20 bp, Artificial Sequence
  sgRNA
aaggcgtgcgccaccacgct

SEQ ID NO: 9773 - DNA, 20 bp, Artificial Sequence
  sgRNA
agcgggcgggacgtaagggt

SEQ ID NO: 9774 - DNA, 20 bp, Artificial Sequence
  sgRNA
gggcagctaaggtgacatta

SEQ ID NO: 9775 - DNA, 20 bp, Artificial Sequence
  sgRNA
tgaacccgaaaggttagcgt

SEQ ID NO: 9776 - DNA, 20 bp, Artificial Sequence
  sgRNA
cactctaaattcgtccagcc

SEQ ID NO: 9777 - DNA, 20 bp, Artificial Sequence
  sgRNA
acagtaggcctagctggcac

SEQ ID NO: 9778 - DNA, 20 bp, Artificial Sequence
  sgRNA
ggaggctgagaactatggaa

SEQ ID NO: 9779 - DNA, 20 bp, Artificial Sequence
  sgRNA
tccgcccgcccagctcccag

SEQ ID NO: 9780 - DNA, 20 bp, Artificial Sequence
  sgRNA
gagttcataatcctatcaga

SEQ ID NO: 9781 - DNA, 20 bp, Artificial Sequence
  sgRNA
agtaggtagcccagtccgtg

SEQ ID NO: 9782 - DNA, 20 bp, Artificial Sequence
  sgRNA
acgtggtgctctcgcgagag

SEQ ID NO: 9783 - DNA, 20 bp, Artificial Sequence
  sgRNA
aatagctctgaagagttcat

SEQ ID NO: 9784 - DNA, 20 bp, Artificial Sequence
  sgRNA
aagcaagtctgtaaagagga

SEQ ID NO: 9785 - DNA, 20 bp, Artificial Sequence
  sgRNA
cagtgctttccaagcgcgta

SEQ ID NO: 9786 - DNA, 20 bp, Artificial Sequence
  sgRNA
ctcagccctgtgtccgtgcc

SEQ ID NO: 9787 - DNA, 20 bp, Artificial Sequence
  sgRNA
ctcagattggaggaaattaa

SEQ ID NO: 9788 - DNA, 20 bp, Artificial Sequence
  sgRNA
tccactgggagaaggaggga

SEQ ID NO: 9789 - DNA, 20 bp, Artificial Sequence
  sgRNA
cgtcagctgttctgccaagg

SEQ ID NO: 9790 - DNA, 20 bp, Artificial Sequence
  sgRNA
gattggttgaaagcaagagg

SEQ ID NO: 9791 - DNA, 20 bp, Artificial Sequence
  sgRNA
ttaatgtctgcttcagggct

SEQ ID NO: 9792 - DNA, 20 bp, Artificial Sequence
  sgRNA
ggcctgaggcccattgtgtg

SEQ ID NO: 9793 - DNA, 20 bp, Artificial Sequence
  sgRNA
cggtttcccatagaaacaaa

SEQ ID NO: 9794 - DNA, 20 bp, Artificial Sequence
  sgRNA
attgtactttacgttgggaa

SEQ ID NO: 9795 - DNA, 20 bp, Artificial Sequence
  sgRNA
ggacctaagaggcgcggccg

SEQ ID NO: 9796 - DNA, 20 bp, Artificial Sequence
  sgRNA
ggctctaccctgtgaccaat

SEQ ID NO: 9797 - DNA, 20 bp, Artificial Sequence
  sgRNA
tgttccattagcctcttggc

SEQ ID NO: 9798 - DNA, 20 bp, Artificial Sequence
  sgRNA
tctgagccggagatccgcgc

SEQ ID NO: 9799 - DNA, 20 bp, Artificial Sequence
  sgRNA
cgcccagccggcggagcggg

SEQ ID NO: 9800 - DNA, 20 bp, Artificial Sequence
  sgRNA
gagggaaagttgcacgctga

SEQ ID NO: 9801 - DNA, 20 bp, Artificial Sequence
  sgRNA
gggaaacgtggatctcggcg

SEQ ID NO: 9802 - DNA, 20 bp, Artificial Sequence
  sgRNA
aacgtgctgaagagagacaa

SEQ ID NO: 9803 - DNA, 20 bp, Artificial Sequence
  sgRNA
atgcgaggagaacttctacc

SEQ ID NO: 9804 - DNA, 20 bp, Artificial Sequence
  sgRNA
acatgtgatcaactattaac

SEQ ID NO: 9805 - DNA, 20 bp, Artificial Sequence
  sgRNA
gctaccatcgggccaggcct

SEQ ID NO: 9806 - DNA, 20 bp, Artificial Sequence
  sgRNA
ccatcggccgtgctgggagc

SEQ ID NO: 9807 - DNA, 20 bp, Artificial Sequence
  sgRNA
tttctgcctgattcagttct

SEQ ID NO: 9808 - DNA, 20 bp, Artificial Sequence
  sgRNA
tgtgctggtgaagaggcaag

SEQ ID NO: 9809 - DNA, 20 bp, Artificial Sequence
  sgRNA
ttctgagttcaatgccagct

SEQ ID NO: 9810 - DNA, 20 bp, Artificial Sequence
  sgRNA
gctattggtggccgctctcg

SEQ ID NO: 9811 - DNA, 20 bp, Artificial Sequence
  sgRNA
gagctgttacgaggctccta

SEQ ID NO: 9812 - DNA, 20 bp, Artificial Sequence
  sgRNA
gctacccgtggccacagctg

SEQ ID NO: 9813 - DNA, 20 bp, Artificial Sequence
  sgRNA
gaagcctccgcctgaagatt

SEQ ID NO: 9814 - DNA, 20 bp, Artificial Sequence
  sgRNA
taaagaagtagtaggtctca

SEQ ID NO: 9815 - DNA, 20 bp, Artificial Sequence
  sgRNA
aggccaagtgtccaccgtga

SEQ ID NO: 9816 - DNA, 20 bp, Artificial Sequence
  sgRNA
tcccagggattcaataacct

SEQ ID NO: 9817 - DNA, 20 bp, Artificial Sequence
  sgRNA
cgaggacacataaggttcct

SEQ ID NO: 9818 - DNA, 20 bp, Artificial Sequence
  sgRNA
gacgaccgctcctaaggttt

SEQ ID NO: 9819 - DNA, 20 bp, Artificial Sequence
  sgRNA
cagcgagtacaggcttaggc

SEQ ID NO: 9820 - DNA, 20 bp, Artificial Sequence
  sgRNA
ggagggtgaacgtaagtacc

SEQ ID NO: 9821 - DNA, 20 bp, Artificial Sequence
  sgRNA
ctgcgaatttgggattctat

SEQ ID NO: 9822 - DNA, 20 bp, Artificial Sequence
  sgRNA
gaggtgggtgtgagggaaac

SEQ ID NO: 9823 - DNA, 20 bp, Artificial Sequence
  sgRNA
ttccattactctatgtccct

SEQ ID NO: 9824 - DNA, 20 bp, Artificial Sequence
  sgRNA
cgtaggtcgaggactggcga

SEQ ID NO: 9825 - DNA, 20 bp, Artificial Sequence
  sgRNA
cccgccctgtcaaggcagcc

SEQ ID NO: 9826 - DNA, 20 bp, Artificial Sequence
  sgRNA
aaaggaaacacttggccttt

SEQ ID NO: 9827 - DNA, 20 bp, Artificial Sequence
  sgRNA
gggtcctagagaccgctccg

SEQ ID NO: 9828 - DNA, 20 bp, Artificial Sequence
  sgRNA
ggcgggaccacacttggcgc

SEQ ID NO: 9829 - DNA, 20 bp, Artificial Sequence
  sgRNA
gcgtcctggatactttagga

SEQ ID NO: 9830 - DNA, 20 bp, Artificial Sequence
  sgRNA
ttagcaggagtctgattggc

SEQ ID NO: 9831 - DNA, 20 bp, Artificial Sequence
  sgRNA
gccaacacgcggcgttcccg

SEQ ID NO: 9832 - DNA, 20 bp, Artificial Sequence
  sgRNA
tatctgcgactccagcgcgg

SEQ ID NO: 9833 - DNA, 20 bp, Artificial Sequence
  sgRNA
aaagaggaccggagtcgtcg

SEQ ID NO: 9834 - DNA, 20 bp, Artificial Sequence
  sgRNA
caggaaggaggaactcaaga

SEQ ID NO: 9835 - DNA, 20 bp, Artificial Sequence
  sgRNA
gagcttccttctttcaaacc

SEQ ID NO: 9836 - DNA, 20 bp, Artificial Sequence
  sgRNA
tcagccgagctcaggtgccc

SEQ ID NO: 9837 - DNA, 20 bp, Artificial Sequence
  sgRNA
ctctcttagccttgagctgg

SEQ ID NO: 9838 - DNA, 20 bp, Artificial Sequence
  sgRNA
agtcccagttaaccctttcc

SEQ ID NO: 9839 - DNA, 20 bp, Artificial Sequence
  sgRNA
ttgggccctcctaatacatg

SEQ ID NO: 9840 - DNA, 20 bp, Artificial Sequence
  sgRNA
gcaagcgcaatgaagctcgc

SEQ ID NO: 9841 - DNA, 20 bp, Artificial Sequence
  sgRNA
acagtcgggcccaaccacag

SEQ ID NO: 9842 - DNA, 20 bp, Artificial Sequence
  sgRNA
gccgacctgaacaccggcac

SEQ ID NO: 9843 - DNA, 20 bp, Artificial Sequence
  sgRNA
gcatcacgtgggccaaggag

SEQ ID NO: 9844 - DNA, 20 bp, Artificial Sequence
  sgRNA
ggctaattctggtttgtcag

SEQ ID NO: 9845 - DNA, 20 bp, Artificial Sequence
  sgRNA
cacaaggtagtgttgacaga

SEQ ID NO: 9846 - DNA, 20 bp, Artificial Sequence
  sgRNA
aaagaaaggagcatgatgat

SEQ ID NO: 9847 - DNA, 20 bp, Artificial Sequence
  sgRNA
gctacttcgatagcatgtgc

SEQ ID NO: 9848 - DNA, 20 bp, Artificial Sequence
  sgRNA
tcttagtctcgtcgtacgat

SEQ ID NO: 9849 - DNA, 20 bp, Artificial Sequence
  sgRNA
cgcccaccgaaactccacag

SEQ ID NO: 9850 - DNA, 20 bp, Artificial Sequence
  sgRNA
ctctatacccaggattcttc

SEQ ID NO: 9851 - DNA, 20 bp, Artificial Sequence
  sgRNA
agcgcactgggcgtggttag

SEQ ID NO: 9852 - DNA, 20 bp, Artificial Sequence
  sgRNA
gcacacctacctctccctca

SEQ ID NO: 9853 - DNA, 20 bp, Artificial Sequence
  sgRNA
aattgaactggtggcatatc

SEQ ID NO: 9854 - DNA, 20 bp, Artificial Sequence
  sgRNA
ttgagtaggtgtagccttgt

SEQ ID NO: 9855 - DNA, 20 bp, Artificial Sequence
  sgRNA
ctctgcacagggcaggctgg

SEQ ID NO: 9856 - DNA, 20 bp, Artificial Sequence
  sgRNA
cagccaatcggaggccacag

SEQ ID NO: 9857 - DNA, 20 bp, Artificial Sequence
  sgRNA
agctttgcccaccgtgctcc

SEQ ID NO: 9858 - DNA, 20 bp, Artificial Sequence
  sgRNA
aggcaggcccgacgcgcctg

SEQ ID NO: 9859 - DNA, 20 bp, Artificial Sequence
  sgRNA
aggaagaaagcagatgcgac

SEQ ID NO: 9860 - DNA, 20 bp, Artificial Sequence
  sgRNA
tgcaagcctcacactcgctg

SEQ ID NO: 9861 - DNA, 20 bp, Artificial Sequence
  sgRNA
tccgaccgatgctcgatgct

SEQ ID NO: 9862 - DNA, 20 bp, Artificial Sequence
  sgRNA
cgggacccgcgatggcctgc

SEQ ID NO: 9863 - DNA, 20 bp, Artificial Sequence
  sgRNA
gcacctcagacagctcccgc

SEQ ID NO: 9864 - DNA, 20 bp, Artificial Sequence
  sgRNA
gcacgtgcagtgagaattgc

SEQ ID NO: 9865 - DNA, 20 bp, Artificial Sequence
  sgRNA
ctaactgcagtgagccgcca

SEQ ID NO: 9866 - DNA, 20 bp, Artificial Sequence
  sgRNA
cttcatgtaataacttctcc

SEQ ID NO: 9867 - DNA, 20 bp, Artificial Sequence
  sgRNA
taactgagtaagggattaac

SEQ ID NO: 9868 - DNA, 20 bp, Artificial Sequence
  sgRNA
ccgccatcttgtcattgagt

SEQ ID NO: 9869 - DNA, 20 bp, Artificial Sequence
  sgRNA
cttggcggctactctggacc

SEQ ID NO: 9870 - DNA, 20 bp, Artificial Sequence
  sgRNA
aaccgcgggcactcgcccac

SEQ ID NO: 9871 - DNA, 20 bp, Artificial Sequence
  sgRNA
catctcgtgcgtaagatcca

SEQ ID NO: 9872 - DNA, 20 bp, Artificial Sequence
  sgRNA
ggaggcggaagttcggcaag

SEQ ID NO: 9873 - DNA, 20 bp, Artificial Sequence
  sgRNA
gccaggctgcccgtcaaccc

SEQ ID NO: 9874 - DNA, 20 bp, Artificial Sequence
  sgRNA
tgcagagttgcatctaaccc

SEQ ID NO: 9875 - DNA, 20 bp, Artificial Sequence
  sgRNA
tggaatttcgagctgctgat

SEQ ID NO: 9876 - DNA, 20 bp, Artificial Sequence
  sgRNA
ctcagatctagttgcatgat

SEQ ID NO: 9877 - DNA, 20 bp, Artificial Sequence
  sgRNA
aagttctctcccagctctct

SEQ ID NO: 9878 - DNA, 20 bp, Artificial Sequence
  sgRNA
agaatggagaagctcctaag

SEQ ID NO: 9879 - DNA, 20 bp, Artificial Sequence
  sgRNA
ggctgtcacgtgataggctt

SEQ ID NO: 9880 - DNA, 20 bp, Artificial Sequence
  sgRNA
cctggaaatggctagcttgt

SEQ ID NO: 9881 - DNA, 20 bp, Artificial Sequence
  sgRNA
acacaggcgcgcggcgagcc

SEQ ID NO: 9882 - DNA, 20 bp, Artificial Sequence
  sgRNA
gcaacccttagaaacacttc

SEQ ID NO: 9883 - DNA, 20 bp, Artificial Sequence
  sgRNA
cacctcagttcctacagcaa

SEQ ID NO: 9884 - DNA, 20 bp, Artificial Sequence
  sgRNA
aaactgcagttctaaagctc

SEQ ID NO: 9885 - DNA, 20 bp, Artificial Sequence
  sgRNA
gagaagaattagctctacaa

SEQ ID NO: 9886 - DNA, 20 bp, Artificial Sequence
  sgRNA
gcctccaactgcgatggccg

SEQ ID NO: 9887 - DNA, 20 bp, Artificial Sequence
  sgRNA
gtagagcaaggcctgctgag

SEQ ID NO: 9888 - DNA, 20 bp, Artificial Sequence
  sgRNA
tgccctccctccctgcctaa

SEQ ID NO: 9889 - DNA, 20 bp, Artificial Sequence
  sgRNA
ggagaactggtgaagggagg

SEQ ID NO: 9890 - DNA, 20 bp, Artificial Sequence
  sgRNA
gaaagcgactcccagaggta

SEQ ID NO: 9891 - DNA, 20 bp, Artificial Sequence
  sgRNA
gcctgcgtcgtccctacacg

SEQ ID NO: 9892 - DNA, 20 bp, Artificial Sequence
  sgRNA
gcgtcggcgcggacttctcg

SEQ ID NO: 9893 - DNA, 20 bp, Artificial Sequence
  sgRNA
atttattacctccgactccg

SEQ ID NO: 9894 - DNA, 20 bp, Artificial Sequence
  sgRNA
agtttagagggtctgggtgc

SEQ ID NO: 9895 - DNA, 20 bp, Artificial Sequence
  sgRNA
ttcctaggcccttctgcatt

SEQ ID NO: 9896 - DNA, 20 bp, Artificial Sequence
  sgRNA
tccttagggccctactttaa

SEQ ID NO: 9897 - DNA, 20 bp, Artificial Sequence
  sgRNA
aagacctggtctgtgtggtg

SEQ ID NO: 9898 - DNA, 20 bp, Artificial Sequence
  sgRNA
cccaggctgcctgtcacttg

SEQ ID NO: 9899 - DNA, 20 bp, Artificial Sequence
  sgRNA
taactgcactgtggttgatt

SEQ ID NO: 9900 - DNA, 20 bp, Artificial Sequence
  sgRNA
attgtaagaccgggacaatc

SEQ ID NO: 9901 - DNA, 20 bp, Artificial Sequence
  sgRNA
ggcagcattgttacctgcag

SEQ ID NO: 9902 - DNA, 20 bp, Artificial Sequence
  sgRNA
cctagctcggagggatgtca

SEQ ID NO: 9903 - DNA, 20 bp, Artificial Sequence
  sgRNA
gcctttcttgctaagaattg

SEQ ID NO: 9904 - DNA, 20 bp, Artificial Sequence
  sgRNA
gactaagcaggagaggttga

SEQ ID NO: 9905 - DNA, 20 bp, Artificial Sequence
  sgRNA
acgggtcaggccttggttca

SEQ ID NO: 9906 - DNA, 20 bp, Artificial Sequence
  sgRNA
agcgctggaattgctttatg

SEQ ID NO: 9907 - DNA, 20 bp, Artificial Sequence
  sgRNA
ttcccagcagccaacagcag

SEQ ID NO: 9908 - DNA, 20 bp, Artificial Sequence
  sgRNA
gagataccaccgcgccggtg

SEQ ID NO: 9909 - DNA, 20 bp, Artificial Sequence
  sgRNA
agacacgcggaccgcgacag

SEQ ID NO: 9910 - DNA, 20 bp, Artificial Sequence
  sgRNA
gacaccggtgcgtgtcaacc

SEQ ID NO: 9911 - DNA, 20 bp, Artificial Sequence
  sgRNA
agatccttcctcaaagggcc

SEQ ID NO: 9912 - DNA, 20 bp, Artificial Sequence
  sgRNA
taggttcactgctgcccgac

SEQ ID NO: 9913 - DNA, 20 bp, Artificial Sequence
  sgRNA
gggtccttgggacaggttcg

SEQ ID NO: 9914 - DNA, 20 bp, Artificial Sequence
  sgRNA
ccagacccgcgcttagattt

SEQ ID NO: 9915 - DNA, 20 bp, Artificial Sequence
  sgRNA
gacaactgcaaggctttgaa

SEQ ID NO: 9916 - DNA, 20 bp, Artificial Sequence
  sgRNA
cacccttatttatctgtgct

SEQ ID NO: 9917 - DNA, 20 bp, Artificial Sequence
  sgRNA
tggagcacctagctcttagc

SEQ ID NO: 9918 - DNA, 20 bp, Artificial Sequence
  sgRNA
tctgtgacgtcagggacggc

SEQ ID NO: 9919 - DNA, 20 bp, Artificial Sequence
  sgRNA
agtctcggctagtcggtggg

SEQ ID NO: 9920 - DNA, 20 bp, Artificial Sequence
  sgRNA
gtcctatccagttctggctt

SEQ ID NO: 9921 - DNA, 20 bp, Artificial Sequence
  sgRNA
atccagtcagcggaaccgcc

SEQ ID NO: 9922 - DNA, 20 bp, Artificial Sequence
  sgRNA
cgattccaccttattgattt

SEQ ID NO: 9923 - DNA, 20 bp, Artificial Sequence
  sgRNA
cacggttcccacaatactcc

SEQ ID NO: 9924 - DNA, 20 bp, Artificial Sequence
  sgRNA
ttgcagaaacttggtgagat

SEQ ID NO: 9925 - DNA, 20 bp, Artificial Sequence
  sgRNA
acaaacgcagggcggaaata

SEQ ID NO: 9926 - DNA, 20 bp, Artificial Sequence
  sgRNA
ctgagacagtgcggtgacaa

SEQ ID NO: 9927 - DNA, 20 bp, Artificial Sequence
  sgRNA
ggagtatctttagaacatcc

SEQ ID NO: 9928 - DNA, 20 bp, Artificial Sequence
  sgRNA
gccgtgccgcgcgcatgcgc

SEQ ID NO: 9929 - DNA, 20 bp, Artificial Sequence
  sgRNA
gcggcggtcgggccattgtg

SEQ ID NO: 9930 - DNA, 20 bp, Artificial Sequence
  sgRNA
ttccggtaggaaagtgggcg

SEQ ID NO: 9931 - DNA, 20 bp, Artificial Sequence
  sgRNA
agcttggttacgagaacctt

SEQ ID NO: 9932 - DNA, 20 bp, Artificial Sequence
  sgRNA
gcaggaggagcgcagccggg

SEQ ID NO: 9933 - DNA, 20 bp, Artificial Sequence
  sgRNA
aaaccacgacctggctccac

SEQ ID NO: 9934 - DNA, 20 bp, Artificial Sequence
  sgRNA
gctagtatgtcagtttcgag

SEQ ID NO: 9935 - DNA, 20 bp, Artificial Sequence
  sgRNA
taggccagccaatcagaact

SEQ ID NO: 9936 - DNA, 20 bp, Artificial Sequence
  sgRNA
tttctgcgcgcggagcttca

SEQ ID NO: 9937 - DNA, 20 bp, Artificial Sequence
  sgRNA
tacatatgttgttgtgcagc

SEQ ID NO: 9938 - DNA, 20 bp, Artificial Sequence
  sgRNA
tggtagagcttctgaggatc

SEQ ID NO: 9939 - DNA, 20 bp, Artificial Sequence
  sgRNA
tctggtcccggtctccgagc

SEQ ID NO: 9940 - DNA, 20 bp, Artificial Sequence
  sgRNA
ccagttcaaatacagactcc

SEQ ID NO: 9941 - DNA, 20 bp, Artificial Sequence
  sgRNA
cagacggcgagccgcctagg

SEQ ID NO: 9942 - DNA, 20 bp, Artificial Sequence
  sgRNA
tctgcagcgatgacgtcaac

SEQ ID NO: 9943 - DNA, 20 bp, Artificial Sequence
  sgRNA
gacaaacaaataatgctgca

SEQ ID NO: 9944 - DNA, 20 bp, Artificial Sequence
  sgRNA
cagtttctgtagagaaagag

SEQ ID NO: 9945 - DNA, 20 bp, Artificial Sequence
  sgRNA
aaggttcgcgaagtgccgct

SEQ ID NO: 9946 - DNA, 20 bp, Artificial Sequence
  sgRNA
gctcacgcctgcgcgtgcgc

SEQ ID NO: 9947 - DNA, 20 bp, Artificial Sequence
  sgRNA
acggtagcagcgcagcggca

SEQ ID NO: 9948 - DNA, 20 bp, Artificial Sequence
  sgRNA
aacacaatcaagaaacagtt

SEQ ID NO: 9949 - DNA, 20 bp, Artificial Sequence
  sgRNA
atgaaggactctaagcccag

SEQ ID NO: 9950 - DNA, 20 bp, Artificial Sequence
  sgRNA
cgcccactgtatatttagat

SEQ ID NO: 9951 - DNA, 20 bp, Artificial Sequence
  sgRNA
cctaggctgcctaacatgcc

SEQ ID NO: 9952 - DNA, 20 bp, Artificial Sequence
  sgRNA
tcgggaccaatgagctgcgc

SEQ ID NO: 9953 - DNA, 20 bp, Artificial Sequence
  sgRNA
gttcagaggcacaagccagc

SEQ ID NO: 9954 - DNA, 20 bp, Artificial Sequence
  sgRNA
gttaggctcccttgctaagg

SEQ ID NO: 9955 - DNA, 20 bp, Artificial Sequence
  sgRNA
agagcagggcgcgctgtgat

SEQ ID NO: 9956 - DNA, 20 bp, Artificial Sequence
  sgRNA
cggttggttgtgggttcccg

SEQ ID NO: 9957 - DNA, 20 bp, Artificial Sequence
  sgRNA
gaggctccttcctccaagat

SEQ ID NO: 9958 - DNA, 20 bp, Artificial Sequence
  sgRNA
ctggacattctattgtgtcc

SEQ ID NO: 9959 - DNA, 20 bp, Artificial Sequence
  sgRNA
caacacaggcagaggtggcc

SEQ ID NO: 9960 - DNA, 20 bp, Artificial Sequence
  sgRNA
gtcccttccatctgcattgc

SEQ ID NO: 9961 - DNA, 20 bp, Artificial Sequence
  sgRNA
acgtatccactcattaaatg

SEQ ID NO: 9962 - DNA, 20 bp, Artificial Sequence
  sgRNA
gttgctgcaggacgcagtcg

SEQ ID NO: 9963 - DNA, 20 bp, Artificial Sequence
  sgRNA
ggcagggcagtagtagaaag

SEQ ID NO: 9964 - DNA, 20 bp, Artificial Sequence
  sgRNA
cgggcggctggcgagggact

SEQ ID NO: 9965 - DNA, 20 bp, Artificial Sequence
  sgRNA
gtttccgcatacccagcttc

SEQ ID NO: 9966 - DNA, 20 bp, Artificial Sequence
  sgRNA
ggttagcactcgtgattctg

SEQ ID NO: 9967 - DNA, 20 bp, Artificial Sequence
  sgRNA
cttctggcgtggagcgccgc

SEQ ID NO: 9968 - DNA, 20 bp, Artificial Sequence
  sgRNA
ggaggaggagacacctcagc

SEQ ID NO: 9969 - DNA, 20 bp, Artificial Sequence
  sgRNA
ttgaggagggatgagaggag

SEQ ID NO: 9970 - DNA, 20 bp, Artificial Sequence
  sgRNA
atgacacgctggctaatacc

SEQ ID NO: 9971 - DNA, 20 bp, Artificial Sequence
  sgRNA
ccacctgagtcaaacagaac

SEQ ID NO: 9972 - DNA, 20 bp, Artificial Sequence
  sgRNA
cccgggctggaggatcagcg

SEQ ID NO: 9973 - DNA, 20 bp, Artificial Sequence
  sgRNA
cgcgtgtcttctgtaggatg

SEQ ID NO: 9974 - DNA, 20 bp, Artificial Sequence
  sgRNA
ggatcctcatcctaaccaag

SEQ ID NO: 9975 - DNA, 20 bp, Artificial Sequence
  sgRNA
ggtttcctagctacatcttg

SEQ ID NO: 9976 - DNA, 20 bp, Artificial Sequence
  sgRNA
agataactgtgtaagagctc

SEQ ID NO: 9977 - DNA, 20 bp, Artificial Sequence
  sgRNA
cccgcacaatagcggtggga

SEQ ID NO: 9978 - DNA, 20 bp, Artificial Sequence
  sgRNA
ggcgtgctgtcctttgcggc

SEQ ID NO: 9979 - DNA, 20 bp, Artificial Sequence
  sgRNA
aatggcagtctttctttccc

SEQ ID NO: 9980 - DNA, 20 bp, Artificial Sequence
  sgRNA
cagatgaagacacggaagcg

SEQ ID NO: 9981 - DNA, 20 bp, Artificial Sequence
  sgRNA
ctgtcacgcggtctgcttgc

SEQ ID NO: 9982 - DNA, 20 bp, Artificial Sequence
  sgRNA
aaagggaggagacaaacgtt

SEQ ID NO: 9983 - DNA, 20 bp, Artificial Sequence
  sgRNA
tacgcgcttgagtgcgcgag

SEQ ID NO: 9984 - DNA, 20 bp, Artificial Sequence
  sgRNA
ttggaagggagaaagactta

SEQ ID NO: 9985 - DNA, 20 bp, Artificial Sequence
  sgRNA
cgcgcttggaatgcataggc

SEQ ID NO: 9986 - DNA, 20 bp, Artificial Sequence
  sgRNA
tgaactcatctctaagctct

SEQ ID NO: 9987 - DNA, 20 bp, Artificial Sequence
  sgRNA
ggacccaggctctgactaac

SEQ ID NO: 9988 - DNA, 20 bp, Artificial Sequence
  sgRNA
ccgctctccattcataaatc

SEQ ID NO: 9989 - DNA, 20 bp, Artificial Sequence
  sgRNA
gacgcgcatgcgtgtctcca

SEQ ID NO: 9990 - DNA, 20 bp, Artificial Sequence
  sgRNA
ggcctcagagcaggaactaa

SEQ ID NO: 9991 - DNA, 20 bp, Artificial Sequence
  sgRNA
gggcgcgaggaacccaggga

SEQ ID NO: 9992 - DNA, 20 bp, Artificial Sequence
  sgRNA
tttataacgtgtcgttgaga

SEQ ID NO: 9993 - DNA, 20 bp, Artificial Sequence
  sgRNA
aacataagcacccatcagct

SEQ ID NO: 9994 - DNA, 20 bp, Artificial Sequence
  sgRNA
aacatgcgctcctgggaaga

SEQ ID NO: 9995 - DNA, 20 bp, Artificial Sequence
  sgRNA
ggcggcagcgtcgtgaggtg

SEQ ID NO: 9996 - DNA, 20 bp, Artificial Sequence
  sgRNA
tggaatatctcccgccgaga

SEQ ID NO: 9997 - DNA, 20 bp, Artificial Sequence
  sgRNA
ctctccggcatctctagttt

SEQ ID NO: 9998 - DNA, 20 bp, Artificial Sequence
  sgRNA
gacagggtatcctagcggag

SEQ ID NO: 9999 - DNA, 20 bp, Artificial Sequence
  sgRNA
gatgtgatcgcagcggtgat

SEQ ID NO: 10000 - DNA, 20 bp, Artificial Sequence
  sgRNA
cccgcctgcaggccaaagca

SEQ ID NO: 10001 - DNA, 20 bp, Artificial Sequence
  sgRNA
tcggaagcggaactctgccg

SEQ ID NO: 10002 - DNA, 20 bp, Artificial Sequence
  sgRNA
agggacagaaatgatcaatg

SEQ ID NO: 10003 - DNA, 20 bp, Artificial Sequence
  sgRNA
agcattgctagtcctgtccc

SEQ ID NO: 10004 - DNA, 20 bp, Artificial Sequence
  sgRNA
tttcaaacaactatcgcggg

SEQ ID NO: 10005 - DNA, 20 bp, Artificial Sequence
  sgRNA
gggacttgtaggaatactgg

SEQ ID NO: 10006 - DNA, 20 bp, Artificial Sequence
  sgRNA
tcatatcgaaaccaaacata

SEQ ID NO: 10007 - DNA, 20 bp, Artificial Sequence
  sgRNA
gctctcgaccaatcggcgct

SEQ ID NO: 10008 - DNA, 20 bp, Artificial Sequence
  sgRNA
actaattggagcccatgaga

SEQ ID NO: 10009 - DNA, 20 bp, Artificial Sequence
  sgRNA
gccgatggatcttgtcgacg

SEQ ID NO: 10010 - DNA, 20 bp, Artificial Sequence
  sgRNA
ctacagcaagttatttgaag

SEQ ID NO: 10011 - DNA, 20 bp, Artificial Sequence
  sgRNA
gcagagtagggtttcaaagc

SEQ ID NO: 10012 - DNA, 20 bp, Artificial Sequence
  sgRNA
ggaggcgccgagccgtcctg

SEQ ID NO: 10013 - DNA, 20 bp, Artificial Sequence
  sgRNA
gccaaagccttagctggccc

SEQ ID NO: 10014 - DNA, 20 bp, Artificial Sequence
  sgRNA
aacactcctgtcacccattt

SEQ ID NO: 10015 - DNA, 20 bp, Artificial Sequence
  sgRNA
acactcaagagttcttgacc

SEQ ID NO: 10016 - DNA, 20 bp, Artificial Sequence
  sgRNA
gcggctttctctagcccggt

SEQ ID NO: 10017 - DNA, 20 bp, Artificial Sequence
  sgRNA
taacctagtggctgtgttgg

SEQ ID NO: 10018 - DNA, 20 bp, Artificial Sequence
  sgRNA
ccctgtcaaagggcggaaag

SEQ ID NO: 10019 - DNA, 20 bp, Artificial Sequence
  sgRNA
tatcaacactatacagcctg

SEQ ID NO: 10020 - DNA, 20 bp, Artificial Sequence
  sgRNA
ccggaggccgctttcccgtt

SEQ ID NO: 10021 - DNA, 20 bp, Artificial Sequence
  sgRNA
ccggctgcctacagtccgcg

SEQ ID NO: 10022 - DNA, 20 bp, Artificial Sequence
  sgRNA
gggaagatctgaatctctcc

SEQ ID NO: 10023 - DNA, 20 bp, Artificial Sequence
  sgRNA
ggtagacgtggaacaggtaa

SEQ ID NO: 10024 - DNA, 20 bp, Artificial Sequence
  sgRNA
tttccgggcttctagtttct

SEQ ID NO: 10025 - DNA, 20 bp, Artificial Sequence
  sgRNA
cagggctccttgagcgtccc

SEQ ID NO: 10026 - DNA, 20 bp, Artificial Sequence
  sgRNA
ctagagtaggagtatacttt

SEQ ID NO: 10027 - DNA, 20 bp, Artificial Sequence
  sgRNA
ggcctctgaccactttggcc

SEQ ID NO: 10028 - DNA, 20 bp, Artificial Sequence
  sgRNA
gcaaatgacatgtcagtggg

SEQ ID NO: 10029 - DNA, 20 bp, Artificial Sequence
  sgRNA
aggccatgatggactccgcg

SEQ ID NO: 10030 - DNA, 20 bp, Artificial Sequence
  sgRNA
gcggtcaccgcacaagcaag

SEQ ID NO: 10031 - DNA, 20 bp, Artificial Sequence
  sgRNA
ggatgggaggatagtcagag

SEQ ID NO: 10032 - DNA, 20 bp, Artificial Sequence
  sgRNA
agcgaacgctgctttcgacc

SEQ ID NO: 10033 - DNA, 20 bp, Artificial Sequence
  sgRNA
agaccggaagcagacacgga

SEQ ID NO: 10034 - DNA, 20 bp, Artificial Sequence
  sgRNA
aggccgtggaccctggtaag

SEQ ID NO: 10035 - DNA, 20 bp, Artificial Sequence
  sgRNA
tcctaagcgctaaagggaaa

SEQ ID NO: 10036 - DNA, 20 bp, Artificial Sequence
  sgRNA
gttccggcgccatcgcgttt

SEQ ID NO: 10037 - DNA, 20 bp, Artificial Sequence
  sgRNA
tatatctaagcgccctctcg

SEQ ID NO: 10038 - DNA, 20 bp, Artificial Sequence
  sgRNA
tcggtgatggaacacactgt

SEQ ID NO: 10039 - DNA, 20 bp, Artificial Sequence
  sgRNA
ggagaggcccacgtgacgca

SEQ ID NO: 10040 - DNA, 20 bp, Artificial Sequence
  sgRNA
tttacaaacagagctagata

SEQ ID NO: 10041 - DNA, 20 bp, Artificial Sequence
  sgRNA
atgcagacatggagtctctc

SEQ ID NO: 10042 - DNA, 20 bp, Artificial Sequence
  sgRNA
aagggcagggacggtactca

SEQ ID NO: 10043 - DNA, 20 bp, Artificial Sequence
  sgRNA
cctgattggttgccaagagg

SEQ ID NO: 10044 - DNA, 20 bp, Artificial Sequence
  sgRNA
cagaacctccagagagtgtg

SEQ ID NO: 10045 - DNA, 20 bp, Artificial Sequence
  sgRNA
gcacaggacatgatgctcct

SEQ ID NO: 10046 - DNA, 20 bp, Artificial Sequence
  sgRNA
gtggccgaagaggagcgaac

SEQ ID NO: 10047 - DNA, 20 bp, Artificial Sequence
  sgRNA
ctacttgacagaattccaaa

SEQ ID NO: 10048 - DNA, 20 bp, Artificial Sequence
  sgRNA
ttaggagctctcactttgcg

SEQ ID NO: 10049 - DNA, 20 bp, Artificial Sequence
  sgRNA
atgactactctcacctccac

SEQ ID NO: 10050 - DNA, 20 bp, Artificial Sequence
  sgRNA
taacaatgtcctgcgtttcc

SEQ ID NO: 10051 - DNA, 20 bp, Artificial Sequence
  sgRNA
ctgggctggcagtaggacaa

SEQ ID NO: 10052 - DNA, 20 bp, Artificial Sequence
  sgRNA
gtgcgccctgtgctcaggcg

SEQ ID NO: 10053 - DNA, 20 bp, Artificial Sequence
  sgRNA
aattcctgccatgctgccct

SEQ ID NO: 10054 - DNA, 20 bp, Artificial Sequence
  sgRNA
ctcacgagaagacgtagtca

SEQ ID NO: 10055 - DNA, 20 bp, Artificial Sequence
  sgRNA
ggtggagtttccgaccgggc

SEQ ID NO: 10056 - DNA, 20 bp, Artificial Sequence
  sgRNA
cattgttgtgatcactgcac

SEQ ID NO: 10057 - DNA, 20 bp, Artificial Sequence
  sgRNA
ttgaggagtaaatagcacct

SEQ ID NO: 10058 - DNA, 20 bp, Artificial Sequence
  sgRNA
agacgggcccgattggctgc

SEQ ID NO: 10059 - DNA, 20 bp, Artificial Sequence
  sgRNA
aaagcactcagttagctggc

SEQ ID NO: 10060 - DNA, 20 bp, Artificial Sequence
  sgRNA
gctcagcccaagagattgtc

SEQ ID NO: 10061 - DNA, 20 bp, Artificial Sequence
  sgRNA
ctacttgattgtgcctgctg

SEQ ID NO: 10062 - DNA, 20 bp, Artificial Sequence
  sgRNA
agctgggcgactggaaccaa

SEQ ID NO: 10063 - DNA, 20 bp, Artificial Sequence
  sgRNA
ttgtctgctgaaccaaagcg

SEQ ID NO: 10064 - DNA, 20 bp, Artificial Sequence
  sgRNA
gcggcctgccactcacgcgc

SEQ ID NO: 10065 - DNA, 20 bp, Artificial Sequence
  sgRNA
catgtgtttacatatctatc

SEQ ID NO: 10066 - DNA, 20 bp, Artificial Sequence
  sgRNA
agcggcaggttctcaacccg

SEQ ID NO: 10067 - DNA, 20 bp, Artificial Sequence
  sgRNA
aagtaggagcaacttcctca

SEQ ID NO: 10068 - DNA, 20 bp, Artificial Sequence
  sgRNA
cgcagagaactcgagccgga

SEQ ID NO: 10069 - DNA, 20 bp, Artificial Sequence
  sgRNA
tactccaggtacctacaagt

SEQ ID NO: 10070 - DNA, 20 bp, Artificial Sequence
  sgRNA
gagccaatcagagctggcgg

SEQ ID NO: 10071 - DNA, 20 bp, Artificial Sequence
  sgRNA
gcgcgcgcagcttccactcg

SEQ ID NO: 10072 - DNA, 20 bp, Artificial Sequence
  sgRNA
agagtttggagatggtgtcc

SEQ ID NO: 10073 - DNA, 20 bp, Artificial Sequence
  sgRNA
gtatgtgaaatgtatttcgt

SEQ ID NO: 10074 - DNA, 20 bp, Artificial Sequence
  sgRNA
gtgttgttagaaggagaagc

SEQ ID NO: 10075 - DNA, 20 bp, Artificial Sequence
  sgRNA
aactaacaaggtcacactga

SEQ ID NO: 10076 - DNA, 20 bp, Artificial Sequence
  sgRNA
agccctggcgaaggcactac

SEQ ID NO: 10077 - DNA, 20 bp, Artificial Sequence
  sgRNA
tgcgcacaaagccgccacgg

SEQ ID NO: 10078 - DNA, 20 bp, Artificial Sequence
  sgRNA
gaagcgtgaagtacaaggcg

SEQ ID NO: 10079 - DNA, 20 bp, Artificial Sequence
  sgRNA
cggctccttcgttgggatcc

SEQ ID NO: 10080 - DNA, 20 bp, Artificial Sequence
  sgRNA
agtctgtgttgtatcttctc

SEQ ID NO: 10081 - DNA, 20 bp, Artificial Sequence
  sgRNA
tcagctttgcttaggtagtt

SEQ ID NO: 10082 - DNA, 20 bp, Artificial Sequence
  sgRNA
ggacaagtcacgcagagttg

SEQ ID NO: 10083 - DNA, 20 bp, Artificial Sequence
  sgRNA
tcgtgggtctcactcagccg

SEQ ID NO: 10084 - DNA, 20 bp, Artificial Sequence
  sgRNA
ctgtggttgcgctggtgaca

SEQ ID NO: 10085 - DNA, 20 bp, Artificial Sequence
  sgRNA
gaaggatgtgaatgagccag

SEQ ID NO: 10086 - DNA, 20 bp, Artificial Sequence
  sgRNA
acatggaccacattggcctt

SEQ ID NO: 10087 - DNA, 20 bp, Artificial Sequence
  sgRNA
aattcctcagatgggcgagg

SEQ ID NO: 10088 - DNA, 20 bp, Artificial Sequence
  sgRNA
agtatagtaagaactctctt

SEQ ID NO: 10089 - DNA, 20 bp, Artificial Sequence
  sgRNA
tatgatgacgccttgtcctg

SEQ ID NO: 10090 - DNA, 20 bp, Artificial Sequence
  sgRNA
ggatgctttgtcgcgtcgtc

SEQ ID NO: 10091 - DNA, 20 bp, Artificial Sequence
  sgRNA
gacctttaaacagccagcgt

SEQ ID NO: 10092 - DNA, 20 bp, Artificial Sequence
  sgRNA
tagaacccggagcgcttcct

SEQ ID NO: 10093 - DNA, 20 bp, Artificial Sequence
  sgRNA
ggaaggcggtgacgcgctcc

SEQ ID NO: 10094 - DNA, 20 bp, Artificial Sequence
  sgRNA
cagggcgcggagaaagtttg

SEQ ID NO: 10095 - DNA, 20 bp, Artificial Sequence
  sgRNA
gcagcggcacctgtacttgc

SEQ ID NO: 10096 - DNA, 20 bp, Artificial Sequence
  sgRNA
tggaggcgttccttgtttga

SEQ ID NO: 10097 - DNA, 20 bp, Artificial Sequence
  sgRNA
ccagctgcagggctgtgcag

SEQ ID NO: 10098 - DNA, 20 bp, Artificial Sequence
  sgRNA
aagggagagagctctaaggc

SEQ ID NO: 10099 - DNA, 20 bp, Artificial Sequence
  sgRNA
tccaggccacgatccagccc

SEQ ID NO: 10100 - DNA, 20 bp, Artificial Sequence
  sgRNA
agaagttgaaatctagaact

SEQ ID NO: 10101 - DNA, 20 bp, Artificial Sequence
  sgRNA
tcaaccaatacagcaagcct

SEQ ID NO: 10102 - DNA, 20 bp, Artificial Sequence
  sgRNA
ggaagagtgcctgcaaatgg

SEQ ID NO: 10103 - DNA, 20 bp, Artificial Sequence
  sgRNA
gaacagactaacaggccacc

SEQ ID NO: 10104 - DNA, 20 bp, Artificial Sequence
  sgRNA
gggaggcgccacgcggagga

SEQ ID NO: 10105 - DNA, 20 bp, Artificial Sequence
  sgRNA
ctcattgataaataccgccc

SEQ ID NO: 10106 - DNA, 20 bp, Artificial Sequence
  sgRNA
acgcgcctgcccatctcggc

SEQ ID NO: 10107 - DNA, 20 bp, Artificial Sequence
  sgRNA
tcctccgcagtactttattt

SEQ ID NO: 10108 - DNA, 20 bp, Artificial Sequence
  sgRNA
cagcctaagactggcagaca

SEQ ID NO: 10109 - DNA, 20 bp, Artificial Sequence
  sgRNA
tggtgacctggaggacaatg

SEQ ID NO: 10110 - DNA, 20 bp, Artificial Sequence
  sgRNA
gaatgaatcacagtgagagt

SEQ ID NO: 10111 - DNA, 20 bp, Artificial Sequence
  sgRNA
cccgggcgctgagttgggcg

SEQ ID NO: 10112 - DNA, 20 bp, Artificial Sequence
  sgRNA
tctgcgtgggttcccttctc

SEQ ID NO: 10113 - DNA, 20 bp, Artificial Sequence
  sgRNA
acagatgtcatctcttcctt

SEQ ID NO: 10114 - DNA, 20 bp, Artificial Sequence
  sgRNA
tgacagaccaggagagcaag

SEQ ID NO: 10115 - DNA, 20 bp, Artificial Sequence
  sgRNA
gtcatgctccctggacacat

SEQ ID NO: 10116 - DNA, 20 bp, Artificial Sequence
  sgRNA
tgtgacaccagctttcttaa

SEQ ID NO: 10117 - DNA, 20 bp, Artificial Sequence
  sgRNA
ctctaaagggttaaggccta

SEQ ID NO: 10118 - DNA, 20 bp, Artificial Sequence
  sgRNA
gctgagggcagggcttgaat

SEQ ID NO: 10119 - DNA, 20 bp, Artificial Sequence
  sgRNA
agcagaatctgcgcttctcc

SEQ ID NO: 10120 - DNA, 20 bp, Artificial Sequence
  sgRNA
gggcgtcttgggcgagcttg

SEQ ID NO: 10121 - DNA, 20 bp, Artificial Sequence
  sgRNA
attaaacttagggcattgcc

SEQ ID NO: 10122 - DNA, 20 bp, Artificial Sequence
  sgRNA
ctccctcgggttcgagtgat

SEQ ID NO: 10123 - DNA, 20 bp, Artificial Sequence
  sgRNA
tttagggtggagatccagac

SEQ ID NO: 10124 - DNA, 20 bp, Artificial Sequence
  sgRNA
gcagaacccggctgtgcctc

SEQ ID NO: 10125 - DNA, 20 bp, Artificial Sequence
  sgRNA
ggcacgtgcggcgcgtgcgc

SEQ ID NO: 10126 - DNA, 20 bp, Artificial Sequence
  sgRNA
gagatttctcataactttgg

SEQ ID NO: 10127 - DNA, 20 bp, Artificial Sequence
  sgRNA
cgggtaacccacagacttgt

SEQ ID NO: 10128 - DNA, 20 bp, Artificial Sequence
  sgRNA
tcatatgacagctcacgtca

SEQ ID NO: 10129 - DNA, 20 bp, Artificial Sequence
  sgRNA
aagagtcgctcagttcaggg

SEQ ID NO: 10130 - DNA, 20 bp, Artificial Sequence
  sgRNA
aaactccagctaaactcgga

SEQ ID NO: 10131 - DNA, 20 bp, Artificial Sequence
  sgRNA
agacaatagaatgtccagga

SEQ ID NO: 10132 - DNA, 20 bp, Artificial Sequence
  sgRNA
ttgagcgaggcactgactag

SEQ ID NO: 10133 - DNA, 20 bp, Artificial Sequence
  sgRNA
acactcaccagagctactgt

SEQ ID NO: 10134 - DNA, 20 bp, Artificial Sequence
  sgRNA
tcagttccgcagcttaagga

SEQ ID NO: 10135 - DNA, 20 bp, Artificial Sequence
  sgRNA
agcagtaagcacagtgtgcc

SEQ ID NO: 10136 - DNA, 20 bp, Artificial Sequence
  sgRNA
agagagcgggaatgctgttc

SEQ ID NO: 10137 - DNA, 20 bp, Artificial Sequence
  sgRNA
ttgctacgtagcggagagcc

SEQ ID NO: 10138 - DNA, 20 bp, Artificial Sequence
  sgRNA
ggcttcttgaactgattgtg

SEQ ID NO: 10139 - DNA, 20 bp, Artificial Sequence
  sgRNA
ccttctcttcttcatgggac

SEQ ID NO: 10140 - DNA, 20 bp, Artificial Sequence
  sgRNA
gggtgcaagcgccggagacc

SEQ ID NO: 10141 - DNA, 20 bp, Artificial Sequence
  sgRNA
cagaaacataggctcgcccg

SEQ ID NO: 10142 - DNA, 20 bp, Artificial Sequence
  sgRNA
caattggtccctccgagagg

SEQ ID NO: 10143 - DNA, 20 bp, Artificial Sequence
  sgRNA
cgtatctatggactacagga

SEQ ID NO: 10144 - DNA, 20 bp, Artificial Sequence
  sgRNA
aggtttagggtctatggact

SEQ ID NO: 10145 - DNA, 20 bp, Artificial Sequence
  sgRNA
atgcgccgtgcaattggcgc

SEQ ID NO: 10146 - DNA, 20 bp, Artificial Sequence
  sgRNA
tactacttgaaagggcttca

SEQ ID NO: 10147 - DNA, 20 bp, Artificial Sequence
  sgRNA
gtttggcctcctgatgttgg

SEQ ID NO: 10148 - DNA, 20 bp, Artificial Sequence
  sgRNA
cctcccaagcctccaggaca

SEQ ID NO: 10149 - DNA, 20 bp, Artificial Sequence
  sgRNA
tctttggagggcatcatcgc

SEQ ID NO: 10150 - DNA, 20 bp, Artificial Sequence
  sgRNA
gggacgagtggaacatcgcg

SEQ ID NO: 10151 - DNA, 20 bp, Artificial Sequence
  sgRNA
aatctaaagagttgtcccag

SEQ ID NO: 10152 - DNA, 20 bp, Artificial Sequence
  sgRNA
tgcatttgtgagcggattca

SEQ ID NO: 10153 - DNA, 20 bp, Artificial Sequence
  sgRNA
cgagagcgcggctcgcgagt

SEQ ID NO: 10154 - DNA, 20 bp, Artificial Sequence
  sgRNA
ctcgccatcaatcttgacgt

SEQ ID NO: 10155 - DNA, 20 bp, Artificial Sequence
  sgRNA
gactgtcataggacagctct

SEQ ID NO: 10156 - DNA, 20 bp, Artificial Sequence
  sgRNA
tacagttaccctgatgggcg

SEQ ID NO: 10157 - DNA, 20 bp, Artificial Sequence
  sgRNA
caaatctactctttcaatct

SEQ ID NO: 10158 - DNA, 20 bp, Artificial Sequence
  sgRNA
ttctagcgattgttaacgcc

SEQ ID NO: 10159 - DNA, 20 bp, Artificial Sequence
  sgRNA
caccagattgtcagttattc

SEQ ID NO: 10160 - DNA, 20 bp, Artificial Sequence
  sgRNA
accgttggctctgggccttg

SEQ ID NO: 10161 - DNA, 20 bp, Artificial Sequence
  sgRNA
catcacctgctgtgaaatgt

SEQ ID NO: 10162 - DNA, 20 bp, Artificial Sequence
  sgRNA
taattgtgacgcaccaaggc

SEQ ID NO: 10163 - DNA, 20 bp, Artificial Sequence
  sgRNA
aaaccttcgctacccgcacg

SEQ ID NO: 10164 - DNA, 20 bp, Artificial Sequence
  sgRNA
gttagatgggctgggagtgg

SEQ ID NO: 10165 - DNA, 20 bp, Artificial Sequence
  sgRNA
cacacatcccagattgaggg

SEQ ID NO: 10166 - DNA, 20 bp, Artificial Sequence
  sgRNA
gctggcaggaaggtcggctg

SEQ ID NO: 10167 - DNA, 20 bp, Artificial Sequence
  sgRNA
cgaaagcggaaacacctaca

SEQ ID NO: 10168 - DNA, 20 bp, Artificial Sequence
  sgRNA
aacttaggagtctatcctga

SEQ ID NO: 10169 - DNA, 20 bp, Artificial Sequence
  sgRNA
ggtgctgttcgggttgaagg

SEQ ID NO: 10170 - DNA, 20 bp, Artificial Sequence
  sgRNA
ggtagactttagacagactt

SEQ ID NO: 10171 - DNA, 20 bp, Artificial Sequence
  sgRNA
ggagtcacgcctccggttcc

SEQ ID NO: 10172 - DNA, 20 bp, Artificial Sequence
  sgRNA
tcaccgggctgggccactgc

SEQ ID NO: 10173 - DNA, 20 bp, Artificial Sequence
  sgRNA
gctctgttaggaaggcatga

SEQ ID NO: 10174 - DNA, 20 bp, Artificial Sequence
  sgRNA
ttcgataagctctaatgctg

SEQ ID NO: 10175 - DNA, 20 bp, Artificial Sequence
  sgRNA
cagactgcacatcaattata

SEQ ID NO: 10176 - DNA, 20 bp, Artificial Sequence
  sgRNA
ggaagctgggagagggacgg

SEQ ID NO: 10177 - DNA, 20 bp, Artificial Sequence
  sgRNA
ctgagatgaaatggatagag

SEQ ID NO: 10178 - DNA, 20 bp, Artificial Sequence
  sgRNA
gtttcttcccatcaatgtcc

SEQ ID NO: 10179 - DNA, 20 bp, Artificial Sequence
  sgRNA
tcaaagatacactgcctccc

SEQ ID NO: 10180 - DNA, 20 bp, Artificial Sequence
  sgRNA
agggaatttatgcatctaat

SEQ ID NO: 10181 - DNA, 20 bp, Artificial Sequence
  sgRNA
cgcgctcccgcctcggcgta

SEQ ID NO: 10182 - DNA, 20 bp, Artificial Sequence
  sgRNA
tgtctgatgcacagattact

SEQ ID NO: 10183 - DNA, 20 bp, Artificial Sequence
  sgRNA
gaggctgttccctagcgccg

SEQ ID NO: 10184 - DNA, 20 bp, Artificial Sequence
  sgRNA
cagcttcgcctttgcgcaac

SEQ ID NO: 10185 - DNA, 20 bp, Artificial Sequence
  sgRNA
tccatcatgacctttcaagg

SEQ ID NO: 10186 - DNA, 20 bp, Artificial Sequence
  sgRNA
gcggtgactgggacatttcc

SEQ ID NO: 10187 - DNA, 20 bp, Artificial Sequence
  sgRNA
gtctgcaatatgctgggacc

SEQ ID NO: 10188 - DNA, 20 bp, Artificial Sequence
  sgRNA
agagcgaagcttgcgctttg

SEQ ID NO: 10189 - DNA, 20 bp, Artificial Sequence
  sgRNA
aagggttgctgacagatagg

SEQ ID NO: 10190 - DNA, 20 bp, Artificial Sequence
  sgRNA
gcgtaatcttactgcatccc

SEQ ID NO: 10191 - DNA, 20 bp, Artificial Sequence
  sgRNA
agaatagaaaccaccgcctc

SEQ ID NO: 10192 - DNA, 20 bp, Artificial Sequence
  sgRNA
gcagaaagagctcacatttc

SEQ ID NO: 10193 - DNA, 20 bp, Artificial Sequence
  sgRNA
tgcctgtgccggccactggg

SEQ ID NO: 10194 - DNA, 20 bp, Artificial Sequence
  sgRNA
cgagtgacgcggcgccagcc

SEQ ID NO: 10195 - DNA, 20 bp, Artificial Sequence
  sgRNA
agtgagcagcctgacttctc

SEQ ID NO: 10196 - DNA, 20 bp, Artificial Sequence
  sgRNA
aggtctgcacttgtccgctc

SEQ ID NO: 10197 - DNA, 20 bp, Artificial Sequence
  sgRNA
caatcgctgttgccctgccg

SEQ ID NO: 10198 - DNA, 20 bp, Artificial Sequence
  sgRNA
aggcagtgggaatacctctt

SEQ ID NO: 10199 - DNA, 20 bp, Artificial Sequence
  sgRNA
gggcgccaaattcaaatctg

SEQ ID NO: 10200 - DNA, 20 bp, Artificial Sequence
  sgRNA
cctgctcccattcatcaggg

SEQ ID NO: 10201 - DNA, 20 bp, Artificial Sequence
  sgRNA
ggccgggtgctcctaggatc

SEQ ID NO: 10202 - DNA, 20 bp, Artificial Sequence
  sgRNA
cgtgggacaactcaaagtcc

SEQ ID NO: 10203 - DNA, 20 bp, Artificial Sequence
  sgRNA
taagtgtgtgcacgcgcggg

SEQ ID NO: 10204 - DNA, 20 bp, Artificial Sequence
  sgRNA
tgggtttgaaattctctatc

SEQ ID NO: 10205 - DNA, 20 bp, Artificial Sequence
  sgRNA
gggtgattctgagggccagg

SEQ ID NO: 10206 - DNA, 20 bp, Artificial Sequence
  sgRNA
aaaggactgcggtttcccgc

SEQ ID NO: 10207 - DNA, 20 bp, Artificial Sequence
  sgRNA
cacatgtatacagtatttgt

SEQ ID NO: 10208 - DNA, 20 bp, Artificial Sequence
  sgRNA
gggctaagtggctacccgct

SEQ ID NO: 10209 - DNA, 20 bp, Artificial Sequence
  sgRNA
tgcttggcaaggaacgccac

SEQ ID NO: 10210 - DNA, 20 bp, Artificial Sequence
  sgRNA
gttggagctaagcatggaag

SEQ ID NO: 10211 - DNA, 20 bp, Artificial Sequence
  sgRNA
tgtctacaatctcgcgagac

SEQ ID NO: 10212 - DNA, 20 bp, Artificial Sequence
  sgRNA
ggcggcgcctgggcgcgatc

SEQ ID NO: 10213 - DNA, 20 bp, Artificial Sequence
  sgRNA
gggtggtcacaccttaggtt

SEQ ID NO: 10214 - DNA, 20 bp, Artificial Sequence
  sgRNA
gaatggaatctctctagagc

SEQ ID NO: 10215 - DNA, 20 bp, Artificial Sequence
  sgRNA
gccctcccatcaattcgccc

SEQ ID NO: 10216 - DNA, 20 bp, Artificial Sequence
  sgRNA
gcagcggcgggtcggtagag

SEQ ID NO: 10217 - DNA, 20 bp, Artificial Sequence
  sgRNA
ggtcactcggccaagacatc

SEQ ID NO: 10218 - DNA, 20 bp, Artificial Sequence
  sgRNA
gtctgcatggctatggcctc

SEQ ID NO: 10219 - DNA, 20 bp, Artificial Sequence
  sgRNA
tctaagtacctgctctcaac

SEQ ID NO: 10220 - DNA, 20 bp, Artificial Sequence
  sgRNA
gtattcatactcccgccggc

SEQ ID NO: 10221 - DNA, 20 bp, Artificial Sequence
  sgRNA
gcggatcgcgcgacctggac

SEQ ID NO: 10222 - DNA, 20 bp, Artificial Sequence
  sgRNA
tggttagaggtccagggccg

SEQ ID NO: 10223 - DNA, 20 bp, Artificial Sequence
  sgRNA
catcagagcatgcgcctcgc

SEQ ID NO: 10224 - DNA, 20 bp, Artificial Sequence
  sgRNA
attggctccgactatgggcg

SEQ ID NO: 10225 - DNA, 20 bp, Artificial Sequence
  sgRNA
cgcacgtgacccgcagtttg

SEQ ID NO: 10226 - DNA, 20 bp, Artificial Sequence
  sgRNA
tctgtcaagctgtgagacga

SEQ ID NO: 10227 - DNA, 20 bp, Artificial Sequence
  sgRNA
aactaggatgaagcctttga

SEQ ID NO: 10228 - DNA, 20 bp, Artificial Sequence
  sgRNA
aagggagtgtgcggagtcta

SEQ ID NO: 10229 - DNA, 20 bp, Artificial Sequence
  sgRNA
aggtggagtctcaggatagg

SEQ ID NO: 10230 - DNA, 20 bp, Artificial Sequence
  sgRNA
aagtctctacagtcccttcc

SEQ ID NO: 10231 - DNA, 20 bp, Artificial Sequence
  sgRNA
tgcctgaacactgcccgctc

SEQ ID NO: 10232 - DNA, 20 bp, Artificial Sequence
  sgRNA
gtcaaagtaagtactttcca

SEQ ID NO: 10233 - DNA, 20 bp, Artificial Sequence
  sgRNA
ggatgggcctcctgaataag

SEQ ID NO: 10234 - DNA, 20 bp, Artificial Sequence
  sgRNA
gtagaacctaggatccaagc

SEQ ID NO: 10235 - DNA, 20 bp, Artificial Sequence
  sgRNA
tgaggattctgatagcgcac

SEQ ID NO: 10236 - DNA, 20 bp, Artificial Sequence
  sgRNA
gacgcggcggactgaacgct

SEQ ID NO: 10237 - DNA, 20 bp, Artificial Sequence
  sgRNA
acttgcctcttctctactga

SEQ ID NO: 10238 - DNA, 20 bp, Artificial Sequence
  sgRNA
atcttggtgtgacagcgata

SEQ ID NO: 10239 - DNA, 20 bp, Artificial Sequence
  sgRNA
ggtctgccacctgcatatgt

SEQ ID NO: 10240 - DNA, 20 bp, Artificial Sequence
  sgRNA
cctctttctcctggatgacc

SEQ ID NO: 10241 - DNA, 20 bp, Artificial Sequence
  sgRNA
catcccaggtcaccctcgca

SEQ ID NO: 10242 - DNA, 20 bp, Artificial Sequence
  sgRNA
ggctgcctgccttctcggcg

SEQ ID NO: 10243 - DNA, 20 bp, Artificial Sequence
  sgRNA
gaacatgacggctgtgggtg

SEQ ID NO: 10244 - DNA, 20 bp, Artificial Sequence
  sgRNA
gctctctgttgagttatcta

SEQ ID NO: 10245 - DNA, 20 bp, Artificial Sequence
  sgRNA
tggccagcctattaaagagc

SEQ ID NO: 10246 - DNA, 20 bp, Artificial Sequence
  sgRNA
agaggcgtggtcttgcgtag

SEQ ID NO: 10247 - DNA, 20 bp, Artificial Sequence
  sgRNA
tgtgtccgctaaccctaagc

SEQ ID NO: 10248 - DNA, 20 bp, Artificial Sequence
  sgRNA
ggacagagagggtgtcagac

SEQ ID NO: 10249 - DNA, 20 bp, Artificial Sequence
  sgRNA
aggaagcgcagctcagcgcc

SEQ ID NO: 10250 - DNA, 20 bp, Artificial Sequence
  sgRNA
gctgaagtcctgtgtggaat

SEQ ID NO: 10251 - DNA, 20 bp, Artificial Sequence
  sgRNA
ggaagctcttcgcagctggg

SEQ ID NO: 10252 - DNA, 20 bp, Artificial Sequence
  sgRNA
tccgaagcttgttaagaacc

SEQ ID NO: 10253 - DNA, 20 bp, Artificial Sequence
  sgRNA
ggtcatagacagtggagcag

SEQ ID NO: 10254 - DNA, 20 bp, Artificial Sequence
  sgRNA
tcacgcggaggctgtgtcag

SEQ ID NO: 10255 - DNA, 20 bp, Artificial Sequence
  sgRNA
aaccgtatggcgcggctcct

SEQ ID NO: 10256 - DNA, 20 bp, Artificial Sequence
  sgRNA
ggccaggcatagaaagtatg

SEQ ID NO: 10257 - DNA, 20 bp, Artificial Sequence
  sgRNA
gggaccatcccaacaacttc

SEQ ID NO: 10258 - DNA, 20 bp, Artificial Sequence
  sgRNA
agagctcacataaaggacca

SEQ ID NO: 10259 - DNA, 20 bp, Artificial Sequence
  sgRNA
cctggaaggtagacctagag

SEQ ID NO: 10260 - DNA, 20 bp, Artificial Sequence
  sgRNA
cgagtacgtgccgggagtct

SEQ ID NO: 10261 - DNA, 20 bp, Artificial Sequence
  sgRNA
tggaacgtcgctgcgccgcg

SEQ ID NO: 10262 - DNA, 20 bp, Artificial Sequence
  sgRNA
ggaagatgcatgactaagtg

SEQ ID NO: 10263 - DNA, 20 bp, Artificial Sequence
  sgRNA
caacctagtcttagccattt

SEQ ID NO: 10264 - DNA, 20 bp, Artificial Sequence
  sgRNA
ggaaacagacctcgcagcaa

SEQ ID NO: 10265 - DNA, 20 bp, Artificial Sequence
  sgRNA
cggctaagagctcccggcac

SEQ ID NO: 10266 - DNA, 20 bp, Artificial Sequence
  sgRNA
agacaggcagtcataatcat

SEQ ID NO: 10267 - DNA, 20 bp, Artificial Sequence
  sgRNA
agagtgttacgaagtttaaa

SEQ ID NO: 10268 - DNA, 20 bp, Artificial Sequence
  sgRNA
atgtttaagaactgcagttg

SEQ ID NO: 10269 - DNA, 20 bp, Artificial Sequence
  sgRNA
ctgagccagtgcacagtgaa

SEQ ID NO: 10270 - DNA, 20 bp, Artificial Sequence
  sgRNA
aacattcggaactggactga

SEQ ID NO: 10271 - DNA, 20 bp, Artificial Sequence
  sgRNA
tacacatgcgccctgcggcc

SEQ ID NO: 10272 - DNA, 20 bp, Artificial Sequence
  sgRNA
catgtgggaatcacttggca

SEQ ID NO: 10273 - DNA, 20 bp, Artificial Sequence
  sgRNA
gtttgcccgaagcactctgt

SEQ ID NO: 10274 - DNA, 20 bp, Artificial Sequence
  sgRNA
ctgacttaagtggtcctcag

SEQ ID NO: 10275 - DNA, 20 bp, Artificial Sequence
  sgRNA
tagctcggaaggaataggtg

SEQ ID NO: 10276 - DNA, 20 bp, Artificial Sequence
  sgRNA
agtttgttgacactaaacac

SEQ ID NO: 10277 - DNA, 20 bp, Artificial Sequence
  sgRNA
ctaagttgtgtggttcataa

SEQ ID NO: 10278 - DNA, 20 bp, Artificial Sequence
  sgRNA
ggtaaacagagcgcctagag

SEQ ID NO: 10279 - DNA, 20 bp, Artificial Sequence
  sgRNA
tggagttcagaagaggatag

SEQ ID NO: 10280 - DNA, 20 bp, Artificial Sequence
  sgRNA
ccgaccgccgcttagccttt

SEQ ID NO: 10281 - DNA, 20 bp, Artificial Sequence
  sgRNA
ttataggcagcaggcactct

SEQ ID NO: 10282 - DNA, 20 bp, Artificial Sequence
  sgRNA
aacacagaacagcctcttgc

SEQ ID NO: 10283 - DNA, 20 bp, Artificial Sequence
  sgRNA
tggcgctcggtcagggctgg

SEQ ID NO: 10284 - DNA, 20 bp, Artificial Sequence
  sgRNA
aaagacgttcgtcggtacag

SEQ ID NO: 10285 - DNA, 20 bp, Artificial Sequence
  sgRNA
gtgtgtgaagtgcttgtgtc

SEQ ID NO: 10286 - DNA, 20 bp, Artificial Sequence
  sgRNA
aactaaactggtgttctcta

SEQ ID NO: 10287 - DNA, 20 bp, Artificial Sequence
  sgRNA
tagaagacacaccctgaacg

SEQ ID NO: 10288 - DNA, 20 bp, Artificial Sequence
  sgRNA
ggagaagcccatggagctcc

SEQ ID NO: 10289 - DNA, 20 bp, Artificial Sequence
  sgRNA
aacattccacaaagcatgcg

SEQ ID NO: 10290 - DNA, 20 bp, Artificial Sequence
  sgRNA
cagcggaccgggtttcgaaa

SEQ ID NO: 10291 - DNA, 20 bp, Artificial Sequence
  sgRNA
tgggaaataaactagatact

SEQ ID NO: 10292 - DNA, 20 bp, Artificial Sequence
  sgRNA
ggctgtggtttacaccaatg

SEQ ID NO: 10293 - DNA, 20 bp, Artificial Sequence
  sgRNA
aaaggcattaacagcgtgag

SEQ ID NO: 10294 - DNA, 20 bp, Artificial Sequence
  sgRNA
gttcatcaaggcctgcctcc

SEQ ID NO: 10295 - DNA, 20 bp, Artificial Sequence
  sgRNA
ggcaggccgacgcgccatgg

SEQ ID NO: 10296 - DNA, 20 bp, Artificial Sequence
  sgRNA
acttgaggagtccgtgacgc

SEQ ID NO: 10297 - DNA, 20 bp, Artificial Sequence
  sgRNA
aggcgcgaaacccgcaacct

SEQ ID NO: 10298 - DNA, 20 bp, Artificial Sequence
  sgRNA
tcaggcggcagcgttccgat

SEQ ID NO: 10299 - DNA, 20 bp, Artificial Sequence
  sgRNA
cggctgctggcggatcgagc

SEQ ID NO: 10300 - DNA, 20 bp, Artificial Sequence
  sgRNA
gtaaggctagtttacgctag

SEQ ID NO: 10301 - DNA, 20 bp, Artificial Sequence
  sgRNA
tggagtcctttagaagaggc

SEQ ID NO: 10302 - DNA, 20 bp, Artificial Sequence
  sgRNA
ttgcgtcagtctcgggcacg

SEQ ID NO: 10303 - DNA, 20 bp, Artificial Sequence
  sgRNA
gtgcgtagctgcccgggctt

SEQ ID NO: 10304 - DNA, 20 bp, Artificial Sequence
  sgRNA
caactgtttgttgcttcttt

SEQ ID NO: 10305 - DNA, 20 bp, Artificial Sequence
  sgRNA
gcacgatctcctgggattct

SEQ ID NO: 10306 - DNA, 20 bp, Artificial Sequence
  sgRNA
tgaaagacaagttacagcca

SEQ ID NO: 10307 - DNA, 20 bp, Artificial Sequence
  sgRNA
ggaagatagttccgagggtg

SEQ ID NO: 10308 - DNA, 20 bp, Artificial Sequence
  sgRNA
cacactttaacattgaggag

SEQ ID NO: 10309 - DNA, 20 bp, Artificial Sequence
  sgRNA
actgtttatcccaccggtat

SEQ ID NO: 10310 - DNA, 20 bp, Artificial Sequence
  sgRNA
cctagtctagagtggtaccg

SEQ ID NO: 10311 - DNA, 20 bp, Artificial Sequence
  sgRNA
cagtggttgccatagcgacc

SEQ ID NO: 10312 - DNA, 20 bp, Artificial Sequence
  sgRNA
gagaaagcgcggctcagagc

SEQ ID NO: 10313 - DNA, 20 bp, Artificial Sequence
  sgRNA
aatgggcggagactcatcct

SEQ ID NO: 10314 - DNA, 20 bp, Artificial Sequence
  sgRNA
gggcattagaggtgggaggc

SEQ ID NO: 10315 - DNA, 20 bp, Artificial Sequence
  sgRNA
gtgtgggagtctcgcgagag

SEQ ID NO: 10316 - DNA, 20 bp, Artificial Sequence
  sgRNA
tacaatggagtcccaaacag

SEQ ID NO: 10317 - DNA, 20 bp, Artificial Sequence
  sgRNA
cgtaaagacatacgctccgc

SEQ ID NO: 10318 - DNA, 20 bp, Artificial Sequence
  sgRNA
cacacggacagaggcacaac

SEQ ID NO: 10319 - DNA, 20 bp, Artificial Sequence
  sgRNA
gcggctcagcgcgtcaagcc

SEQ ID NO: 10320 - DNA, 20 bp, Artificial Sequence
  sgRNA
gctgcggctgcctctgggag

SEQ ID NO: 10321 - DNA, 20 bp, Artificial Sequence
  sgRNA
gtggagagaagacaagaaag

SEQ ID NO: 10322 - DNA, 20 bp, Artificial Sequence
  sgRNA
tggcagatgcatcccacagg

SEQ ID NO: 10323 - DNA, 20 bp, Artificial Sequence
  sgRNA
aagcccggaaaccacggaaa

SEQ ID NO: 10324 - DNA, 20 bp, Artificial Sequence
  sgRNA
aagagctcccgggaaccgcc

SEQ ID NO: 10325 - DNA, 20 bp, Artificial Sequence
  sgRNA
gccgggaagtgggtcaactg

SEQ ID NO: 10326 - DNA, 20 bp, Artificial Sequence
  sgRNA
cgatactggcgagggcgtcg

SEQ ID NO: 10327 - DNA, 20 bp, Artificial Sequence
  sgRNA
gggttgacactgggaaggtc

SEQ ID NO: 10328 - DNA, 20 bp, Artificial Sequence
  sgRNA
gctctgccagaggcgggatg

SEQ ID NO: 10329 - DNA, 20 bp, Artificial Sequence
  sgRNA
tggcggccggagtagctaat

SEQ ID NO: 10330 - DNA, 20 bp, Artificial Sequence
  sgRNA
tagcagacgcttacggactt

SEQ ID NO: 10331 - DNA, 20 bp, Artificial Sequence
  sgRNA
ccttccgattgggcggcggt

SEQ ID NO: 10332 - DNA, 20 bp, Artificial Sequence
  sgRNA
gcggatatggagaacagaac

SEQ ID NO: 10333 - DNA, 20 bp, Artificial Sequence
  sgRNA
ggagcagcagtggccgtctt

SEQ ID NO: 10334 - DNA, 20 bp, Artificial Sequence
  sgRNA
gccgatagaggagtggccac

SEQ ID NO: 10335 - DNA, 20 bp, Artificial Sequence
  sgRNA
gtcctggcgtaagcgaatct

SEQ ID NO: 10336 - DNA, 20 bp, Artificial Sequence
  sgRNA
cacgacacactgctggtctc

SEQ ID NO: 10337 - DNA, 20 bp, Artificial Sequence
  sgRNA
atccacactgaagacacctc

SEQ ID NO: 10338 - DNA, 20 bp, Artificial Sequence
  sgRNA
tgctaccgttgcgtggagcc

SEQ ID NO: 10339 - DNA, 20 bp, Artificial Sequence
  sgRNA
agatggctttgcataaatgc

SEQ ID NO: 10340 - DNA, 20 bp, Artificial Sequence
  sgRNA
cgtatttgagaagcagtcaa

SEQ ID NO: 10341 - DNA, 20 bp, Artificial Sequence
  sgRNA
aaagcagcggcggcagcggt

SEQ ID NO: 10342 - DNA, 20 bp, Artificial Sequence
  sgRNA
aacacaagttgggcgcagcg

SEQ ID NO: 10343 - DNA, 20 bp, Artificial Sequence
  sgRNA
cggacgtgacacgtgcggcg

SEQ ID NO: 10344 - DNA, 20 bp, Artificial Sequence
  sgRNA
cccagtgacttcacgtgggt

SEQ ID NO: 10345 - DNA, 20 bp, Artificial Sequence
  sgRNA
gttagtgactttactgcatg

SEQ ID NO: 10346 - DNA, 20 bp, Artificial Sequence
  sgRNA
acttcctgtggcgaccctgc

SEQ ID NO: 10347 - DNA, 20 bp, Artificial Sequence
  sgRNA
ttccttgggtttaagagtgt

SEQ ID NO: 10348 - DNA, 20 bp, Artificial Sequence
  sgRNA
taaacaagcccttccgctgc

SEQ ID NO: 10349 - DNA, 20 bp, Artificial Sequence
  sgRNA
accggtggaattgtgtcagc

SEQ ID NO: 10350 - DNA, 20 bp, Artificial Sequence
  sgRNA
acataatcacaaattgatgc

SEQ ID NO: 10351 - DNA, 20 bp, Artificial Sequence
  sgRNA
gtggcgtagaactctttcgc

SEQ ID NO: 10352 - DNA, 20 bp, Artificial Sequence
  sgRNA
tacaggattccaggaagagt

SEQ ID NO: 10353 - DNA, 20 bp, Artificial Sequence
  sgRNA
gcttccacggaccgaccact

SEQ ID NO: 10354 - DNA, 20 bp, Artificial Sequence
  sgRNA
gtcactagttgggagggatg

SEQ ID NO: 10355 - DNA, 20 bp, Artificial Sequence
  sgRNA
ttgcgcactgcgcacgtctg

SEQ ID NO: 10356 - DNA, 20 bp, Artificial Sequence
  sgRNA
catatacccgtgcggaggac

SEQ ID NO: 10357 - DNA, 20 bp, Artificial Sequence
  sgRNA
gcaagctcggctccgaggcg

SEQ ID NO: 10358 - DNA, 20 bp, Artificial Sequence
  sgRNA
gccgcccaacctgacagccc

SEQ ID NO: 10359 - DNA, 20 bp, Artificial Sequence
  sgRNA
gcccacggcccgcgggacaa

SEQ ID NO: 10360 - DNA, 20 bp, Artificial Sequence
  sgRNA
ccgaatgcttgatcgacagc

SEQ ID NO: 10361 - DNA, 20 bp, Artificial Sequence
  sgRNA
gagtcttcaagagagctcct

SEQ ID NO: 10362 - DNA, 20 bp, Artificial Sequence
  sgRNA
taggcaaagaaatggtggcc

SEQ ID NO: 10363 - DNA, 20 bp, Artificial Sequence
  sgRNA
cgtttctgagcgttctgcgc

SEQ ID NO: 10364 - DNA, 20 bp, Artificial Sequence
  sgRNA
atcacaacccagtgcgcaat

SEQ ID NO: 10365 - DNA, 20 bp, Artificial Sequence
  sgRNA
catcttgtgagatcctgcca

SEQ ID NO: 10366 - DNA, 20 bp, Artificial Sequence
  sgRNA
tcaacaacgctgagcacttc

SEQ ID NO: 10367 - DNA, 20 bp, Artificial Sequence
  sgRNA
gagcccggcgatacggccaa

SEQ ID NO: 10368 - DNA, 20 bp, Artificial Sequence
  sgRNA
ctacaaaggaaggagactca

SEQ ID NO: 10369 - DNA, 20 bp, Artificial Sequence
  sgRNA
tgagaaaggtggactacaac

SEQ ID NO: 10370 - DNA, 20 bp, Artificial Sequence
  sgRNA
ggtaagcttagctcggcgtg

SEQ ID NO: 10371 - DNA, 20 bp, Artificial Sequence
  sgRNA
tagcccattaacctagagcc

SEQ ID NO: 10372 - DNA, 20 bp, Artificial Sequence
  sgRNA
gcttgggctacgttccaagt

SEQ ID NO: 10373 - DNA, 20 bp, Artificial Sequence
  sgRNA
ggtctacagggcggagaccc

SEQ ID NO: 10374 - DNA, 20 bp, Artificial Sequence
  sgRNA
agctcagacctgacattctg

SEQ ID NO: 10375 - DNA, 20 bp, Artificial Sequence
  sgRNA
accctctgccaaggattgcc

SEQ ID NO: 10376 - DNA, 20 bp, Artificial Sequence
  sgRNA
tgcacacgtttgatgcttga

SEQ ID NO: 10377 - DNA, 20 bp, Artificial Sequence
  sgRNA
gtataaataggtcagattgt

SEQ ID NO: 10378 - DNA, 20 bp, Artificial Sequence
  sgRNA
cctaaactcagaacccacca

SEQ ID NO: 10379 - DNA, 20 bp, Artificial Sequence
  sgRNA
ataaggcctagacgcgtggc

SEQ ID NO: 10380 - DNA, 20 bp, Artificial Sequence
  sgRNA
cgggccaagcggctaagttc

SEQ ID NO: 10381 - DNA, 20 bp, Artificial Sequence
  sgRNA
aacatcaagtgcttgaaaga

SEQ ID NO: 10382 - DNA, 20 bp, Artificial Sequence
  sgRNA
tttgacctagacgcccacac

SEQ ID NO: 10383 - DNA, 20 bp, Artificial Sequence
  sgRNA
gcagccggacctcgccctcg

SEQ ID NO: 10384 - DNA, 20 bp, Artificial Sequence
  sgRNA
tattcattggtccgggcccg

SEQ ID NO: 10385 - DNA, 20 bp, Artificial Sequence
  sgRNA
aggcccaattcctctacctt

SEQ ID NO: 10386 - DNA, 20 bp, Artificial Sequence
  sgRNA
caagggaagagggaagaaag

SEQ ID NO: 10387 - DNA, 20 bp, Artificial Sequence
  sgRNA
gcccacctgagccgcagact

SEQ ID NO: 10388 - DNA, 20 bp, Artificial Sequence
  sgRNA
gtctagccaacccaactctg

SEQ ID NO: 10389 - DNA, 20 bp, Artificial Sequence
  sgRNA
gagtcagctccgggaccctc

SEQ ID NO: 10390 - DNA, 20 bp, Artificial Sequence
  sgRNA
ttcctttgatttccgtgaaa

SEQ ID NO: 10391 - DNA, 20 bp, Artificial Sequence
  sgRNA
ataaagtccatgcagcccta

SEQ ID NO: 10392 - DNA, 20 bp, Artificial Sequence
  sgRNA
tggcgacctctagaggcgtt

SEQ ID NO: 10393 - DNA, 20 bp, Artificial Sequence
  sgRNA
gacgacggactattggaagg

SEQ ID NO: 10394 - DNA, 20 bp, Artificial Sequence
  sgRNA
tggcggcgattgggcaggcg

SEQ ID NO: 10395 - DNA, 20 bp, Artificial Sequence
  sgRNA
tctcaaagttccaagggtct

SEQ ID NO: 10396 - DNA, 20 bp, Artificial Sequence
  sgRNA
gacgcagggcgctaaattcc

SEQ ID NO: 10397 - DNA, 20 bp, Artificial Sequence
  sgRNA
aaagctgcttcaacaggcta

SEQ ID NO: 10398 - DNA, 20 bp, Artificial Sequence
  sgRNA
aaagcccggaccagctatcc

SEQ ID NO: 10399 - DNA, 20 bp, Artificial Sequence
  sgRNA
tatctttgatccagggtgag

SEQ ID NO: 10400 - DNA, 20 bp, Artificial Sequence
  sgRNA
ctagcagcgggctcagcggt

SEQ ID NO: 10401 - DNA, 20 bp, Artificial Sequence
  sgRNA
agggtgttaagctgcactgt

SEQ ID NO: 10402 - DNA, 20 bp, Artificial Sequence
  sgRNA
gcgcgtcgacttggaggcag

SEQ ID NO: 10403 - DNA, 20 bp, Artificial Sequence
  sgRNA
gctgagcttatggtggcctc

SEQ ID NO: 10404 - DNA, 20 bp, Artificial Sequence
  sgRNA
ggtttggtatgttctaaatt

SEQ ID NO: 10405 - DNA, 20 bp, Artificial Sequence
  sgRNA
cagacgcgagagctgggcgg

SEQ ID NO: 10406 - DNA, 20 bp, Artificial Sequence
  sgRNA
tcgtgacctgcagcggacct

SEQ ID NO: 10407 - DNA, 20 bp, Artificial Sequence
  sgRNA
cgagggacccgagggctctt

SEQ ID NO: 10408 - DNA, 20 bp, Artificial Sequence
  sgRNA
ggcggcggaggcctcaccac

SEQ ID NO: 10409 - DNA, 20 bp, Artificial Sequence
  sgRNA
ctttgtggatgggagcaggg

SEQ ID NO: 10410 - DNA, 20 bp, Artificial Sequence
  sgRNA
cagatcagcatcattcacca

SEQ ID NO: 10411 - DNA, 20 bp, Artificial Sequence
  sgRNA
ccacagcccttctcgttgcc

SEQ ID NO: 10412 - DNA, 20 bp, Artificial Sequence
  sgRNA
agtaagttatccgggaccct

SEQ ID NO: 10413 - DNA, 20 bp, Artificial Sequence
  sgRNA
gacagtgagaagcgcaaacc

SEQ ID NO: 10414 - DNA, 20 bp, Artificial Sequence
  sgRNA
tttcagcagaggcagcaacc

SEQ ID NO: 10415 - DNA, 20 bp, Artificial Sequence
  sgRNA
ggagctctcttgccagtggg

SEQ ID NO: 10416 - DNA, 20 bp, Artificial Sequence
  sgRNA
tgaggaatcgactcagggtg

SEQ ID NO: 10417 - DNA, 20 bp, Artificial Sequence
  sgRNA
gggcaggaggacaatgctag

SEQ ID NO: 10418 - DNA, 20 bp, Artificial Sequence
  sgRNA
tgaaggagtcagaggtctgg

SEQ ID NO: 10419 - DNA, 20 bp, Artificial Sequence
  sgRNA
taattcacactccggtgaag

SEQ ID NO: 10420 - DNA, 20 bp, Artificial Sequence
  sgRNA
atggttggaagctgggttga

SEQ ID NO: 10421 - DNA, 20 bp, Artificial Sequence
  sgRNA
gagcggcgatcgaacgcccg

SEQ ID NO: 10422 - DNA, 20 bp, Artificial Sequence
  sgRNA
agcccaggacacagcaaagg

SEQ ID NO: 10423 - DNA, 20 bp, Artificial Sequence
  sgRNA
ttgtcgccgtcaggcacagc

SEQ ID NO: 10424 - DNA, 20 bp, Artificial Sequence
  sgRNA
tcgaagcgaatcggctgtcg

SEQ ID NO: 10425 - DNA, 20 bp, Artificial Sequence
  sgRNA
gggcttcggctggcgtcacg

SEQ ID NO: 10426 - DNA, 20 bp, Artificial Sequence
  sgRNA
gcgctctgcctgcccagtgg

SEQ ID NO: 10427 - DNA, 20 bp, Artificial Sequence
  sgRNA
aaccgacccaacatggcgcc

SEQ ID NO: 10428 - DNA, 20 bp, Artificial Sequence
  sgRNA
aagtttcctgcagaaagaga

SEQ ID NO: 10429 - DNA, 20 bp, Artificial Sequence
  sgRNA
gaggattccaattgattcct

SEQ ID NO: 10430 - DNA, 20 bp, Artificial Sequence
  sgRNA
ggtgacccgcaaggcatagg

SEQ ID NO: 10431 - DNA, 20 bp, Artificial Sequence
  sgRNA
ctgtggcaacacctcagttt

SEQ ID NO: 10432 - DNA, 20 bp, Artificial Sequence
  sgRNA
tacacagggcagtgtgagtt

SEQ ID NO: 10433 - DNA, 20 bp, Artificial Sequence
  sgRNA
gagattcgtatgtgaccaga

SEQ ID NO: 10434 - DNA, 20 bp, Artificial Sequence
  sgRNA
atttaggtctcaggtgggac

SEQ ID NO: 10435 - DNA, 20 bp, Artificial Sequence
  sgRNA
gattgggacagtgaccaacc

SEQ ID NO: 10436 - DNA, 20 bp, Artificial Sequence
  sgRNA
gttctgtaccgggcaggaac

SEQ ID NO: 10437 - DNA, 20 bp, Artificial Sequence
  sgRNA
agatatttcatcttactgca

SEQ ID NO: 10438 - DNA, 20 bp, Artificial Sequence
  sgRNA
ccctcggctttacgactttc

SEQ ID NO: 10439 - DNA, 20 bp, Artificial Sequence
  sgRNA
ctaactcaggcaccaccctt

SEQ ID NO: 10440 - DNA, 20 bp, Artificial Sequence
  sgRNA
gggcacttccgaggccgctc

SEQ ID NO: 10441 - DNA, 20 bp, Artificial Sequence
  sgRNA
tgtgggcgggaggccgagtg

SEQ ID NO: 10442 - DNA, 20 bp, Artificial Sequence
  sgRNA
tgcccgggtcgaggtcgggt

SEQ ID NO: 10443 - DNA, 20 bp, Artificial Sequence
  sgRNA
cggtcccagtcttgcagccc

SEQ ID NO: 10444 - DNA, 20 bp, Artificial Sequence
  sgRNA
acctaccctgccgtgaagaa

SEQ ID NO: 10445 - DNA, 20 bp, Artificial Sequence
  sgRNA
caaatcagacgcatgcgctt

SEQ ID NO: 10446 - DNA, 20 bp, Artificial Sequence
  sgRNA
ggaagaacaacaaatctatt

SEQ ID NO: 10447 - DNA, 20 bp, Artificial Sequence
  sgRNA
tagtcccgagaatttgctgc

SEQ ID NO: 10448 - DNA, 20 bp, Artificial Sequence
  sgRNA
gcaaagacgctgcggcttgc

SEQ ID NO: 10449 - DNA, 20 bp, Artificial Sequence
  sgRNA
aaatggctgcccggcccaca

SEQ ID NO: 10450 - DNA, 20 bp, Artificial Sequence
  sgRNA
cagggtgatccgctgaggac

SEQ ID NO: 10451 - DNA, 20 bp, Artificial Sequence
  sgRNA
tagcggatgggcgggctcta

SEQ ID NO: 10452 - DNA, 20 bp, Artificial Sequence
  sgRNA
ttgcagcacccattgggttg

SEQ ID NO: 10453 - DNA, 20 bp, Artificial Sequence
  sgRNA
tcatttcaaaggctgaccct

SEQ ID NO: 10454 - DNA, 20 bp, Artificial Sequence
  sgRNA
ccctgcactatattcccgcc

SEQ ID NO: 10455 - DNA, 20 bp, Artificial Sequence
  sgRNA
tttgcggtgtgcggcgctgg

SEQ ID NO: 10456 - DNA, 20 bp, Artificial Sequence
  sgRNA
ggctgctgattccagaatgc

SEQ ID NO: 10457 - DNA, 20 bp, Artificial Sequence
  sgRNA
caattcttggcttcaagcca

SEQ ID NO: 10458 - DNA, 20 bp, Artificial Sequence
  sgRNA
ccctgcacagtgcctaggac

SEQ ID NO: 10459 - DNA, 20 bp, Artificial Sequence
  sgRNA
ggagcttgggcgaagctttg

SEQ ID NO: 10460 - DNA, 20 bp, Artificial Sequence
  sgRNA
gttaagggcggcaatgtggg

SEQ ID NO: 10461 - DNA, 20 bp, Artificial Sequence
  sgRNA
agtgtaagctgggtgctgat

SEQ ID NO: 10462 - DNA, 20 bp, Artificial Sequence
  sgRNA
cctagaaggaatgctaacag

SEQ ID NO: 10463 - DNA, 20 bp, Artificial Sequence
  sgRNA
agcggtggacggcgtcgatc

SEQ ID NO: 10464 - DNA, 20 bp, Artificial Sequence
  sgRNA
gggtttgggagatactgagt

SEQ ID NO: 10465 - DNA, 20 bp, Artificial Sequence
  sgRNA
ggccaattccttcttagctg

SEQ ID NO: 10466 - DNA, 20 bp, Artificial Sequence
  sgRNA
ggtcacagggagcccgactg

SEQ ID NO: 10467 - DNA, 20 bp, Artificial Sequence
  sgRNA
ttgccggagccgcctcgagg

SEQ ID NO: 10468 - DNA, 20 bp, Artificial Sequence
  sgRNA
caaagcgccctcaggttccg

SEQ ID NO: 10469 - DNA, 20 bp, Artificial Sequence
  sgRNA
atagcctttccgcggcgccg

SEQ ID NO: 10470 - DNA, 20 bp, Artificial Sequence
  sgRNA
gattcagtcttcaacttggg

SEQ ID NO: 10471 - DNA, 20 bp, Artificial Sequence
  sgRNA
aagccaaagtctgggcacca

SEQ ID NO: 10472 - DNA, 20 bp, Artificial Sequence
  sgRNA
ggaattgtgatataaggcat

SEQ ID NO: 10473 - DNA, 20 bp, Artificial Sequence
  sgRNA
aaacacttgaaggtgtggcc

SEQ ID NO: 10474 - DNA, 20 bp, Artificial Sequence
  sgRNA
actggacgcgcctgtacgtg

SEQ ID NO: 10475 - DNA, 20 bp, Artificial Sequence
  sgRNA
gctgacgctgctattagtct

SEQ ID NO: 10476 - DNA, 20 bp, Artificial Sequence
  sgRNA
agcactaagcccagtatgag

SEQ ID NO: 10477 - DNA, 20 bp, Artificial Sequence
  sgRNA
ggcgcagaccgtgtcttacc

SEQ ID NO: 10478 - DNA, 20 bp, Artificial Sequence
  sgRNA
cgggcccagctgacacttat

SEQ ID NO: 10479 - DNA, 20 bp, Artificial Sequence
  sgRNA
tctgagctatggttgggtgg

SEQ ID NO: 10480 - DNA, 20 bp, Artificial Sequence
  sgRNA
agaccaacgcacgcggaaga

SEQ ID NO: 10481 - DNA, 20 bp, Artificial Sequence
  sgRNA
ggacgccggacgctcacgag

SEQ ID NO: 10482 - DNA, 20 bp, Artificial Sequence
  sgRNA
ggcacctcccatgcagtggg

SEQ ID NO: 10483 - DNA, 20 bp, Artificial Sequence
  sgRNA
gtgacgtttaagactctgat

SEQ ID NO: 10484 - DNA, 20 bp, Artificial Sequence
  sgRNA
gggacgtgggtgcgggtttg

SEQ ID NO: 10485 - DNA, 20 bp, Artificial Sequence
  sgRNA
gcgtagggcgcagagacagt

SEQ ID NO: 10486 - DNA, 20 bp, Artificial Sequence
  sgRNA
gagggccgcgggaaggaggt

SEQ ID NO: 10487 - DNA, 20 bp, Artificial Sequence
  sgRNA
ccaagacgggaggaaagcct

SEQ ID NO: 10488 - DNA, 20 bp, Artificial Sequence
  sgRNA
gcccgtgtctgagtctctcc

SEQ ID NO: 10489 - DNA, 20 bp, Artificial Sequence
  sgRNA
cctgtgccgactgaccaatt

SEQ ID NO: 10490 - DNA, 20 bp, Artificial Sequence
  sgRNA
ggtggatgaaactagccttg

SEQ ID NO: 10491 - DNA, 20 bp, Artificial Sequence
  sgRNA
ccctctataccaggttgtga

SEQ ID NO: 10492 - DNA, 20 bp, Artificial Sequence
  sgRNA
cctgtcccatatcagatata

SEQ ID NO: 10493 - DNA, 20 bp, Artificial Sequence
  sgRNA
gcagggcgaccgcccatccg

SEQ ID NO: 10494 - DNA, 20 bp, Artificial Sequence
  sgRNA
gatggccgcagatttgaatt

SEQ ID NO: 10495 - DNA, 20 bp, Artificial Sequence
  sgRNA
tttagtctcgcagaggtcaa

SEQ ID NO: 10496 - DNA, 20 bp, Artificial Sequence
  sgRNA
ccgtgcctttctcgggcctt

SEQ ID NO: 10497 - DNA, 20 bp, Artificial Sequence
  sgRNA
ggcaaactccagggtcccac

SEQ ID NO: 10498 - DNA, 20 bp, Artificial Sequence
  sgRNA
tgggaggactgccgaggcgg

SEQ ID NO: 10499 - DNA, 20 bp, Artificial Sequence
  sgRNA
tctgacttcggatgtttcta

SEQ ID NO: 10500 - DNA, 20 bp, Artificial Sequence
  sgRNA
ccggctcctctccggacttc

SEQ ID NO: 10501 - DNA, 20 bp, Artificial Sequence
  sgRNA
ggcgcagagactgacagctg

SEQ ID NO: 10502 - DNA, 20 bp, Artificial Sequence
  sgRNA
ttgctgagacctccgcttcc

SEQ ID NO: 10503 - DNA, 20 bp, Artificial Sequence
  sgRNA
ccacgtgaccgccgatcttc

SEQ ID NO: 10504 - DNA, 20 bp, Artificial Sequence
  sgRNA
gcgcagtgatccagagttga

SEQ ID NO: 10505 - DNA, 20 bp, Artificial Sequence
  sgRNA
tgccattccgagtgagaagc

SEQ ID NO: 10506 - DNA, 20 bp, Artificial Sequence
  sgRNA
gcacttcctgtagttggagc

SEQ ID NO: 10507 - DNA, 20 bp, Artificial Sequence
  sgRNA
atgccggagcttctggcccg

SEQ ID NO: 10508 - DNA, 20 bp, Artificial Sequence
  sgRNA
tttaaggtctaatgcagaag

SEQ ID NO: 10509 - DNA, 20 bp, Artificial Sequence
  sgRNA
agcgggcgctgtgcaagcgg

SEQ ID NO: 10510 - DNA, 20 bp, Artificial Sequence
  sgRNA
ggcacttccggaatcttggc

SEQ ID NO: 10511 - DNA, 20 bp, Artificial Sequence
  sgRNA
ccttagcaagcagctctgcc

SEQ ID NO: 10512 - DNA, 20 bp, Artificial Sequence
  sgRNA
aaatttcgagcagagaccca

SEQ ID NO: 10513 - DNA, 20 bp, Artificial Sequence
  sgRNA
ccctttgaaggcaagcggtg

SEQ ID NO: 10514 - DNA, 20 bp, Artificial Sequence
  sgRNA
tgtttgggtaaagtttcctc

SEQ ID NO: 10515 - DNA, 20 bp, Artificial Sequence
  sgRNA
aaactcctgacgtcactcca

SEQ ID NO: 10516 - DNA, 20 bp, Artificial Sequence
  sgRNA
ctctggctcagggatgttca

SEQ ID NO: 10517 - DNA, 20 bp, Artificial Sequence
  sgRNA
gaagaatgggttaatgaccc

SEQ ID NO: 10518 - DNA, 20 bp, Artificial Sequence
  sgRNA
catcagaacctaggagggag

SEQ ID NO: 10519 - DNA, 20 bp, Artificial Sequence
  sgRNA
tcactgctgcccgcctacga

SEQ ID NO: 10520 - DNA, 20 bp, Artificial Sequence
  sgRNA
cctcgcgtatcgtcagcgtc

SEQ ID NO: 10521 - DNA, 20 bp, Artificial Sequence
  sgRNA
gggcaaagattgcctgagcc

SEQ ID NO: 10522 - DNA, 20 bp, Artificial Sequence
  sgRNA
cccgttccgacagaacccag

SEQ ID NO: 10523 - DNA, 20 bp, Artificial Sequence
  sgRNA
tgtcgacttgtagagctggg

SEQ ID NO: 10524 - DNA, 20 bp, Artificial Sequence
  sgRNA
tgggagtggaaattcgaaag

SEQ ID NO: 10525 - DNA, 20 bp, Artificial Sequence
  sgRNA
gcgcatcactggcctgcagg

SEQ ID NO: 10526 - DNA, 20 bp, Artificial Sequence
  sgRNA
ttccgataagttgttgcaaa

SEQ ID NO: 10527 - DNA, 20 bp, Artificial Sequence
  sgRNA
ggcgagcgagggaacgaaat

SEQ ID NO: 10528 - DNA, 20 bp, Artificial Sequence
  sgRNA
cgcccatgacgcaccctctc

SEQ ID NO: 10529 - DNA, 20 bp, Artificial Sequence
  sgRNA
ctagcattgtgtcttctctt

SEQ ID NO: 10530 - DNA, 20 bp, Artificial Sequence
  sgRNA
taattatagacgcatttgcg

SEQ ID NO: 10531 - DNA, 20 bp, Artificial Sequence
  sgRNA
tgagaaataacggccagccc

SEQ ID NO: 10532 - DNA, 20 bp, Artificial Sequence
  sgRNA
gggaaagtccagcaacgaca

SEQ ID NO: 10533 - DNA, 20 bp, Artificial Sequence
  sgRNA
aagcaagctgcatctatctt

SEQ ID NO: 10534 - DNA, 20 bp, Artificial Sequence
  sgRNA
agacacagctttgggctgtt

SEQ ID NO: 10535 - DNA, 20 bp, Artificial Sequence
  sgRNA
acttaatccgcccaaacaac

SEQ ID NO: 10536 - DNA, 20 bp, Artificial Sequence
  sgRNA
gacacgatgagtggaggcgt

SEQ ID NO: 10537 - DNA, 20 bp, Artificial Sequence
  sgRNA
tcagaatcacactgtgggcg

SEQ ID NO: 10538 - DNA, 20 bp, Artificial Sequence
  sgRNA
gtatgtctacagataacttc

SEQ ID NO: 10539 - DNA, 20 bp, Artificial Sequence
  sgRNA
atacatgacacagcagagtt

SEQ ID NO: 10540 - DNA, 20 bp, Artificial Sequence
  sgRNA
agttacagcctgggtctacc

SEQ ID NO: 10541 - DNA, 20 bp, Artificial Sequence
  sgRNA
cacaggtgtcctatccattg

SEQ ID NO: 10542 - DNA, 20 bp, Artificial Sequence
  sgRNA
agagaaagcgagtgatcgca

SEQ ID NO: 10543 - DNA, 20 bp, Artificial Sequence
  sgRNA
gtataaacactgtatttccc

SEQ ID NO: 10544 - DNA, 20 bp, Artificial Sequence
  sgRNA
tctggcagtgtttatctcgt

SEQ ID NO: 10545 - DNA, 20 bp, Artificial Sequence
  sgRNA
ccggcacgggaggagagctc

SEQ ID NO: 10546 - DNA, 20 bp, Artificial Sequence
  sgRNA
ctctgttgggcgtgttgcct

SEQ ID NO: 10547 - DNA, 20 bp, Artificial Sequence
  sgRNA
tgcgaagaggcgtgggttcc

SEQ ID NO: 10548 - DNA, 20 bp, Artificial Sequence
  sgRNA
aggttctggtcagtttgctc

SEQ ID NO: 10549 - DNA, 20 bp, Artificial Sequence
  sgRNA
aaataaggcaaagaagaccc

SEQ ID NO: 10550 - DNA, 20 bp, Artificial Sequence
  sgRNA
ggaaacaaggtttcttctcc

SEQ ID NO: 10551 - DNA, 20 bp, Artificial Sequence
  sgRNA
aggctggtgtctgggtgtcc

SEQ ID NO: 10552 - DNA, 20 bp, Artificial Sequence
  sgRNA
tcacagtgtctgtaagtgca

SEQ ID NO: 10553 - DNA, 20 bp, Artificial Sequence
  sgRNA
ggcgcgtgacgcaaagcggc

SEQ ID NO: 10554 - DNA, 20 bp, Artificial Sequence
  sgRNA
accgcggaactcgcgcccgg

SEQ ID NO: 10555 - DNA, 20 bp, Artificial Sequence
  sgRNA
atgcggtgcgggacagcctc

SEQ ID NO: 10556 - DNA, 20 bp, Artificial Sequence
  sgRNA
cggcgggaaagcgccgctca

SEQ ID NO: 10557 - DNA, 20 bp, Artificial Sequence
  sgRNA
cgggcaccacctcgtaacaa

SEQ ID NO: 10558 - DNA, 20 bp, Artificial Sequence
  sgRNA
gggtttcccttggcgctttc

SEQ ID NO: 10559 - DNA, 20 bp, Artificial Sequence
  sgRNA
gaatggagcggcacgtgacc

SEQ ID NO: 10560 - DNA, 20 bp, Artificial Sequence
  sgRNA
gcagatttaatccgaatgca

SEQ ID NO: 10561 - DNA, 20 bp, Artificial Sequence
  sgRNA
aagatgacttagaccagtga

SEQ ID NO: 10562 - DNA, 20 bp, Artificial Sequence
  sgRNA
ttcttgaagtgagttatgtc

SEQ ID NO: 10563 - DNA, 20 bp, Artificial Sequence
  sgRNA
tggttggatgccggaacctt

SEQ ID NO: 10564 - DNA, 20 bp, Artificial Sequence
  sgRNA
ggatgtcagacaggaagaac

SEQ ID NO: 10565 - DNA, 20 bp, Artificial Sequence
  sgRNA
catgcgcaggccgcccggct

SEQ ID NO: 10566 - DNA, 20 bp, Artificial Sequence
  sgRNA
gggagaaacaaagggcttca

SEQ ID NO: 10567 - DNA, 20 bp, Artificial Sequence
  sgRNA
ctcctaaatgtgacttccaa

SEQ ID NO: 10568 - DNA, 20 bp, Artificial Sequence
  sgRNA
gtaaaggtccttctttgccg

SEQ ID NO: 10569 - DNA, 20 bp, Artificial Sequence
  sgRNA
tgccattagcccacgcaagg

SEQ ID NO: 10570 - DNA, 20 bp, Artificial Sequence
  sgRNA
ccgcatgcaaagaatagctg

SEQ ID NO: 10571 - DNA, 20 bp, Artificial Sequence
  sgRNA
tcagcctcacctcaatatgg

SEQ ID NO: 10572 - DNA, 20 bp, Artificial Sequence
  sgRNA
aggaatgaatggccatcagg

SEQ ID NO: 10573 - DNA, 20 bp, Artificial Sequence
  sgRNA
tagaatgtggtacaggcgac

SEQ ID NO: 10574 - DNA, 20 bp, Artificial Sequence
  sgRNA
tgccaactgctgagagaccc

SEQ ID NO: 10575 - DNA, 20 bp, Artificial Sequence
  sgRNA
taagaatgtgccacattaaa

SEQ ID NO: 10576 - DNA, 20 bp, Artificial Sequence
  sgRNA
ccgttagaccgctgttactc

SEQ ID NO: 10577 - DNA, 20 bp, Artificial Sequence
  sgRNA
cccaccactgacaacctgtt

SEQ ID NO: 10578 - DNA, 20 bp, Artificial Sequence
  sgRNA
tgactaagaactgaaggcac

SEQ ID NO: 10579 - DNA, 20 bp, Artificial Sequence
  sgRNA
ggcaccagctctgagctgga

SEQ ID NO: 10580 - DNA, 20 bp, Artificial Sequence
  sgRNA
tgcagaactggagtaaaccg

SEQ ID NO: 10581 - DNA, 20 bp, Artificial Sequence
  sgRNA
ggtactgtgatctcagtaac

SEQ ID NO: 10582 - DNA, 20 bp, Artificial Sequence
  sgRNA
cggaaagtcctggcaggacg

SEQ ID NO: 10583 - DNA, 20 bp, Artificial Sequence
  sgRNA
acgtggtggaatgttacctt

SEQ ID NO: 10584 - DNA, 20 bp, Artificial Sequence
  sgRNA
atgtattgaactgtcgtcta

SEQ ID NO: 10585 - DNA, 20 bp, Artificial Sequence
  sgRNA
agacgcgcgcccgcaatgtc

SEQ ID NO: 10586 - DNA, 20 bp, Artificial Sequence
  sgRNA
tcaggataagagttgtagct

SEQ ID NO: 10587 - DNA, 20 bp, Artificial Sequence
  sgRNA
actgtcgatcctatatatag

SEQ ID NO: 10588 - DNA, 20 bp, Artificial Sequence
  sgRNA
tcgcctgtcgcaaggcatct

SEQ ID NO: 10589 - DNA, 20 bp, Artificial Sequence
  sgRNA
ctccggcgcgctgtccgctg

SEQ ID NO: 10590 - DNA, 20 bp, Artificial Sequence
  sgRNA
ctgcccaaagtccagaagtc

SEQ ID NO: 10591 - DNA, 20 bp, Artificial Sequence
  sgRNA
ttcacttgagttcaaactcc

SEQ ID NO: 10592 - DNA, 20 bp, Artificial Sequence
  sgRNA
ggctccacgtgggcgcaccc

SEQ ID NO: 10593 - DNA, 20 bp, Artificial Sequence
  sgRNA
ggtgctcgcgcgttgccttt

SEQ ID NO: 10594 - DNA, 20 bp, Artificial Sequence
  sgRNA
acgatctgtgggcgggcacg

SEQ ID NO: 10595 - DNA, 20 bp, Artificial Sequence
  sgRNA
ggcgggacatccgcaaggag

SEQ ID NO: 10596 - DNA, 20 bp, Artificial Sequence
  sgRNA
tcaatctgcaagatgtggcg

SEQ ID NO: 10597 - DNA, 20 bp, Artificial Sequence
  sgRNA
ctacactggagtgcgttgcc

SEQ ID NO: 10598 - DNA, 20 bp, Artificial Sequence
  sgRNA
aggcttgagaaactgtgtac

SEQ ID NO: 10599 - DNA, 20 bp, Artificial Sequence
  sgRNA
tgtggtgctacaccttctgc

SEQ ID NO: 10600 - DNA, 20 bp, Artificial Sequence
  sgRNA
tgtggacgtgcattccctga

SEQ ID NO: 10601 - DNA, 20 bp, Artificial Sequence
  sgRNA
ctccttctcctagactaccc

SEQ ID NO: 10602 - DNA, 20 bp, Artificial Sequence
  sgRNA
acatttgccgggcaggcagg

SEQ ID NO: 10603 - DNA, 20 bp, Artificial Sequence
  sgRNA
ggcgggcgctgtggaatgta

SEQ ID NO: 10604 - DNA, 20 bp, Artificial Sequence
  sgRNA
caacagggctccaccgcttc

SEQ ID NO: 10605 - DNA, 20 bp, Artificial Sequence
  sgRNA
tagagaactgttgcaagttg

SEQ ID NO: 10606 - DNA, 20 bp, Artificial Sequence
  sgRNA
cactccttccacactcagat

SEQ ID NO: 10607 - DNA, 20 bp, Artificial Sequence
  sgRNA
gtcagcatgatctccagacc

SEQ ID NO: 10608 - DNA, 20 bp, Artificial Sequence
  sgRNA
aggtatgtcagtgtggatgt

SEQ ID NO: 10609 - DNA, 20 bp, Artificial Sequence
  sgRNA
gcctagccctcttgaatctc

SEQ ID NO: 10610 - DNA, 20 bp, Artificial Sequence
  sgRNA
gtgaatagtggcagaggaga

SEQ ID NO: 10611 - DNA, 20 bp, Artificial Sequence
  sgRNA
tgttggacaccgacatcgaa

SEQ ID NO: 10612 - DNA, 20 bp, Artificial Sequence
  sgRNA
ctgacgtagcgaaggctgcc

SEQ ID NO: 10613 - DNA, 20 bp, Artificial Sequence
  sgRNA
agtccagaaacttggcactg

SEQ ID NO: 10614 - DNA, 20 bp, Artificial Sequence
  sgRNA
ttctagagagaggctgtccg

SEQ ID NO: 10615 - DNA, 20 bp, Artificial Sequence
  sgRNA
tacggcttcggctccgtggg

SEQ ID NO: 10616 - DNA, 20 bp, Artificial Sequence
  sgRNA
gatacagccttctgaataac

SEQ ID NO: 10617 - DNA, 20 bp, Artificial Sequence
  sgRNA
gcaggaagctataaataatt

SEQ ID NO: 10618 - DNA, 20 bp, Artificial Sequence
  sgRNA
atttaaagagacaaccgacc

SEQ ID NO: 10619 - DNA, 20 bp, Artificial Sequence
  sgRNA
aggtccacgtcaatccctcc

SEQ ID NO: 10620 - DNA, 20 bp, Artificial Sequence
  sgRNA
gcgctccgagcgctcagccc

SEQ ID NO: 10621 - DNA, 20 bp, Artificial Sequence
  sgRNA
cccaacaaagcagagaccag

SEQ ID NO: 10622 - DNA, 20 bp, Artificial Sequence
  sgRNA
cataaggcctacagagttct

SEQ ID NO: 10623 - DNA, 20 bp, Artificial Sequence
  sgRNA
tgctcaccaccgcgtgcgac

SEQ ID NO: 10624 - DNA, 20 bp, Artificial Sequence
  sgRNA
cgactggcaattcgctccgg

SEQ ID NO: 10625 - DNA, 20 bp, Artificial Sequence
  sgRNA
tggcggtggcatgagaattg

SEQ ID NO: 10626 - DNA, 20 bp, Artificial Sequence
  sgRNA
acgtcacttccggcaacaat

SEQ ID NO: 10627 - DNA, 20 bp, Artificial Sequence
  sgRNA
caagcgtggaacatcatccc

SEQ ID NO: 10628 - DNA, 20 bp, Artificial Sequence
  sgRNA
tgacgcgagcgggcttccgg

SEQ ID NO: 10629 - DNA, 20 bp, Artificial Sequence
  sgRNA
aaggacagaggtagttcagt

SEQ ID NO: 10630 - DNA, 20 bp, Artificial Sequence
  sgRNA
gtgggaagctggtatcgttt

SEQ ID NO: 10631 - DNA, 20 bp, Artificial Sequence
  sgRNA
ttaagaacagttcctaacaa

SEQ ID NO: 10632 - DNA, 20 bp, Artificial Sequence
  sgRNA
cagacggctgatcggaagat

SEQ ID NO: 10633 - DNA, 20 bp, Artificial Sequence
  sgRNA
ctgctgtactgggaagtggg

SEQ ID NO: 10634 - DNA, 20 bp, Artificial Sequence
  sgRNA
atcaaatcagtttagtagag

SEQ ID NO: 10635 - DNA, 20 bp, Artificial Sequence
  sgRNA
tcaggcgcgtggaacgttta

SEQ ID NO: 10636 - DNA, 20 bp, Artificial Sequence
  sgRNA
gggcctgaggcaggagtgcg

SEQ ID NO: 10637 - DNA, 20 bp, Artificial Sequence
  sgRNA
tcctcgtccggagactgctg

SEQ ID NO: 10638 - DNA, 20 bp, Artificial Sequence
  sgRNA
gcggtgccgcgggctctcta

SEQ ID NO: 10639 - DNA, 20 bp, Artificial Sequence
  sgRNA
ggcagcaggcgggcctgcgc

SEQ ID NO: 10640 - DNA, 20 bp, Artificial Sequence
  sgRNA
tgtcggcgcgcctgcgcagt

SEQ ID NO: 10641 - DNA, 20 bp, Artificial Sequence
  sgRNA
gggacagagctgctcgctag

SEQ ID NO: 10642 - DNA, 20 bp, Artificial Sequence
  sgRNA
gaaagtttatctggcaagtt

SEQ ID NO: 10643 - DNA, 20 bp, Artificial Sequence
  sgRNA
cgcagtagtcccttcggctg

SEQ ID NO: 10644 - DNA, 20 bp, Artificial Sequence
  sgRNA
actgaagaattacttccaag

SEQ ID NO: 10645 - DNA, 20 bp, Artificial Sequence
  sgRNA
acaataggtccaaaccaccg

SEQ ID NO: 10646 - DNA, 20 bp, Artificial Sequence
  sgRNA
agcagctttagaaactaagc

SEQ ID NO: 10647 - DNA, 20 bp, Artificial Sequence
  sgRNA
tgaaggaaggcagtccgcac

SEQ ID NO: 10648 - DNA, 20 bp, Artificial Sequence
  sgRNA
ggtctgagttgggcccgaga

SEQ ID NO: 10649 - DNA, 20 bp, Artificial Sequence
  sgRNA
cctcacgaagagtaagtgtt

SEQ ID NO: 10650 - DNA, 20 bp, Artificial Sequence
  sgRNA
ggtcagggccacgacagaga

SEQ ID NO: 10651 - DNA, 20 bp, Artificial Sequence
  sgRNA
gtgctacgcgggtccggcgg

SEQ ID NO: 10652 - DNA, 20 bp, Artificial Sequence
  sgRNA
cggaggtgactggactaata

SEQ ID NO: 10653 - DNA, 20 bp, Artificial Sequence
  sgRNA
gaggctcctagtccggctgc

SEQ ID NO: 10654 - DNA, 20 bp, Artificial Sequence
  sgRNA
gccttgctgtgggccttcta

SEQ ID NO: 10655 - DNA, 20 bp, Artificial Sequence
  sgRNA
agccgttccctcggagctaa

SEQ ID NO: 10656 - DNA, 20 bp, Artificial Sequence
  sgRNA
tctaggctgctggcagcgcg

SEQ ID NO: 10657 - DNA, 20 bp, Artificial Sequence
  sgRNA
cctcagtataaagtccagcc

SEQ ID NO: 10658 - DNA, 20 bp, Artificial Sequence
  sgRNA
ctcctttcacttcgggcgag

SEQ ID NO: 10659 - DNA, 20 bp, Artificial Sequence
  sgRNA
ggtttccaagtgcgggagac

SEQ ID NO: 10660 - DNA, 20 bp, Artificial Sequence
  sgRNA
tgcttcgcgtgagcgccctc

SEQ ID NO: 10661 - DNA, 20 bp, Artificial Sequence
  sgRNA
tggatttattgagaagggtc

SEQ ID NO: 10662 - DNA, 20 bp, Artificial Sequence
  sgRNA
ttgagagctgggtggaagcc

SEQ ID NO: 10663 - DNA, 20 bp, Artificial Sequence
  sgRNA
ggcatagatgcgtggaatct

SEQ ID NO: 10664 - DNA, 20 bp, Artificial Sequence
  sgRNA
atctcaacggccagcccggc

SEQ ID NO: 10665 - DNA, 20 bp, Artificial Sequence
  sgRNA
ccaggcaacatatcaggaca

SEQ ID NO: 10666 - DNA, 20 bp, Artificial Sequence
  sgRNA
tggttaatccttaaccctgg

SEQ ID NO: 10667 - DNA, 20 bp, Artificial Sequence
  sgRNA
aagtgagcctttcaatgtcg

SEQ ID NO: 10668 - DNA, 20 bp, Artificial Sequence
  sgRNA
cgcaggcctacaggcaagcg

SEQ ID NO: 10669 - DNA, 20 bp, Artificial Sequence
  sgRNA
tcagagcccgcgtccattcc

SEQ ID NO: 10670 - DNA, 20 bp, Artificial Sequence
  sgRNA
gtggcgtgatggcagagggc

SEQ ID NO: 10671 - DNA, 20 bp, Artificial Sequence
  sgRNA
tcagccattggctagaaacc

SEQ ID NO: 10672 - DNA, 20 bp, Artificial Sequence
  sgRNA
ctgttctctctcccgggagg

SEQ ID NO: 10673 - DNA, 20 bp, Artificial Sequence
  sgRNA
cccttgcaacctctttcgct

SEQ ID NO: 10674 - DNA, 20 bp, Artificial Sequence
  sgRNA
gggtggagtttaatgagaaa

SEQ ID NO: 10675 - DNA, 20 bp, Artificial Sequence
  sgRNA
cagcggaccctttcgatcgc

SEQ ID NO: 10676 - DNA, 20 bp, Artificial Sequence
  sgRNA
ttcttcgcgagactccgcct

SEQ ID NO: 10677 - DNA, 20 bp, Artificial Sequence
  sgRNA
gagtcgcgcacagctcacag

SEQ ID NO: 10678 - DNA, 20 bp, Artificial Sequence
  sgRNA
ctccgagccactggagcctt

SEQ ID NO: 10679 - DNA, 20 bp, Artificial Sequence
  sgRNA
agctttgatttgaactgggc

SEQ ID NO: 10680 - DNA, 20 bp, Artificial Sequence
  sgRNA
gtattccctggaaggtgaca

SEQ ID NO: 10681 - DNA, 20 bp, Artificial Sequence
  sgRNA
ctgagagcttacaagggttc

SEQ ID NO: 10682 - DNA, 20 bp, Artificial Sequence
  sgRNA
taaagggctcatccagcagc

SEQ ID NO: 10683 - DNA, 20 bp, Artificial Sequence
  sgRNA
gggtcgagacgtcggcccga

SEQ ID NO: 10684 - DNA, 20 bp, Artificial Sequence
  sgRNA
gagtgttcattggttagctg

SEQ ID NO: 10685 - DNA, 20 bp, Artificial Sequence
  sgRNA
gtcatctgattctccactgg

SEQ ID NO: 10686 - DNA, 20 bp, Artificial Sequence
  sgRNA
gtccaggtgtactgcctcac

SEQ ID NO: 10687 - DNA, 20 bp, Artificial Sequence
  sgRNA
tgctaaaggcgcggagcaca

SEQ ID NO: 10688 - DNA, 20 bp, Artificial Sequence
  sgRNA
cccggcggcggcgacggtgg

SEQ ID NO: 10689 - DNA, 20 bp, Artificial Sequence
  sgRNA
tgagaggaggttcctagaaa

SEQ ID NO: 10690 - DNA, 20 bp, Artificial Sequence
  sgRNA
ggctggagcgtgagtgcgag

SEQ ID NO: 10691 - DNA, 20 bp, Artificial Sequence
  sgRNA
gtttcgggcaaacggtttag

SEQ ID NO: 10692 - DNA, 20 bp, Artificial Sequence
  sgRNA
atgctcttgtagctagacaa

SEQ ID NO: 10693 - DNA, 20 bp, Artificial Sequence
  sgRNA
ccacgaagaatagccctagg

SEQ ID NO: 10694 - DNA, 20 bp, Artificial Sequence
  sgRNA
cactgacagcgaggcaacac

SEQ ID NO: 10695 - DNA, 20 bp, Artificial Sequence
  sgRNA
gcaataattaaatctctacc

SEQ ID NO: 10696 - DNA, 20 bp, Artificial Sequence
  sgRNA
ggcgttctgtcaatctcaac

SEQ ID NO: 10697 - DNA, 20 bp, Artificial Sequence
  sgRNA
ggagaaaggaggatccaagc

SEQ ID NO: 10698 - DNA, 20 bp, Artificial Sequence
  sgRNA
gctgaatgtggttatgcaca

SEQ ID NO: 10699 - DNA, 20 bp, Artificial Sequence
  sgRNA
acaagatctgttctgcctcg

SEQ ID NO: 10700 - DNA, 20 bp, Artificial Sequence
  sgRNA
gctgtacttacaaaggagag

SEQ ID NO: 10701 - DNA, 20 bp, Artificial Sequence
  sgRNA
aaacattcttcgcgacacaa

SEQ ID NO: 10702 - DNA, 20 bp, Artificial Sequence
  sgRNA
tagcagggtgaacacgtgtg

SEQ ID NO: 10703 - DNA, 20 bp, Artificial Sequence
  sgRNA
catcgcgtgggcctcggcgg

SEQ ID NO: 10704 - DNA, 20 bp, Artificial Sequence
  sgRNA
tacacaatcctcgaagctgt

SEQ ID NO: 10705 - DNA, 20 bp, Artificial Sequence
  sgRNA
aatttagtacaagacatgca

SEQ ID NO: 10706 - DNA, 20 bp, Artificial Sequence
  sgRNA
ataagctgcttcatataaga

SEQ ID NO: 10707 - DNA, 20 bp, Artificial Sequence
  sgRNA
caaatgtagggaatcaagag

SEQ ID NO: 10708 - DNA, 20 bp, Artificial Sequence
  sgRNA
aggagcatgtcgggaataac

SEQ ID NO: 10709 - DNA, 20 bp, Artificial Sequence
  sgRNA
taagaagagggaaagggttc

SEQ ID NO: 10710 - DNA, 20 bp, Artificial Sequence
  sgRNA
aagaggccgcctgcctggca

SEQ ID NO: 10711 - DNA, 20 bp, Artificial Sequence
  sgRNA
atcggagaggttaacacaac

SEQ ID NO: 10712 - DNA, 20 bp, Artificial Sequence
  sgRNA
gcactagaaacccgagaacg

SEQ ID NO: 10713 - DNA, 20 bp, Artificial Sequence
  sgRNA
gtttcctgcagagcaagcaa

SEQ ID NO: 10714 - DNA, 20 bp, Artificial Sequence
  sgRNA
ggagctagagaaagaaccca

SEQ ID NO: 10715 - DNA, 20 bp, Artificial Sequence
  sgRNA
tatagagcgacagctgttgg

SEQ ID NO: 10716 - DNA, 20 bp, Artificial Sequence
  sgRNA
gttgtgaaatccatttctta

SEQ ID NO: 10717 - DNA, 20 bp, Artificial Sequence
  sgRNA
ctgccaggagcttccggcgc

SEQ ID NO: 10718 - DNA, 20 bp, Artificial Sequence
  sgRNA
ttactagaatctgcagcagg

SEQ ID NO: 10719 - DNA, 20 bp, Artificial Sequence
  sgRNA
tcaggatgaccaatgtcaac

SEQ ID NO: 10720 - DNA, 20 bp, Artificial Sequence
  sgRNA
atccagagttagcctatcag

SEQ ID NO: 10721 - DNA, 20 bp, Artificial Sequence
  sgRNA
gtgtcacttgaaagttcctg

SEQ ID NO: 10722 - DNA, 20 bp, Artificial Sequence
  sgRNA
gataggtgtcggtctataaa

SEQ ID NO: 10723 - DNA, 20 bp, Artificial Sequence
  sgRNA
gttctcccgcggctcgcaca

SEQ ID NO: 10724 - DNA, 20 bp, Artificial Sequence
  sgRNA
ctggtatgtagtggatgccc

SEQ ID NO: 10725 - DNA, 20 bp, Artificial Sequence
  sgRNA
agagtgcgagggcgaccagg

SEQ ID NO: 10726 - DNA, 20 bp, Artificial Sequence
  sgRNA
caagaggcaggcgcgtggat

SEQ ID NO: 10727 - DNA, 20 bp, Artificial Sequence
  sgRNA
tgtcttcattgtggaaggtg

SEQ ID NO: 10728 - DNA, 20 bp, Artificial Sequence
  sgRNA
ccaggccacggagcagggcg

SEQ ID NO: 10729 - DNA, 20 bp, Artificial Sequence
  sgRNA
agacagcacatgcccaactg

SEQ ID NO: 10730 - DNA, 20 bp, Artificial Sequence
  sgRNA
ccctcgccgcctgcgcgcgt

SEQ ID NO: 10731 - DNA, 20 bp, Artificial Sequence
  sgRNA
cacttaaggttgtaaactgt

SEQ ID NO: 10732 - DNA, 20 bp, Artificial Sequence
  sgRNA
agaactagccctggtgaagt

SEQ ID NO: 10733 - DNA, 20 bp, Artificial Sequence
  sgRNA
gggcgggacctgacaggctt

SEQ ID NO: 10734 - DNA, 20 bp, Artificial Sequence
  sgRNA
gcgcaggaaggaggtgccgc

SEQ ID NO: 10735 - DNA, 20 bp, Artificial Sequence
  sgRNA
ttgggacatggattggacaa

SEQ ID NO: 10736 - DNA, 20 bp, Artificial Sequence
  sgRNA
acgagcatccttgcatctgc

SEQ ID NO: 10737 - DNA, 20 bp, Artificial Sequence
  sgRNA
cacttggtctgtcctgcagc

SEQ ID NO: 10738 - DNA, 20 bp, Artificial Sequence
  sgRNA
gaacctgagaggtgggtttg

SEQ ID NO: 10739 - DNA, 20 bp, Artificial Sequence
  sgRNA
acagccggaccaggagtgcc

SEQ ID NO: 10740 - DNA, 20 bp, Artificial Sequence
  sgRNA
gggaatcacttgtgtagctc

SEQ ID NO: 10741 - DNA, 20 bp, Artificial Sequence
  sgRNA
tcacccatctgagtccttca

SEQ ID NO: 10742 - DNA, 20 bp, Artificial Sequence
  sgRNA
cgaggaggcccggcagcgtg

SEQ ID NO: 10743 - DNA, 20 bp, Artificial Sequence
  sgRNA
tacccatgaacacaggccac

SEQ ID NO: 10744 - DNA, 20 bp, Artificial Sequence
  sgRNA
ccgcagccaatttgagtggg

SEQ ID NO: 10745 - DNA, 20 bp, Artificial Sequence
  sgRNA
tagaaactctaacggatgtc

SEQ ID NO: 10746 - DNA, 20 bp, Artificial Sequence
  sgRNA
gcgcctggcttacgaataat

SEQ ID NO: 10747 - DNA, 20 bp, Artificial Sequence
  sgRNA
agggagggaagagagcaagg

SEQ ID NO: 10748 - DNA, 20 bp, Artificial Sequence
  sgRNA
ctgacccacgtgggccggtt

SEQ ID NO: 10749 - DNA, 20 bp, Artificial Sequence
  sgRNA
aatgagccaagagagagtgc

SEQ ID NO: 10750 - DNA, 20 bp, Artificial Sequence
  sgRNA
ctggaggcacccggtgttgg

SEQ ID NO: 10751 - DNA, 20 bp, Artificial Sequence
  sgRNA
gctaatgaaattaggtcaat

SEQ ID NO: 10752 - DNA, 20 bp, Artificial Sequence
  sgRNA
gaaccttgctaattcctaga

SEQ ID NO: 10753 - DNA, 20 bp, Artificial Sequence
  sgRNA
gtcagaacatcaaaggatgg

SEQ ID NO: 10754 - DNA, 20 bp, Artificial Sequence
  sgRNA
gggatgtggctagaatctcc

SEQ ID NO: 10755 - DNA, 20 bp, Artificial Sequence
  sgRNA
tcagccctctcacgctccgg

SEQ ID NO: 10756 - DNA, 20 bp, Artificial Sequence
  sgRNA
cggatcttctgtgcccaccc

SEQ ID NO: 10757 - DNA, 20 bp, Artificial Sequence
  sgRNA
atacggtctcgtgggccgat

SEQ ID NO: 10758 - DNA, 20 bp, Artificial Sequence
  sgRNA
ttgggctagagcggaagtgg

SEQ ID NO: 10759 - DNA, 20 bp, Artificial Sequence
  sgRNA
cttgttaaggttacaagtcc

SEQ ID NO: 10760 - DNA, 20 bp, Artificial Sequence
  sgRNA
aagctgtgtagttagaaggg

SEQ ID NO: 10761 - DNA, 20 bp, Artificial Sequence
  sgRNA
gacttcacgttctctaggct

SEQ ID NO: 10762 - DNA, 20 bp, Artificial Sequence
  sgRNA
agtttcactctggcgtacaa

SEQ ID NO: 10763 - DNA, 20 bp, Artificial Sequence
  sgRNA
agtgctgacagcttccggtc

SEQ ID NO: 10764 - DNA, 20 bp, Artificial Sequence
  sgRNA
ggactgaaatccatgaagcc

SEQ ID NO: 10765 - DNA, 20 bp, Artificial Sequence
  sgRNA
tgcctatgggatagagacgg

SEQ ID NO: 10766 - DNA, 20 bp, Artificial Sequence
  sgRNA
ttcagattgtactctgtacg

SEQ ID NO: 10767 - DNA, 20 bp, Artificial Sequence
  sgRNA
gacgtcatgctcagtgcccg

SEQ ID NO: 10768 - DNA, 20 bp, Artificial Sequence
  sgRNA
aaagattatggtaagcatgc

SEQ ID NO: 10769 - DNA, 20 bp, Artificial Sequence
  sgRNA
aggaggaggagaagaaggca

SEQ ID NO: 10770 - DNA, 20 bp, Artificial Sequence
  sgRNA
gttaaaggtcaatctaagca

SEQ ID NO: 10771 - DNA, 20 bp, Artificial Sequence
  sgRNA
gagaacactgccgcccgact

SEQ ID NO: 10772 - DNA, 20 bp, Artificial Sequence
  sgRNA
gcatacttcgagcattcctt

SEQ ID NO: 10773 - DNA, 20 bp, Artificial Sequence
  sgRNA
atactcctgtccaaactaag

SEQ ID NO: 10774 - DNA, 20 bp, Artificial Sequence
  sgRNA
aaccacatgctttctgcctc

SEQ ID NO: 10775 - DNA, 20 bp, Artificial Sequence
  sgRNA
attggtcgagagcgatgcgg

SEQ ID NO: 10776 - DNA, 20 bp, Artificial Sequence
  sgRNA
ctctagctgacacaacctcc

SEQ ID NO: 10777 - DNA, 20 bp, Artificial Sequence
  sgRNA
ctagacccaaatatttctcc

SEQ ID NO: 10778 - DNA, 20 bp, Artificial Sequence
  sgRNA
tggctggctgtacgtgagaa

SEQ ID NO: 10779 - DNA, 20 bp, Artificial Sequence
  sgRNA
actccgaggaccaatcggtg

SEQ ID NO: 10780 - DNA, 20 bp, Artificial Sequence
  sgRNA
gctgtgtctgtgcctcgcat

SEQ ID NO: 10781 - DNA, 20 bp, Artificial Sequence
  sgRNA
actagtgctatctttaagac

SEQ ID NO: 10782 - DNA, 20 bp, Artificial Sequence
  sgRNA
gaatcctctacacccgcttt

SEQ ID NO: 10783 - DNA, 20 bp, Artificial Sequence
  sgRNA
tcggattctatccggcccgg

SEQ ID NO: 10784 - DNA, 20 bp, Artificial Sequence
  sgRNA
tttaacttactgctgtcaag

SEQ ID NO: 10785 - DNA, 20 bp, Artificial Sequence
  sgRNA
ctctgaagccaggcagattg

SEQ ID NO: 10786 - DNA, 20 bp, Artificial Sequence
  sgRNA
cctgacggcagtcgaaacac

SEQ ID NO: 10787 - DNA, 20 bp, Artificial Sequence
  sgRNA
atagagttcgagaggacgtc

SEQ ID NO: 10788 - DNA, 20 bp, Artificial Sequence
  sgRNA
acggatccttaaatatgctg

SEQ ID NO: 10789 - DNA, 20 bp, Artificial Sequence
  sgRNA
caaactgctggcgagtcaag

SEQ ID NO: 10790 - DNA, 20 bp, Artificial Sequence
  sgRNA
cccgtcgcggctctagttcc

SEQ ID NO: 10791 - DNA, 20 bp, Artificial Sequence
  sgRNA
agacagtaacacccatcttc

SEQ ID NO: 10792 - DNA, 20 bp, Artificial Sequence
  sgRNA
ggcgcgcaaagagtgaccgc

SEQ ID NO: 10793 - DNA, 20 bp, Artificial Sequence
  sgRNA
gggaggacagcatttagctc

SEQ ID NO: 10794 - DNA, 20 bp, Artificial Sequence
  sgRNA
gtccctgacacttcctttcc

SEQ ID NO: 10795 - DNA, 20 bp, Artificial Sequence
  sgRNA
gttgctccgtcctcctgaaa

SEQ ID NO: 10796 - DNA, 20 bp, Artificial Sequence
  sgRNA
atgaaagggcgagcccacgc

SEQ ID NO: 10797 - DNA, 20 bp, Artificial Sequence
  sgRNA
tcctaggatgttacacttgg

SEQ ID NO: 10798 - DNA, 20 bp, Artificial Sequence
  sgRNA
gctgactcccggcgcgttgg

SEQ ID NO: 10799 - DNA, 20 bp, Artificial Sequence
  sgRNA
aaccacagaaccacaaggcc

SEQ ID NO: 10800 - DNA, 20 bp, Artificial Sequence
  sgRNA
gggcggtgctcccagatctc

SEQ ID NO: 10801 - DNA, 20 bp, Artificial Sequence
  sgRNA
gtacatctattacgttcgtc

SEQ ID NO: 10802 - DNA, 20 bp, Artificial Sequence
  sgRNA
gtaactagagtgtcagaaca

SEQ ID NO: 10803 - DNA, 20 bp, Artificial Sequence
  sgRNA
acggcgccgctatgcactgt

SEQ ID NO: 10804 - DNA, 20 bp, Artificial Sequence
  sgRNA
ccaatgcagaactttgcatc

SEQ ID NO: 10805 - DNA, 20 bp, Artificial Sequence
  sgRNA
gcgccgtagtcgccgtgagt

SEQ ID NO: 10806 - DNA, 20 bp, Artificial Sequence
  sgRNA
gacagggtctcgtgacggcc

SEQ ID NO: 10807 - DNA, 20 bp, Artificial Sequence
  sgRNA
ggcgtcttctctagctggcc

SEQ ID NO: 10808 - DNA, 20 bp, Artificial Sequence
  sgRNA
ggacctacggagattacttc

SEQ ID NO: 10809 - DNA, 20 bp, Artificial Sequence
  sgRNA
ttctagaagagactgtcagg

SEQ ID NO: 10810 - DNA, 20 bp, Artificial Sequence
  sgRNA
gaatagcactgcagttacca

SEQ ID NO: 10811 - DNA, 20 bp, Artificial Sequence
  sgRNA
gcaaactggtatgcagaagt

SEQ ID NO: 10812 - DNA, 20 bp, Artificial Sequence
  sgRNA
aaagatgattgctcaagccc

SEQ ID NO: 10813 - DNA, 20 bp, Artificial Sequence
  sgRNA
cagattctccaaggctgatg

SEQ ID NO: 10814 - DNA, 20 bp, Artificial Sequence
  sgRNA
taaaggtgtgtgtttctacc

SEQ ID NO: 10815 - DNA, 20 bp, Artificial Sequence
  sgRNA
tgtctaggcaaatgtctacc

SEQ ID NO: 10816 - DNA, 20 bp, Artificial Sequence
  sgRNA
cccggcgccggagcgagaag

SEQ ID NO: 10817 - DNA, 20 bp, Artificial Sequence
  sgRNA
agtcgccgttctcattacca

SEQ ID NO: 10818 - DNA, 20 bp, Artificial Sequence
  sgRNA
tcactcacgaccacgtccgc

SEQ ID NO: 10819 - DNA, 20 bp, Artificial Sequence
  sgRNA
ggaggctgagcggaacggag

SEQ ID NO: 10820 - DNA, 20 bp, Artificial Sequence
  sgRNA
gtactagctgcgggtgctgc

SEQ ID NO: 10821 - DNA, 20 bp, Artificial Sequence
  sgRNA
gcatctgtgtgactgtgttg

SEQ ID NO: 10822 - DNA, 20 bp, Artificial Sequence
  sgRNA
gcactgattgatcctgggag

SEQ ID NO: 10823 - DNA, 20 bp, Artificial Sequence
  sgRNA
ggctgcaagtcaccagactg

SEQ ID NO: 10824 - DNA, 20 bp, Artificial Sequence
  sgRNA
ggaaggaggattaaacccgg

SEQ ID NO: 10825 - DNA, 20 bp, Artificial Sequence
  sgRNA
ggcagcgaaatggtatttcc

SEQ ID NO: 10826 - DNA, 20 bp, Artificial Sequence
  sgRNA
gaaacagtacttccggcctc

SEQ ID NO: 10827 - DNA, 20 bp, Artificial Sequence
  sgRNA
ggtggaggaggcccacctgt

SEQ ID NO: 10828 - DNA, 20 bp, Artificial Sequence
  sgRNA
ggttctcagctggacagcca

SEQ ID NO: 10829 - DNA, 20 bp, Artificial Sequence
  sgRNA
ggacgcggttaacccttcct

SEQ ID NO: 10830 - DNA, 20 bp, Artificial Sequence
  sgRNA
agtcgggcgtggctcgaaag

SEQ ID NO: 10831 - DNA, 20 bp, Artificial Sequence
  sgRNA
ggcacagcttgtttgctagc

SEQ ID NO: 10832 - DNA, 20 bp, Artificial Sequence
  sgRNA
ccagacccggagttaaaggg

SEQ ID NO: 10833 - DNA, 20 bp, Artificial Sequence
  sgRNA
gcaaggtaaatgcaaacaac

SEQ ID NO: 10834 - DNA, 20 bp, Artificial Sequence
  sgRNA
gggacgacccaggagtgaag

SEQ ID NO: 10835 - DNA, 20 bp, Artificial Sequence
  sgRNA
gaccaaaggaggccagtcag

SEQ ID NO: 10836 - DNA, 20 bp, Artificial Sequence
  sgRNA
ctaggtaagtggatggtgag

SEQ ID NO: 10837 - DNA, 20 bp, Artificial Sequence
  sgRNA
agaagctttgttctaaagtc

SEQ ID NO: 10838 - DNA, 20 bp, Artificial Sequence
  sgRNA
acagggagagaaagcgaatc

SEQ ID NO: 10839 - DNA, 20 bp, Artificial Sequence
  sgRNA
aggacagcagaagcaggagc

SEQ ID NO: 10840 - DNA, 20 bp, Artificial Sequence
  sgRNA
tgacactatagtgagctgca

SEQ ID NO: 10841 - DNA, 20 bp, Artificial Sequence
  sgRNA
aggtttgaggaagtcgtggt

SEQ ID NO: 10842 - DNA, 20 bp, Artificial Sequence
  sgRNA
gagcgctgggcaggtgatgg

SEQ ID NO: 10843 - DNA, 20 bp, Artificial Sequence
  sgRNA
ccatatgtctgtatttgagc

SEQ ID NO: 10844 - DNA, 20 bp, Artificial Sequence
  sgRNA
gctggatccactgcaatggc

SEQ ID NO: 10845 - DNA, 20 bp, Artificial Sequence
  sgRNA
atttgcatatcatcactgat

SEQ ID NO: 10846 - DNA, 20 bp, Artificial Sequence
  sgRNA
tgaattcggagtgctcgtgg

SEQ ID NO: 10847 - DNA, 20 bp, Artificial Sequence
  sgRNA
cttcctgtggcgaccctgcg

SEQ ID NO: 10848 - DNA, 20 bp, Artificial Sequence
  sgRNA
aaggaaccagattagtgtgc

SEQ ID NO: 10849 - DNA, 20 bp, Artificial Sequence
  sgRNA
acttatctccaggcagtagg

SEQ ID NO: 10850 - DNA, 20 bp, Artificial Sequence
  sgRNA
gagctcggtttcgaggtcct

SEQ ID NO: 10851 - DNA, 20 bp, Artificial Sequence
  sgRNA
cccgagctagagacgccgtc

SEQ ID NO: 10852 - DNA, 20 bp, Artificial Sequence
  sgRNA
tgtgcccgcctgccaccgcc

SEQ ID NO: 10853 - DNA, 20 bp, Artificial Sequence
  sgRNA
tagagcacccacaccacaga

SEQ ID NO: 10854 - DNA, 20 bp, Artificial Sequence
  sgRNA
gaatgtgcgtatgttataaa

SEQ ID NO: 10855 - DNA, 20 bp, Artificial Sequence
  sgRNA
tgctctggcttggacgaagg

SEQ ID NO: 10856 - DNA, 20 bp, Artificial Sequence
  sgRNA
ctttcgcctccctgtcatcc

SEQ ID NO: 10857 - DNA, 20 bp, Artificial Sequence
  sgRNA
cctcggctctgaacaaggcc

SEQ ID NO: 10858 - DNA, 20 bp, Artificial Sequence
  sgRNA
acgagattcagcgttcagta

SEQ ID NO: 10859 - DNA, 20 bp, Artificial Sequence
  sgRNA
gggtataaatggagcggtgg

SEQ ID NO: 10860 - DNA, 20 bp, Artificial Sequence
  sgRNA
agagccgagacgcttaagaa

SEQ ID NO: 10861 - DNA, 20 bp, Artificial Sequence
  sgRNA
gtctccctggtctctcggag

SEQ ID NO: 10862 - DNA, 20 bp, Artificial Sequence
  sgRNA
ccagctagatgtgtgtcaca

SEQ ID NO: 10863 - DNA, 20 bp, Artificial Sequence
  sgRNA
ccgcaggttggagaggcata

SEQ ID NO: 10864 - DNA, 20 bp, Artificial Sequence
  sgRNA
caaacgttctgtatagggat

SEQ ID NO: 10865 - DNA, 20 bp, Artificial Sequence
  sgRNA
gcctgagtgttacttgccag

SEQ ID NO: 10866 - DNA, 20 bp, Artificial Sequence
  sgRNA
aagtgctgcccggtggctgc

SEQ ID NO: 10867 - DNA, 20 bp, Artificial Sequence
  sgRNA
caggcttctcaaggaccctt

SEQ ID NO: 10868 - DNA, 20 bp, Artificial Sequence
  sgRNA
ggactttgggaacctccagg

SEQ ID NO: 10869 - DNA, 20 bp, Artificial Sequence
  sgRNA
cagacacttccaggacagcc

SEQ ID NO: 10870 - DNA, 20 bp, Artificial Sequence
  sgRNA
taaccgagggtagtactgat

SEQ ID NO: 10871 - DNA, 20 bp, Artificial Sequence
  sgRNA
ctagattaacagtactaacg

SEQ ID NO: 10872 - DNA, 20 bp, Artificial Sequence
  sgRNA
gctagcgtctcgaatggcac

SEQ ID NO: 10873 - DNA, 20 bp, Artificial Sequence
  sgRNA
ggataggatagacagatggc

SEQ ID NO: 10874 - DNA, 20 bp, Artificial Sequence
  sgRNA
tggaagtctggacggatggg

SEQ ID NO: 10875 - DNA, 20 bp, Artificial Sequence
  sgRNA
gtaaatctcaaagtcaatcg

SEQ ID NO: 10876 - DNA, 20 bp, Artificial Sequence
  sgRNA
actcgcccacctttcacctt

SEQ ID NO: 10877 - DNA, 20 bp, Artificial Sequence
  sgRNA
aggtggagagtagataggcg

SEQ ID NO: 10878 - DNA, 20 bp, Artificial Sequence
  sgRNA
gaatgagaaactgagccagc

SEQ ID NO: 10879 - DNA, 20 bp, Artificial Sequence
  sgRNA
gaggaatatgctatgtagat

SEQ ID NO: 10880 - DNA, 20 bp, Artificial Sequence
  sgRNA
ggtgagcgaatggtcgcttc

SEQ ID NO: 10881 - DNA, 20 bp, Artificial Sequence
  sgRNA
gacaactttgaaacgtttaa

SEQ ID NO: 10882 - DNA, 20 bp, Artificial Sequence
  sgRNA
gtgacaaagagaatcattgc

SEQ ID NO: 10883 - DNA, 20 bp, Artificial Sequence
  sgRNA
gggcgcgcgcaggctttgtc

SEQ ID NO: 10884 - DNA, 20 bp, Artificial Sequence
  sgRNA
catacacctgaggagctact

SEQ ID NO: 10885 - DNA, 20 bp, Artificial Sequence
  sgRNA
cggagcctagctaccagtgg

SEQ ID NO: 10886 - DNA, 20 bp, Artificial Sequence
  sgRNA
ggagccagcagcgcgctgtc

SEQ ID NO: 10887 - DNA, 20 bp, Artificial Sequence
  sgRNA
cggtgaaggaggtctacttt

SEQ ID NO: 10888 - DNA, 20 bp, Artificial Sequence
  sgRNA
gcggcattcctaaggtgggt

SEQ ID NO: 10889 - DNA, 20 bp, Artificial Sequence
  sgRNA
actagggtcgatcgtattgt

SEQ ID NO: 10890 - DNA, 20 bp, Artificial Sequence
  sgRNA
agcagggtattctgggaggc

SEQ ID NO: 10891 - DNA, 20 bp, Artificial Sequence
  sgRNA
gggactcttaaatcggcgcc

SEQ ID NO: 10892 - DNA, 20 bp, Artificial Sequence
  sgRNA
tctgccaagttgaaggtgag

SEQ ID NO: 10893 - DNA, 20 bp, Artificial Sequence
  sgRNA
tagaatgtctgggtggaaca

SEQ ID NO: 10894 - DNA, 20 bp, Artificial Sequence
  sgRNA
cgggtaccgcgagactcgcg

SEQ ID NO: 10895 - DNA, 20 bp, Artificial Sequence
  sgRNA
gcagcgctctttcaggacgt

SEQ ID NO: 10896 - DNA, 20 bp, Artificial Sequence
  sgRNA
ctgcgcgcgcgctctagatc

SEQ ID NO: 10897 - DNA, 20 bp, Artificial Sequence
  sgRNA
tgtttgcggctgggcctcat

SEQ ID NO: 10898 - DNA, 20 bp, Artificial Sequence
  sgRNA
aaactggaggaagtaaaggg

SEQ ID NO: 10899 - DNA, 20 bp, Artificial Sequence
  sgRNA
gcgggaccatagagagcccg

SEQ ID NO: 10900 - DNA, 20 bp, Artificial Sequence
  sgRNA
tgatgagtggagtctcaatc

SEQ ID NO: 10901 - DNA, 20 bp, Artificial Sequence
  sgRNA
aagcaagatggccgcaccgg

SEQ ID NO: 10902 - DNA, 20 bp, Artificial Sequence
  sgRNA
agtttgttgttactacaaca

SEQ ID NO: 10903 - DNA, 20 bp, Artificial Sequence
  sgRNA
ctgcactgcctagagataaa

SEQ ID NO: 10904 - DNA, 20 bp, Artificial Sequence
  sgRNA
attggtccctgcatgcgacc

SEQ ID NO: 10905 - DNA, 20 bp, Artificial Sequence
  sgRNA
gggtgtaccggacgaattgc

SEQ ID NO: 10906 - DNA, 20 bp, Artificial Sequence
  sgRNA
aaaccttgcctgagcactag

SEQ ID NO: 10907 - DNA, 20 bp, Artificial Sequence
  sgRNA
gcgagccaagcacttagcgc

SEQ ID NO: 10908 - DNA, 20 bp, Artificial Sequence
  sgRNA
tttgctgatcaaagagcaac

SEQ ID NO: 10909 - DNA, 20 bp, Artificial Sequence
  sgRNA
gtgccggagccggttccggg

SEQ ID NO: 10910 - DNA, 20 bp, Artificial Sequence
  sgRNA
tgtttgaagacccagggcac

SEQ ID NO: 10911 - DNA, 20 bp, Artificial Sequence
  sgRNA
cagtagatgttcttacatgc

SEQ ID NO: 10912 - DNA, 20 bp, Artificial Sequence
  sgRNA
actgtcaagagctgtcatga

SEQ ID NO: 10913 - DNA, 20 bp, Artificial Sequence
  sgRNA
aggagtatatgtttaagcag

SEQ ID NO: 10914 - DNA, 20 bp, Artificial Sequence
  sgRNA
gagctaaggaaggccagctg

SEQ ID NO: 10915 - DNA, 20 bp, Artificial Sequence
  sgRNA
caactgtgctcctgtaccca

SEQ ID NO: 10916 - DNA, 20 bp, Artificial Sequence
  sgRNA
taccctgctgcagagatact

SEQ ID NO: 10917 - DNA, 20 bp, Artificial Sequence
  sgRNA
ttaacccatgctggatttgc

SEQ ID NO: 10918 - DNA, 20 bp, Artificial Sequence
  sgRNA
agagcaaggcgtcgcacaaa

SEQ ID NO: 10919 - DNA, 20 bp, Artificial Sequence
  sgRNA
ggagctgtcggccgcatttg

SEQ ID NO: 10920 - DNA, 20 bp, Artificial Sequence
  sgRNA
gcagtgtgagatgtgtcagg

SEQ ID NO: 10921 - DNA, 20 bp, Artificial Sequence
  sgRNA
ggcaccttgaaacgcgaggg

SEQ ID NO: 10922 - DNA, 20 bp, Artificial Sequence
  sgRNA
gggcggtagaaaggacgcgg

SEQ ID NO: 10923 - DNA, 20 bp, Artificial Sequence
  sgRNA
ggacacggccgcctcgcgga

SEQ ID NO: 10924 - DNA, 20 bp, Artificial Sequence
  sgRNA
acgtcaggcggcgtcacgcg

SEQ ID NO: 10925 - DNA, 20 bp, Artificial Sequence
  sgRNA
tgtcttcctttgaggaggtg

SEQ ID NO: 10926 - DNA, 20 bp, Artificial Sequence
  sgRNA
aaggtgctgacaccgtctat

SEQ ID NO: 10927 - DNA, 20 bp, Artificial Sequence
  sgRNA
tgactttgcgagcgcttccc

SEQ ID NO: 10928 - DNA, 20 bp, Artificial Sequence
  sgRNA
ggctgctgatgtaatcgcct

SEQ ID NO: 10929 - DNA, 20 bp, Artificial Sequence
  sgRNA
gattcccgcatgctagttcc

SEQ ID NO: 10930 - DNA, 20 bp, Artificial Sequence
  sgRNA
tcagccaaccagcaaaggga

SEQ ID NO: 10931 - DNA, 20 bp, Artificial Sequence
  sgRNA
cggctctctgtttcgctccc

SEQ ID NO: 10932 - DNA, 20 bp, Artificial Sequence
  sgRNA
gttatgcaagctcagactgc

SEQ ID NO: 10933 - DNA, 20 bp, Artificial Sequence
  sgRNA
gaagcctctgcgcaggcgag

SEQ ID NO: 10934 - DNA, 20 bp, Artificial Sequence
  sgRNA
ggccatattgcgcagggagg

SEQ ID NO: 10935 - DNA, 20 bp, Artificial Sequence
  sgRNA
ttaaagatcatgggtataca

SEQ ID NO: 10936 - DNA, 20 bp, Artificial Sequence
  sgRNA
cgtgcctgttgagagcggga

SEQ ID NO: 10937 - DNA, 20 bp, Artificial Sequence
  sgRNA
caaactcagaatgcagaccc

SEQ ID NO: 10938 - DNA, 20 bp, Artificial Sequence
  sgRNA
gggcagagtggttaattacc

SEQ ID NO: 10939 - DNA, 20 bp, Artificial Sequence
  sgRNA
aaggaatgtggctccgtgta

SEQ ID NO: 10940 - DNA, 20 bp, Artificial Sequence
  sgRNA
ggcgcacaaaggaagcgcgc

SEQ ID NO: 10941 - DNA, 20 bp, Artificial Sequence
  sgRNA
aggagctggcaatagaaaga

SEQ ID NO: 10942 - DNA, 20 bp, Artificial Sequence
  sgRNA
gtaatttcatccttatctcc

SEQ ID NO: 10943 - DNA, 20 bp, Artificial Sequence
  sgRNA
cacctcctggtggaacatct

SEQ ID NO: 10944 - DNA, 20 bp, Artificial Sequence
  sgRNA
aatgagctacctggatgttg

SEQ ID NO: 10945 - DNA, 20 bp, Artificial Sequence
  sgRNA
acgagcgctcgcgagaagca

SEQ ID NO: 10946 - DNA, 20 bp, Artificial Sequence
  sgRNA
ccctcactccgcgagtagca

SEQ ID NO: 10947 - DNA, 20 bp, Artificial Sequence
  sgRNA
gcttcttcccggatacccta

SEQ ID NO: 10948 - DNA, 20 bp, Artificial Sequence
  sgRNA
accggtttaaagagatagag

SEQ ID NO: 10949 - DNA, 20 bp, Artificial Sequence
  sgRNA
ctgtttgtctaagcaccgac

SEQ ID NO: 10950 - DNA, 20 bp, Artificial Sequence
  sgRNA
cctggaagtcattcatccag

SEQ ID NO: 10951 - DNA, 20 bp, Artificial Sequence
  sgRNA
cgtgtggtaggaggttccga

SEQ ID NO: 10952 - DNA, 20 bp, Artificial Sequence
  sgRNA
acacacagaaccagttgttc

SEQ ID NO: 10953 - DNA, 20 bp, Artificial Sequence
  sgRNA
tttattgggcctccgaagcg

SEQ ID NO: 10954 - DNA, 20 bp, Artificial Sequence
  sgRNA
ctaaggaaggagagcctcga

SEQ ID NO: 10955 - DNA, 20 bp, Artificial Sequence
  sgRNA
aagaaactgataatgtgcac

SEQ ID NO: 10956 - DNA, 20 bp, Artificial Sequence
  sgRNA
gcacacaacacattcagttt

SEQ ID NO: 10957 - DNA, 20 bp, Artificial Sequence
  sgRNA
gggcagatggaccacagatc

SEQ ID NO: 10958 - DNA, 20 bp, Artificial Sequence
  sgRNA
tggccaatcagcctctgcag

SEQ ID NO: 10959 - DNA, 20 bp, Artificial Sequence
  sgRNA
tcaaggccggccagggaacg

SEQ ID NO: 10960 - DNA, 20 bp, Artificial Sequence
  sgRNA
tgctgtgagctcagaacaac

SEQ ID NO: 10961 - DNA, 20 bp, Artificial Sequence
  sgRNA
aaaggcgctgaggcgccgcc

SEQ ID NO: 10962 - DNA, 20 bp, Artificial Sequence
  sgRNA
ttctcctcttctcgcgatag

SEQ ID NO: 10963 - DNA, 20 bp, Artificial Sequence
  sgRNA
caggagaagctgaggcaatc

SEQ ID NO: 10964 - DNA, 20 bp, Artificial Sequence
  sgRNA
aagggacactgtgactgagc

SEQ ID NO: 10965 - DNA, 20 bp, Artificial Sequence
  sgRNA
ctcacgtgagcgacagagat

SEQ ID NO: 10966 - DNA, 20 bp, Artificial Sequence
  sgRNA
gcttggagacctgccgcgcc

SEQ ID NO: 10967 - DNA, 20 bp, Artificial Sequence
  sgRNA
tgtatggttgccttatctcg

SEQ ID NO: 10968 - DNA, 20 bp, Artificial Sequence
  sgRNA
aaagatgaggccagaaagtt

SEQ ID NO: 10969 - DNA, 20 bp, Artificial Sequence
  sgRNA
ctggtcacgcaatgctttgt

SEQ ID NO: 10970 - DNA, 20 bp, Artificial Sequence
  sgRNA
agatctgaaattgcacggat

SEQ ID NO: 10971 - DNA, 20 bp, Artificial Sequence
  sgRNA
ggataatgaatggaatgccc

SEQ ID NO: 10972 - DNA, 20 bp, Artificial Sequence
  sgRNA
cagagtcaagaaaggaagtg

SEQ ID NO: 10973 - DNA, 20 bp, Artificial Sequence
  sgRNA
taagttgaatgcctgaggtg

SEQ ID NO: 10974 - DNA, 20 bp, Artificial Sequence
  sgRNA
tgcaggaagcttcactgtgc

SEQ ID NO: 10975 - DNA, 20 bp, Artificial Sequence
  sgRNA
gggcgggacaaccgtcacca

SEQ ID NO: 10976 - DNA, 20 bp, Artificial Sequence
  sgRNA
ctgaacttgattggttgtga

SEQ ID NO: 10977 - DNA, 20 bp, Artificial Sequence
  sgRNA
accaaggagtaaaggacttc

SEQ ID NO: 10978 - DNA, 20 bp, Artificial Sequence
  sgRNA
cagaggtgtgtgctgatgta

SEQ ID NO: 10979 - DNA, 20 bp, Artificial Sequence
  sgRNA
agcctattacttctgtttag

SEQ ID NO: 10980 - DNA, 20 bp, Artificial Sequence
  sgRNA
cccgcccagagagcacgcgt

SEQ ID NO: 10981 - DNA, 20 bp, Artificial Sequence
  sgRNA
gcgggagaatttcatcccgt

SEQ ID NO: 10982 - DNA, 20 bp, Artificial Sequence
  sgRNA
ttaactgtcttcaaacggtg

SEQ ID NO: 10983 - DNA, 20 bp, Artificial Sequence
  sgRNA
ttctgcctgggacagtaagc

SEQ ID NO: 10984 - DNA, 20 bp, Artificial Sequence
  sgRNA
gcagaatttgtaccgatagc

SEQ ID NO: 10985 - DNA, 20 bp, Artificial Sequence
  sgRNA
ggcttccgcccagaaggtac

SEQ ID NO: 10986 - DNA, 20 bp, Artificial Sequence
  sgRNA
ttacaccgctaagctgcccg

SEQ ID NO: 10987 - DNA, 20 bp, Artificial Sequence
  sgRNA
ggactaccagcaagcctgtg

SEQ ID NO: 10988 - DNA, 20 bp, Artificial Sequence
  sgRNA
gcactggtggtactgggagg

SEQ ID NO: 10989 - DNA, 20 bp, Artificial Sequence
  sgRNA
gggtttgcgttcaagtttcg

SEQ ID NO: 10990 - DNA, 20 bp, Artificial Sequence
  sgRNA
ccctgtcctctgcagctact

SEQ ID NO: 10991 - DNA, 20 bp, Artificial Sequence
  sgRNA
gcagccaaagcagatcgtga

SEQ ID NO: 10992 - DNA, 20 bp, Artificial Sequence
  sgRNA
tggtgatgctggtggtgcgc

SEQ ID NO: 10993 - DNA, 20 bp, Artificial Sequence
  sgRNA
gttataaagtgaagacagac

SEQ ID NO: 10994 - DNA, 20 bp, Artificial Sequence
  sgRNA
cactcccaaagcgctttgtc

SEQ ID NO: 10995 - DNA, 20 bp, Artificial Sequence
  sgRNA
aggaagaggaggcaggaagc

SEQ ID NO: 10996 - DNA, 20 bp, Artificial Sequence
  sgRNA
aagcattctggctccaatcc

SEQ ID NO: 10997 - DNA, 20 bp, Artificial Sequence
  sgRNA
ggttctctaacagctgttgt

SEQ ID NO: 10998 - DNA, 20 bp, Artificial Sequence
  sgRNA
ccagactcctaccaagcctc

SEQ ID NO: 10999 - DNA, 20 bp, Artificial Sequence
  sgRNA
acactagtcgagaatctaaa

SEQ ID NO: 11000 - DNA, 20 bp, Artificial Sequence
  sgRNA
ccacacttgcttgtattcag

SEQ ID NO: 11001 - DNA, 20 bp, Artificial Sequence
  sgRNA
cggaagaggacacctgatcg

SEQ ID NO: 11002 - DNA, 20 bp, Artificial Sequence
  sgRNA
ggaggcagctccgggcccgg

SEQ ID NO: 11003 - DNA, 20 bp, Artificial Sequence
  sgRNA
tcaaggcgctccagaaaccg

SEQ ID NO: 11004 - DNA, 20 bp, Artificial Sequence
  sgRNA
ctttaaacagaatgttacct

SEQ ID NO: 11005 - DNA, 20 bp, Artificial Sequence
  sgRNA
ggcggcgaccgctttgtcta

SEQ ID NO: 11006 - DNA, 20 bp, Artificial Sequence
  sgRNA
tctgggcaagagcgcggcac

SEQ ID NO: 11007 - DNA, 20 bp, Artificial Sequence
  sgRNA
gtgaggatctttgctgcaga

SEQ ID NO: 11008 - DNA, 20 bp, Artificial Sequence
  sgRNA
ttataggacgtaagtgaaag

SEQ ID NO: 11009 - DNA, 20 bp, Artificial Sequence
  sgRNA
acgcgggagcgcacagtcag

SEQ ID NO: 11010 - DNA, 20 bp, Artificial Sequence
  sgRNA
ctagtgggcgtgaaggaggc

SEQ ID NO: 11011 - DNA, 20 bp, Artificial Sequence
  sgRNA
cgcgcactgcgaaagtgaga

SEQ ID NO: 11012 - DNA, 20 bp, Artificial Sequence
  sgRNA
aagtgagggacttcgaggcc

SEQ ID NO: 11013 - DNA, 20 bp, Artificial Sequence
  sgRNA
tggttgtaagggattgggcc

SEQ ID NO: 11014 - DNA, 20 bp, Artificial Sequence
  sgRNA
tcacagtactcaaagtaaag

SEQ ID NO: 11015 - DNA, 20 bp, Artificial Sequence
  sgRNA
ggatccctggctgggcggac

SEQ ID NO: 11016 - DNA, 20 bp, Artificial Sequence
  sgRNA
cggcgcaacgctgggactcc

SEQ ID NO: 11017 - DNA, 20 bp, Artificial Sequence
  sgRNA
gagcgggcaggccttgcgcc

SEQ ID NO: 11018 - DNA, 20 bp, Artificial Sequence
  sgRNA
ggcgcgaagagggtgctcgt

SEQ ID NO: 11019 - DNA, 20 bp, Artificial Sequence
  sgRNA
ggagttgctggcgcatcagt

SEQ ID NO: 11020 - DNA, 20 bp, Artificial Sequence
  sgRNA
ccacccgcacttccggacct

SEQ ID NO: 11021 - DNA, 20 bp, Artificial Sequence
  sgRNA
tcccggacgcctcccgctaa

SEQ ID NO: 11022 - DNA, 20 bp, Artificial Sequence
  sgRNA
gtgtctactagctctgtgca

SEQ ID NO: 11023 - DNA, 20 bp, Artificial Sequence
  sgRNA
aggtagggcgcaagacctgg

SEQ ID NO: 11024 - DNA, 20 bp, Artificial Sequence
  sgRNA
gaggagggaggtggaggagg

SEQ ID NO: 11025 - DNA, 20 bp, Artificial Sequence
  sgRNA
ctgctgctgcgaaagagagc

SEQ ID NO: 11026 - DNA, 20 bp, Artificial Sequence
  sgRNA
tagggagagacacccgccaa

SEQ ID NO: 11027 - DNA, 20 bp, Artificial Sequence
  sgRNA
ggatgagaacgccggcctct

SEQ ID NO: 11028 - DNA, 20 bp, Artificial Sequence
  sgRNA
tgaccagggtgattcagttt

SEQ ID NO: 11029 - DNA, 20 bp, Artificial Sequence
  sgRNA
aacggtacacacgttcctta

SEQ ID NO: 11030 - DNA, 20 bp, Artificial Sequence
  sgRNA
gtgactctggagtactgtat

SEQ ID NO: 11031 - DNA, 20 bp, Artificial Sequence
  sgRNA
gggaacagttagacatgaaa

SEQ ID NO: 11032 - DNA, 20 bp, Artificial Sequence
  sgRNA
ggcggaggaagaaaggtggc

SEQ ID NO: 11033 - DNA, 20 bp, Artificial Sequence
  sgRNA
ggaagagatcgctcactcgg

SEQ ID NO: 11034 - DNA, 20 bp, Artificial Sequence
  sgRNA
cacgcacttaacgttactgt

SEQ ID NO: 11035 - DNA, 20 bp, Artificial Sequence
  sgRNA
tgcgttggtttggcgggttg

SEQ ID NO: 11036 - DNA, 20 bp, Artificial Sequence
  sgRNA
ctgtggtacctgccctgcag

SEQ ID NO: 11037 - DNA, 20 bp, Artificial Sequence
  sgRNA
cgcgttaaggtgtgtcaaga

SEQ ID NO: 11038 - DNA, 20 bp, Artificial Sequence
  sgRNA
acagggaaagaggccaaatt

SEQ ID NO: 11039 - DNA, 20 bp, Artificial Sequence
  sgRNA
aatcagtcatctaaacttct

SEQ ID NO: 11040 - DNA, 20 bp, Artificial Sequence
  sgRNA
atctcatgcgcacagctcaa

SEQ ID NO: 11041 - DNA, 20 bp, Artificial Sequence
  sgRNA
cttggctgcagttgtgcggc

SEQ ID NO: 11042 - DNA, 20 bp, Artificial Sequence
  sgRNA
taggtgggacacacctctca

SEQ ID NO: 11043 - DNA, 20 bp, Artificial Sequence
  sgRNA
tgggccacaccttcttctct

SEQ ID NO: 11044 - DNA, 20 bp, Artificial Sequence
  sgRNA
tagtctagttaatctacgcc

SEQ ID NO: 11045 - DNA, 20 bp, Artificial Sequence
  sgRNA
cgagaccagttggcgggaat

SEQ ID NO: 11046 - DNA, 20 bp, Artificial Sequence
  sgRNA
aaggttccgccctacccgtc

SEQ ID NO: 11047 - DNA, 20 bp, Artificial Sequence
  sgRNA
ccgctctgctgtgcgattta

SEQ ID NO: 11048 - DNA, 20 bp, Artificial Sequence
  sgRNA
tcccgcaggaacaggagctt

SEQ ID NO: 11049 - DNA, 20 bp, Artificial Sequence
  sgRNA
ccagccagtgagacagtgac

SEQ ID NO: 11050 - DNA, 20 bp, Artificial Sequence
  sgRNA
cccacccaccagaatcctcg

SEQ ID NO: 11051 - DNA, 20 bp, Artificial Sequence
  sgRNA
caacttacatttgcagccgg

SEQ ID NO: 11052 - DNA, 20 bp, Artificial Sequence
  sgRNA
gacgcggttgctaaggaagt

SEQ ID NO: 11053 - DNA, 20 bp, Artificial Sequence
  sgRNA
gaactgagtgcgccagagag

SEQ ID NO: 11054 - DNA, 20 bp, Artificial Sequence
  sgRNA
gagggtctgtgtagttctaa

SEQ ID NO: 11055 - DNA, 20 bp, Artificial Sequence
  sgRNA
tctgggtaacctcacgtgac

SEQ ID NO: 11056 - DNA, 20 bp, Artificial Sequence
  sgRNA
taaatgttgctctccagctt

SEQ ID NO: 11057 - DNA, 20 bp, Artificial Sequence
  sgRNA
tacataactgagattaagtg

SEQ ID NO: 11058 - DNA, 20 bp, Artificial Sequence
  sgRNA
accctgtaatttcaacagcc

SEQ ID NO: 11059 - DNA, 20 bp, Artificial Sequence
  sgRNA
gactctgcttgcagggaaag

SEQ ID NO: 11060 - DNA, 20 bp, Artificial Sequence
  sgRNA
gggcttgatcagccacactg

SEQ ID NO: 11061 - DNA, 20 bp, Artificial Sequence
  sgRNA
cgcgcggagcccgcgtggag

SEQ ID NO: 11062 - DNA, 20 bp, Artificial Sequence
  sgRNA
ggattggattggctaatccg

SEQ ID NO: 11063 - DNA, 20 bp, Artificial Sequence
  sgRNA
ttctactcaccatctaatcc

SEQ ID NO: 11064 - DNA, 20 bp, Artificial Sequence
  sgRNA
ggagtctgccagcgatctct

SEQ ID NO: 11065 - DNA, 20 bp, Artificial Sequence
  sgRNA
gcgagttagagttaggcgcg

SEQ ID NO: 11066 - DNA, 20 bp, Artificial Sequence
  sgRNA
ctgcgcagccgagaggcggg

SEQ ID NO: 11067 - DNA, 20 bp, Artificial Sequence
  sgRNA
cgcccgcggattgcgagcag

SEQ ID NO: 11068 - DNA, 20 bp, Artificial Sequence
  sgRNA
ggaaaggaagaggagcctag

SEQ ID NO: 11069 - DNA, 20 bp, Artificial Sequence
  sgRNA
tcaggcaacgcaagcgcaag

SEQ ID NO: 11070 - DNA, 20 bp, Artificial Sequence
  sgRNA
aatggcgtctccggagcccg

SEQ ID NO: 11071 - DNA, 20 bp, Artificial Sequence
  sgRNA
tttgcggataaggaaccaaa

SEQ ID NO: 11072 - DNA, 20 bp, Artificial Sequence
  sgRNA
cctgagcaccagggtagggt

SEQ ID NO: 11073 - DNA, 20 bp, Artificial Sequence
  sgRNA
accagcacccaggaacggcc

SEQ ID NO: 11074 - DNA, 20 bp, Artificial Sequence
  sgRNA
cgcaagcattgtgagaaccg

SEQ ID NO: 11075 - DNA, 20 bp, Artificial Sequence
  sgRNA
tgaatgagtctttcgccaat

SEQ ID NO: 11076 - DNA, 20 bp, Artificial Sequence
  sgRNA
agaggacattgtgccttagg

SEQ ID NO: 11077 - DNA, 20 bp, Artificial Sequence
  sgRNA
cttagactaagcctttccgg

SEQ ID NO: 11078 - DNA, 20 bp, Artificial Sequence
  sgRNA
agaatgagatgtcaattcag

SEQ ID NO: 11079 - DNA, 20 bp, Artificial Sequence
  sgRNA
ttgtcagcagcattaagcag

SEQ ID NO: 11080 - DNA, 20 bp, Artificial Sequence
  sgRNA
cgagtctagttctattaagt

SEQ ID NO: 11081 - DNA, 20 bp, Artificial Sequence
  sgRNA
ccacctacgggcggagagaa

SEQ ID NO: 11082 - DNA, 20 bp, Artificial Sequence
  sgRNA
ccagacggcagtgggatagc

SEQ ID NO: 11083 - DNA, 20 bp, Artificial Sequence
  sgRNA
ccgaagccgcgcagtttaga

SEQ ID NO: 11084 - DNA, 20 bp, Artificial Sequence
  sgRNA
ctttaatcttgtcgtcgcac

SEQ ID NO: 11085 - DNA, 20 bp, Artificial Sequence
  sgRNA
tgtctcacaactcagattaa

SEQ ID NO: 11086 - DNA, 20 bp, Artificial Sequence
  sgRNA
agagggagaagctcgtcacc

SEQ ID NO: 11087 - DNA, 20 bp, Artificial Sequence
  sgRNA
cgaggacagtccactagagg

SEQ ID NO: 11088 - DNA, 20 bp, Artificial Sequence
  sgRNA
ggaccaccacttagttatga

SEQ ID NO: 11089 - DNA, 20 bp, Artificial Sequence
  sgRNA
tgcccagatcggcagagtag

SEQ ID NO: 11090 - DNA, 20 bp, Artificial Sequence
  sgRNA
gcccgtctgtggagcgcgta

SEQ ID NO: 11091 - DNA, 20 bp, Artificial Sequence
  sgRNA
cccttgtggtgagatcacag

SEQ ID NO: 11092 - DNA, 20 bp, Artificial Sequence
  sgRNA
cttggcgattggacgagagt

SEQ ID NO: 11093 - DNA, 20 bp, Artificial Sequence
  sgRNA
gtcagttggatcagggtgga

SEQ ID NO: 11094 - DNA, 20 bp, Artificial Sequence
  sgRNA
gctgcgtgcgcacgtcatca

SEQ ID NO: 11095 - DNA, 20 bp, Artificial Sequence
  sgRNA
cggagcagggatctcgtgct

SEQ ID NO: 11096 - DNA, 20 bp, Artificial Sequence
  sgRNA
tttcgggacggcggctctcc

SEQ ID NO: 11097 - DNA, 20 bp, Artificial Sequence
  sgRNA
gctgggctatgacggcagag

SEQ ID NO: 11098 - DNA, 20 bp, Artificial Sequence
  sgRNA
gcgcaaacaccctccgaccg

SEQ ID NO: 11099 - DNA, 20 bp, Artificial Sequence
  sgRNA
gtggttctgagatttcctac

SEQ ID NO: 11100 - DNA, 20 bp, Artificial Sequence
  sgRNA
catggactacattcagcctt

SEQ ID NO: 11101 - DNA, 20 bp, Artificial Sequence
  sgRNA
tattagaagaattccgttcc

SEQ ID NO: 11102 - DNA, 20 bp, Artificial Sequence
  sgRNA
acacgcctacttctcccaca

SEQ ID NO: 11103 - DNA, 20 bp, Artificial Sequence
  sgRNA
cgcattaaagagacaagcta

SEQ ID NO: 11104 - DNA, 20 bp, Artificial Sequence
  sgRNA
gcctgacgtgagaagcgcga

SEQ ID NO: 11105 - DNA, 20 bp, Artificial Sequence
  sgRNA
ggcttcaagacagaagtagg

SEQ ID NO: 11106 - DNA, 20 bp, Artificial Sequence
  sgRNA
cttcctcgctcagtccgacg

SEQ ID NO: 11107 - DNA, 20 bp, Artificial Sequence
  sgRNA
tgctcgcctactcttccgct

SEQ ID NO: 11108 - DNA, 20 bp, Artificial Sequence
  sgRNA
agactgctggctgcagacgc

SEQ ID NO: 11109 - DNA, 20 bp, Artificial Sequence
  sgRNA
cgcccaactctcgcgatacc

SEQ ID NO: 11110 - DNA, 20 bp, Artificial Sequence
  sgRNA
ttgcctagagttgctaagtt

SEQ ID NO: 11111 - DNA, 20 bp, Artificial Sequence
  sgRNA
aacttcacccgaagaatcct

SEQ ID NO: 11112 - DNA, 20 bp, Artificial Sequence
  sgRNA
cctaaggagttgtgagtgga

SEQ ID NO: 11113 - DNA, 20 bp, Artificial Sequence
  sgRNA
gatgtgtcctgggagggccc

SEQ ID NO: 11114 - DNA, 20 bp, Artificial Sequence
  sgRNA
tctccctgagtcctaacgtg

SEQ ID NO: 11115 - DNA, 20 bp, Artificial Sequence
  sgRNA
agcggcgcccgcgtgacaat

SEQ ID NO: 11116 - DNA, 20 bp, Artificial Sequence
  sgRNA
tgcgcatgtgcaagaggagc

SEQ ID NO: 11117 - DNA, 20 bp, Artificial Sequence
  sgRNA
gccgatatgcaggcggcgcg

SEQ ID NO: 11118 - DNA, 20 bp, Artificial Sequence
  sgRNA
gagctaatgctgggctccat

SEQ ID NO: 11119 - DNA, 20 bp, Artificial Sequence
  sgRNA
tggccgcggcccatgtgacc

SEQ ID NO: 11120 - DNA, 20 bp, Artificial Sequence
  sgRNA
gctgccgtaggtagtgctct

SEQ ID NO: 11121 - DNA, 20 bp, Artificial Sequence
  sgRNA
ggatccgcaggcaagactta

SEQ ID NO: 11122 - DNA, 20 bp, Artificial Sequence
  sgRNA
gaagactggccgtcacggga

SEQ ID NO: 11123 - DNA, 20 bp, Artificial Sequence
  sgRNA
aacggcagggaactaggtcg

SEQ ID NO: 11124 - DNA, 20 bp, Artificial Sequence
  sgRNA
gggaaggcagcggaaagtag

SEQ ID NO: 11125 - DNA, 20 bp, Artificial Sequence
  sgRNA
ctccgactacaagtcccaaa

SEQ ID NO: 11126 - DNA, 20 bp, Artificial Sequence
  sgRNA
atgaataatgtgagcgttgg

SEQ ID NO: 11127 - DNA, 20 bp, Artificial Sequence
  sgRNA
ttgcctcggcccgacccacg

SEQ ID NO: 11128 - DNA, 20 bp, Artificial Sequence
  sgRNA
aggcggccgacctgtggact

SEQ ID NO: 11129 - DNA, 20 bp, Artificial Sequence
  sgRNA
aggtgtggtgctttgccaaa

SEQ ID NO: 11130 - DNA, 20 bp, Artificial Sequence
  sgRNA
cttgagtgggttgggagtgg

SEQ ID NO: 11131 - DNA, 20 bp, Artificial Sequence
  sgRNA
tttccggccgtgaggtaagg

SEQ ID NO: 11132 - DNA, 20 bp, Artificial Sequence
  sgRNA
actcgagcaacgggcacaag

SEQ ID NO: 11133 - DNA, 20 bp, Artificial Sequence
  sgRNA
cccagcaaagaagagcatgc

SEQ ID NO: 11134 - DNA, 20 bp, Artificial Sequence
  sgRNA
cccttgatgggacccttgaa

SEQ ID NO: 11135 - DNA, 20 bp, Artificial Sequence
  sgRNA
tctctgggttagagtggtgc

SEQ ID NO: 11136 - DNA, 20 bp, Artificial Sequence
  sgRNA
ggacattgccttcccttccc

SEQ ID NO: 11137 - DNA, 20 bp, Artificial Sequence
  sgRNA
tccgctgggtccaggagcag

SEQ ID NO: 11138 - DNA, 20 bp, Artificial Sequence
  sgRNA
gtgtcatctcctaaccaccc

SEQ ID NO: 11139 - DNA, 20 bp, Artificial Sequence
  sgRNA
gcacacctccttgcgccgcg

SEQ ID NO: 11140 - DNA, 20 bp, Artificial Sequence
  sgRNA
tggcgcggcggagcagggag

SEQ ID NO: 11141 - DNA, 20 bp, Artificial Sequence
  sgRNA
ggcagcggccgcgtccacgt

SEQ ID NO: 11142 - DNA, 20 bp, Artificial Sequence
  sgRNA
ctaccagcccgcctactggg

SEQ ID NO: 11143 - DNA, 20 bp, Artificial Sequence
  sgRNA
agtaaactagctgtttgcag

SEQ ID NO: 11144 - DNA, 20 bp, Artificial Sequence
  sgRNA
gagaccggagggaaacgaac

SEQ ID NO: 11145 - DNA, 20 bp, Artificial Sequence
  sgRNA
atcaagaatgagggtggact

SEQ ID NO: 11146 - DNA, 20 bp, Artificial Sequence
  sgRNA
gtccatttccctcccttcaa

SEQ ID NO: 11147 - DNA, 20 bp, Artificial Sequence
  sgRNA
gagtgctggacctggttcgg

SEQ ID NO: 11148 - DNA, 20 bp, Artificial Sequence
  sgRNA
tatgcctcccgtctgtacta

SEQ ID NO: 11149 - DNA, 20 bp, Artificial Sequence
  sgRNA
cgaggttctgtccgcttgtc

SEQ ID NO: 11150 - DNA, 20 bp, Artificial Sequence
  sgRNA
tctcgccatgtctctcctct

SEQ ID NO: 11151 - DNA, 20 bp, Artificial Sequence
  sgRNA
actcccagagagctcccttc

SEQ ID NO: 11152 - DNA, 20 bp, Artificial Sequence
  sgRNA
ggcgggcagaagcctgtgat

SEQ ID NO: 11153 - DNA, 20 bp, Artificial Sequence
  sgRNA
acaaagactggtctgtagcc

SEQ ID NO: 11154 - DNA, 20 bp, Artificial Sequence
  sgRNA
gctggacacgggaggactac

SEQ ID NO: 11155 - DNA, 20 bp, Artificial Sequence
  sgRNA
gtaaggttattaaatggctt

SEQ ID NO: 11156 - DNA, 20 bp, Artificial Sequence
  sgRNA
gcttatcggaggacggaggg

SEQ ID NO: 11157 - DNA, 20 bp, Artificial Sequence
  sgRNA
atgtctagcatctcttctct

SEQ ID NO: 11158 - DNA, 20 bp, Artificial Sequence
  sgRNA
tccgatttaaacgtgatagt

SEQ ID NO: 11159 - DNA, 20 bp, Artificial Sequence
  sgRNA
gggcgggcagcctccagacc

SEQ ID NO: 11160 - DNA, 20 bp, Artificial Sequence
  sgRNA
gcgggacatcctgaaataat

SEQ ID NO: 11161 - DNA, 20 bp, Artificial Sequence
  sgRNA
gtagaactggtgcaagttgg

SEQ ID NO: 11162 - DNA, 20 bp, Artificial Sequence
  sgRNA
ccggacagaggtagatgaac

SEQ ID NO: 11163 - DNA, 20 bp, Artificial Sequence
  sgRNA
ctcaaacaagtctttccact

SEQ ID NO: 11164 - DNA, 20 bp, Artificial Sequence
  sgRNA
gagggagcttctgaaggtgg

SEQ ID NO: 11165 - DNA, 20 bp, Artificial Sequence
  sgRNA
cgaggcaatgggcacccgtc

SEQ ID NO: 11166 - DNA, 20 bp, Artificial Sequence
  sgRNA
ttgtggtagcctagactcac

SEQ ID NO: 11167 - DNA, 20 bp, Artificial Sequence
  sgRNA
acactgtgtcacaatccatg

SEQ ID NO: 11168 - DNA, 20 bp, Artificial Sequence
  sgRNA
tctcagagatccgtaagcaa

SEQ ID NO: 11169 - DNA, 20 bp, Artificial Sequence
  sgRNA
cgtggtgtgtgtgggtcttc

SEQ ID NO: 11170 - DNA, 20 bp, Artificial Sequence
  sgRNA
tgtcttctagtctcaagatc

SEQ ID NO: 11171 - DNA, 20 bp, Artificial Sequence
  sgRNA
gggccgcgcaagtcagaggg

SEQ ID NO: 11172 - DNA, 20 bp, Artificial Sequence
  sgRNA
tacgcggagaaactaatatt

SEQ ID NO: 11173 - DNA, 20 bp, Artificial Sequence
  sgRNA
actctgtccgcccaggatcg

SEQ ID NO: 11174 - DNA, 20 bp, Artificial Sequence
  sgRNA
gggcccgcctacgaggacgg

SEQ ID NO: 11175 - DNA, 20 bp, Artificial Sequence
  sgRNA
gtgaggaggattcattctct

SEQ ID NO: 11176 - DNA, 20 bp, Artificial Sequence
  sgRNA
aaagcctctcacaggagttt

SEQ ID NO: 11177 - DNA, 20 bp, Artificial Sequence
  sgRNA
gctgatatggaagatgatta

SEQ ID NO: 11178 - DNA, 20 bp, Artificial Sequence
  sgRNA
ttggatttcttgtagtgcca

SEQ ID NO: 11179 - DNA, 20 bp, Artificial Sequence
  sgRNA
aaccaaatctttgcgggtgc

SEQ ID NO: 11180 - DNA, 20 bp, Artificial Sequence
  sgRNA
tttgggcgcacccgcggcag

SEQ ID NO: 11181 - DNA, 20 bp, Artificial Sequence
  sgRNA
agaggagccaaagagacaat

SEQ ID NO: 11182 - DNA, 20 bp, Artificial Sequence
  sgRNA
ggtgagagcgccttgaggtg

SEQ ID NO: 11183 - DNA, 20 bp, Artificial Sequence
  sgRNA
gttgttcgtttgaacctcgg

SEQ ID NO: 11184 - DNA, 20 bp, Artificial Sequence
  sgRNA
cgcatgccggcacgtggtgc

SEQ ID NO: 11185 - DNA, 20 bp, Artificial Sequence
  sgRNA
ctgggtgggcccttagagga

SEQ ID NO: 11186 - DNA, 20 bp, Artificial Sequence
  sgRNA
taaacaactgtgtcttcacc

SEQ ID NO: 11187 - DNA, 20 bp, Artificial Sequence
  sgRNA
gtctccaacatttcctcctg

SEQ ID NO: 11188 - DNA, 20 bp, Artificial Sequence
  sgRNA
gaaagccaatagatactggg

SEQ ID NO: 11189 - DNA, 20 bp, Artificial Sequence
  sgRNA
tgggagcctccggagcgccc

SEQ ID NO: 11190 - DNA, 20 bp, Artificial Sequence
  sgRNA
aggacttcccatgggcgtga

SEQ ID NO: 11191 - DNA, 20 bp, Artificial Sequence
  sgRNA
agcctgagagcttaggcctt

SEQ ID NO: 11192 - DNA, 20 bp, Artificial Sequence
  sgRNA
acgggcgggaccggccggag

SEQ ID NO: 11193 - DNA, 20 bp, Artificial Sequence
  sgRNA
gcggagcaggtggtcacggg

SEQ ID NO: 11194 - DNA, 20 bp, Artificial Sequence
  sgRNA
ggacgattacccgcgggagg

SEQ ID NO: 11195 - DNA, 20 bp, Artificial Sequence
  sgRNA
gaagacagagcgcactaagc

SEQ ID NO: 11196 - DNA, 20 bp, Artificial Sequence
  sgRNA
tgatactgtcagctagtcct

SEQ ID NO: 11197 - DNA, 20 bp, Artificial Sequence
  sgRNA
gaacgaccggcgcacgggcc

SEQ ID NO: 11198 - DNA, 20 bp, Artificial Sequence
  sgRNA
gacaaagtttcaggagactt

SEQ ID NO: 11199 - DNA, 20 bp, Artificial Sequence
  sgRNA
aaacaggaaagctattggtt

SEQ ID NO: 11200 - DNA, 20 bp, Artificial Sequence
  sgRNA
tacctataattgtatccaac

SEQ ID NO: 11201 - DNA, 20 bp, Artificial Sequence
  sgRNA
aagacatacgctccgcaggc

SEQ ID NO: 11202 - DNA, 20 bp, Artificial Sequence
  sgRNA
aagacgctgcaaggaagcat

SEQ ID NO: 11203 - DNA, 20 bp, Artificial Sequence
  sgRNA
ggtcacaggccacgggtccc

SEQ ID NO: 11204 - DNA, 20 bp, Artificial Sequence
  sgRNA
gtgacgcacttcctattgcg

SEQ ID NO: 11205 - DNA, 20 bp, Artificial Sequence
  sgRNA
tatgagacaagcccatactc

SEQ ID NO: 11206 - DNA, 20 bp, Artificial Sequence
  sgRNA
gctggatccataagggagtc

SEQ ID NO: 11207 - DNA, 20 bp, Artificial Sequence
  sgRNA
aattggacttcagtgtttcg

SEQ ID NO: 11208 - DNA, 20 bp, Artificial Sequence
  sgRNA
gaaggagcgcgcgaaagggt

SEQ ID NO: 11209 - DNA, 20 bp, Artificial Sequence
  sgRNA
agtgcgagctgcgtgctgac

SEQ ID NO: 11210 - DNA, 20 bp, Artificial Sequence
  sgRNA
ttggctgtgcatcttcaaac

SEQ ID NO: 11211 - DNA, 20 bp, Artificial Sequence
  sgRNA
ctaagaggcaccaggctgcc

SEQ ID NO: 11212 - DNA, 20 bp, Artificial Sequence
  sgRNA
gtaatgagaagtgacgggct

SEQ ID NO: 11213 - DNA, 20 bp, Artificial Sequence
  sgRNA
ggtagcaacgtcggacaccc

SEQ ID NO: 11214 - DNA, 20 bp, Artificial Sequence
  sgRNA
gcctattaaataaacccttt

SEQ ID NO: 11215 - DNA, 20 bp, Artificial Sequence
  sgRNA
ggagggcggtgcccgcatga

SEQ ID NO: 11216 - DNA, 20 bp, Artificial Sequence
  sgRNA
agtaagccagctcgacccgc

SEQ ID NO: 11217 - DNA, 20 bp, Artificial Sequence
  sgRNA
aggcgggcccttcagccagc

SEQ ID NO: 11218 - DNA, 20 bp, Artificial Sequence
  sgRNA
ggacgtcctccttactccgc

SEQ ID NO: 11219 - DNA, 20 bp, Artificial Sequence
  sgRNA
aactaagggctagatctgca

SEQ ID NO: 11220 - DNA, 20 bp, Artificial Sequence
  sgRNA
cactgggtcaaggatgtgcc

SEQ ID NO: 11221 - DNA, 20 bp, Artificial Sequence
  sgRNA
gtgctaggcaagccagcgtg

SEQ ID NO: 11222 - DNA, 20 bp, Artificial Sequence
  sgRNA
atcagtttcatgttgaaagt

SEQ ID NO: 11223 - DNA, 20 bp, Artificial Sequence
  sgRNA
ctcagaggcagaatctgctg

SEQ ID NO: 11224 - DNA, 20 bp, Artificial Sequence
  sgRNA
gcagctgttgcaccaagagg

SEQ ID NO: 11225 - DNA, 20 bp, Artificial Sequence
  sgRNA
ggagcgcagcgcgtgctgcg

SEQ ID NO: 11226 - DNA, 20 bp, Artificial Sequence
  sgRNA
gcatgcgcgactgagcagag

SEQ ID NO: 11227 - DNA, 20 bp, Artificial Sequence
  sgRNA
cttatttgacgctgcccact

SEQ ID NO: 11228 - DNA, 20 bp, Artificial Sequence
  sgRNA
gagagaggctgaaatgtcgt

SEQ ID NO: 11229 - DNA, 20 bp, Artificial Sequence
  sgRNA
gatcacgtgacggagctctc

SEQ ID NO: 11230 - DNA, 20 bp, Artificial Sequence
  sgRNA
ctcctgtatcaggagagcaa

SEQ ID NO: 11231 - DNA, 20 bp, Artificial Sequence
  sgRNA
ggcggtggctggcgtctcat

SEQ ID NO: 11232 - DNA, 20 bp, Artificial Sequence
  sgRNA
gagggattaagggctgcagc

SEQ ID NO: 11233 - DNA, 20 bp, Artificial Sequence
  sgRNA
ggccgcacctgactgttcac

SEQ ID NO: 11234 - DNA, 20 bp, Artificial Sequence
  sgRNA
acgcgcccgccttctggcac

SEQ ID NO: 11235 - DNA, 20 bp, Artificial Sequence
  sgRNA
tgtagcagccaatcgaggcg

SEQ ID NO: 11236 - DNA, 20 bp, Artificial Sequence
  sgRNA
cccagaagccagggcgaacc

SEQ ID NO: 11237 - DNA, 20 bp, Artificial Sequence
  sgRNA
cccgaaagtgctaccaagtt

SEQ ID NO: 11238 - DNA, 20 bp, Artificial Sequence
  sgRNA
cacacaatacacttgaacaa

SEQ ID NO: 11239 - DNA, 20 bp, Artificial Sequence
  sgRNA
tttattgtccctccaatttc

SEQ ID NO: 11240 - DNA, 20 bp, Artificial Sequence
  sgRNA
gtccgagactggagagtgcg

SEQ ID NO: 11241 - DNA, 20 bp, Artificial Sequence
  sgRNA
gaaggctcttccgcgctgac

SEQ ID NO: 11242 - DNA, 20 bp, Artificial Sequence
  sgRNA
catagagtctggcctaggtt

SEQ ID NO: 11243 - DNA, 20 bp, Artificial Sequence
  sgRNA
atcctagagaccacctacgt

SEQ ID NO: 11244 - DNA, 20 bp, Artificial Sequence
  sgRNA
taattgggcattgaagactt

SEQ ID NO: 11245 - DNA, 20 bp, Artificial Sequence
  sgRNA
gttacgcatgcgactggagg

SEQ ID NO: 11246 - DNA, 20 bp, Artificial Sequence
  sgRNA
gtggatacttgtagggcctg

SEQ ID NO: 11247 - DNA, 20 bp, Artificial Sequence
  sgRNA
cttcggacgccagccaatag

SEQ ID NO: 11248 - DNA, 20 bp, Artificial Sequence
  sgRNA
agcctatgtaaatgacaagg

SEQ ID NO: 11249 - DNA, 20 bp, Artificial Sequence
  sgRNA
agctccaaccctacttaaac

SEQ ID NO: 11250 - DNA, 20 bp, Artificial Sequence
  sgRNA
ctactggcctatttcttaga

SEQ ID NO: 11251 - DNA, 20 bp, Artificial Sequence
  sgRNA
cgtgaccacagcctatgccg

SEQ ID NO: 11252 - DNA, 20 bp, Artificial Sequence
  sgRNA
cgcacgcccagagatctcgc

SEQ ID NO: 11253 - DNA, 20 bp, Artificial Sequence
  sgRNA
tgtgtgctccaacagtgagt

SEQ ID NO: 11254 - DNA, 20 bp, Artificial Sequence
  sgRNA
atgtcataggacagacacta

SEQ ID NO: 11255 - DNA, 20 bp, Artificial Sequence
  sgRNA
ggcagtgatgcaagcgtttc

SEQ ID NO: 11256 - DNA, 20 bp, Artificial Sequence
  sgRNA
gggctctggttaagtttcct

SEQ ID NO: 11257 - DNA, 20 bp, Artificial Sequence
  sgRNA
gtcactctgcgaaaggcgcc

SEQ ID NO: 11258 - DNA, 20 bp, Artificial Sequence
  sgRNA
aggtgtgcggcttctaggaa

SEQ ID NO: 11259 - DNA, 20 bp, Artificial Sequence
  sgRNA
ggctactcctttgagaccct

SEQ ID NO: 11260 - DNA, 20 bp, Artificial Sequence
  sgRNA
tctaatcatagtgagcatgc

SEQ ID NO: 11261 - DNA, 20 bp, Artificial Sequence
  sgRNA
gcgctcggtgccaactgatg

SEQ ID NO: 11262 - DNA, 20 bp, Artificial Sequence
  sgRNA
gaggaagtaactaactcgcc

SEQ ID NO: 11263 - DNA, 20 bp, Artificial Sequence
  sgRNA
atgaagcgcctggatagtcc

SEQ ID NO: 11264 - DNA, 20 bp, Artificial Sequence
  sgRNA
agaagaggcaccaccttctt

SEQ ID NO: 11265 - DNA, 20 bp, Artificial Sequence
  sgRNA
tggtcttaataggtgtgggc

SEQ ID NO: 11266 - DNA, 20 bp, Artificial Sequence
  sgRNA
ctgtggcacctgccctgcag

SEQ ID NO: 11267 - DNA, 20 bp, Artificial Sequence
  sgRNA
gaccatcctataaggaagca

SEQ ID NO: 11268 - DNA, 20 bp, Artificial Sequence
  sgRNA
caggtctctcgggtaacagg

SEQ ID NO: 11269 - DNA, 20 bp, Artificial Sequence
  sgRNA
cggtgcccgctgaggcaaca

SEQ ID NO: 11270 - DNA, 20 bp, Artificial Sequence
  sgRNA
gaggtgctaaagcacagcaa

SEQ ID NO: 11271 - DNA, 20 bp, Artificial Sequence
  sgRNA
aatctagcatttccattggg

SEQ ID NO: 11272 - DNA, 20 bp, Artificial Sequence
  sgRNA
cccggagtcagctccagggc

SEQ ID NO: 11273 - DNA, 20 bp, Artificial Sequence
  sgRNA
gttgaatcccatgccagttc

SEQ ID NO: 11274 - DNA, 20 bp, Artificial Sequence
  sgRNA
tccgcgctgagattgcggag

SEQ ID NO: 11275 - DNA, 20 bp, Artificial Sequence
  sgRNA
ccaacattgtctctcataga

SEQ ID NO: 11276 - DNA, 20 bp, Artificial Sequence
  sgRNA
gctgtgagctgcagatggta

SEQ ID NO: 11277 - DNA, 20 bp, Artificial Sequence
  sgRNA
ctcccggcatgcctcacgga

SEQ ID NO: 11278 - DNA, 20 bp, Artificial Sequence
  sgRNA
ggatagtctgattgtataaa

SEQ ID NO: 11279 - DNA, 20 bp, Artificial Sequence
  sgRNA
aacgggaagtgtgcgctgat

SEQ ID NO: 11280 - DNA, 20 bp, Artificial Sequence
  sgRNA
gatagtttggaggttaaagt

SEQ ID NO: 11281 - DNA, 20 bp, Artificial Sequence
  sgRNA
gtcttcacagcggctggtga

SEQ ID NO: 11282 - DNA, 20 bp, Artificial Sequence
  sgRNA
aaagtgcccgtcaagttcgg

SEQ ID NO: 11283 - DNA, 20 bp, Artificial Sequence
  sgRNA
actggtctgggcgctgtccg

SEQ ID NO: 11284 - DNA, 20 bp, Artificial Sequence
  sgRNA
aggtttagatttctttccta

SEQ ID NO: 11285 - DNA, 20 bp, Artificial Sequence
  sgRNA
gcagcggaggatttattacc

SEQ ID NO: 11286 - DNA, 20 bp, Artificial Sequence
  sgRNA
gtgagacccacggccatccc

SEQ ID NO: 11287 - DNA, 20 bp, Artificial Sequence
  sgRNA
tgcgttgatggtgttgcacc

SEQ ID NO: 11288 - DNA, 20 bp, Artificial Sequence
  sgRNA
ctgctgacgcgtcgctgctt

SEQ ID NO: 11289 - DNA, 20 bp, Artificial Sequence
  sgRNA
aatcaggctcctgaatataa

SEQ ID NO: 11290 - DNA, 20 bp, Artificial Sequence
  sgRNA
acagctatagggcacagtag

SEQ ID NO: 11291 - DNA, 20 bp, Artificial Sequence
  sgRNA
gctctaatttcgttctacct

SEQ ID NO: 11292 - DNA, 20 bp, Artificial Sequence
  sgRNA
gcggaaccaaagaagtggga

SEQ ID NO: 11293 - DNA, 20 bp, Artificial Sequence
  sgRNA
agagagcacggctaccgccc

SEQ ID NO: 11294 - DNA, 20 bp, Artificial Sequence
  sgRNA
tagaggtgattgagtcataa

SEQ ID NO: 11295 - DNA, 20 bp, Artificial Sequence
  sgRNA
cacatcgctcttgcacacac

SEQ ID NO: 11296 - DNA, 20 bp, Artificial Sequence
  sgRNA
tgcctcgggcaccttagctc

SEQ ID NO: 11297 - DNA, 20 bp, Artificial Sequence
  sgRNA
tccatttagctgaatcacct

SEQ ID NO: 11298 - DNA, 20 bp, Artificial Sequence
  sgRNA
ggtggcggcagttgaggccg

SEQ ID NO: 11299 - DNA, 20 bp, Artificial Sequence
  sgRNA
cttctgctaatacagaacag

SEQ ID NO: 11300 - DNA, 20 bp, Artificial Sequence
  sgRNA
gcacacgtgcagagaacata

SEQ ID NO: 11301 - DNA, 20 bp, Artificial Sequence
  sgRNA
ttaaaccctttctcaacatg

SEQ ID NO: 11302 - DNA, 20 bp, Artificial Sequence
  sgRNA
gagccaatcaggcgctatct

SEQ ID NO: 11303 - DNA, 20 bp, Artificial Sequence
  sgRNA
ggaggacccaagctattgtg

SEQ ID NO: 11304 - DNA, 20 bp, Artificial Sequence
  sgRNA
tgtcagtagtaacctccaag

SEQ ID NO: 11305 - DNA, 20 bp, Artificial Sequence
  sgRNA
gtcgcgcgctacaaattcat

SEQ ID NO: 11306 - DNA, 20 bp, Artificial Sequence
  sgRNA
tatttgtctccgatgggcca

SEQ ID NO: 11307 - DNA, 20 bp, Artificial Sequence
  sgRNA
accagctgtccagcgcaccg

SEQ ID NO: 11308 - DNA, 20 bp, Artificial Sequence
  sgRNA
ccgcctctcagagtaacgat

SEQ ID NO: 11309 - DNA, 20 bp, Artificial Sequence
  sgRNA
ccagggctgatctagtttga

SEQ ID NO: 11310 - DNA, 20 bp, Artificial Sequence
  sgRNA
gccaccggcaaagctagaaa

SEQ ID NO: 11311 - DNA, 20 bp, Artificial Sequence
  sgRNA
cccaccctagcctcggcggg

SEQ ID NO: 11312 - DNA, 20 bp, Artificial Sequence
  sgRNA
ttcggctggcaccgagtgac

SEQ ID NO: 11313 - DNA, 20 bp, Artificial Sequence
  sgRNA
gactgagactctgtcccagt

SEQ ID NO: 11314 - DNA, 20 bp, Artificial Sequence
  sgRNA
cgccaaggaaggtacgcgtg

SEQ ID NO: 11315 - DNA, 20 bp, Artificial Sequence
  sgRNA
aaagacagggcagagctcat

SEQ ID NO: 11316 - DNA, 20 bp, Artificial Sequence
  sgRNA
ctgcggccctgctgctgctc

SEQ ID NO: 11317 - DNA, 20 bp, Artificial Sequence
  sgRNA
acgcctccacccgggtcgcg

SEQ ID NO: 11318 - DNA, 20 bp, Artificial Sequence
  sgRNA
tggcgggcgggagtagacgc

SEQ ID NO: 11319 - DNA, 20 bp, Artificial Sequence
  sgRNA
tccacacttgtaagcgcaac

SEQ ID NO: 11320 - DNA, 20 bp, Artificial Sequence
  sgRNA
gccttgcagtccgtgttctc

SEQ ID NO: 11321 - DNA, 20 bp, Artificial Sequence
  sgRNA
atccatgatcatggctgatc

SEQ ID NO: 11322 - DNA, 20 bp, Artificial Sequence
  sgRNA
gtggatcgggacacctcctt

SEQ ID NO: 11323 - DNA, 20 bp, Artificial Sequence
  sgRNA
caggtgtcaccacgccggga

SEQ ID NO: 11324 - DNA, 20 bp, Artificial Sequence
  sgRNA
cacctgtctcttctctagac

SEQ ID NO: 11325 - DNA, 20 bp, Artificial Sequence
  sgRNA
gaagtctgtgattcagattt

SEQ ID NO: 11326 - DNA, 20 bp, Artificial Sequence
  sgRNA
aaggaacttgatctactggc

SEQ ID NO: 11327 - DNA, 20 bp, Artificial Sequence
  sgRNA
cggtttgctctcgcagcatc

SEQ ID NO: 11328 - DNA, 20 bp, Artificial Sequence
  sgRNA
cgggaaggcgggcgaggacg

SEQ ID NO: 11329 - DNA, 20 bp, Artificial Sequence
  sgRNA
ttataatgtccatctgaggg

SEQ ID NO: 11330 - DNA, 20 bp, Artificial Sequence
  sgRNA
cggcgttctcgagcctcgcg

SEQ ID NO: 11331 - DNA, 20 bp, Artificial Sequence
  sgRNA
tagagaggaagaacgttccc

SEQ ID NO: 11332 - DNA, 20 bp, Artificial Sequence
  sgRNA
ctcactgatataaacattac

SEQ ID NO: 11333 - DNA, 20 bp, Artificial Sequence
  sgRNA
atgcgcttagggactgtgat

SEQ ID NO: 11334 - DNA, 20 bp, Artificial Sequence
  sgRNA
ccagtggatagattaggcgg

SEQ ID NO: 11335 - DNA, 20 bp, Artificial Sequence
  sgRNA
cttctcattctgaactgctt

SEQ ID NO: 11336 - DNA, 20 bp, Artificial Sequence
  sgRNA
gtcgaaggcagttacgtcat

SEQ ID NO: 11337 - DNA, 20 bp, Artificial Sequence
  sgRNA
gagcttgcccaaaggcctcc

SEQ ID NO: 11338 - DNA, 20 bp, Artificial Sequence
  sgRNA
ggaaagggagatgcgctgct

SEQ ID NO: 11339 - DNA, 20 bp, Artificial Sequence
  sgRNA
atcaggccggcggccgcggc

SEQ ID NO: 11340 - DNA, 20 bp, Artificial Sequence
  sgRNA
ttcttcttcgggccagtccc

SEQ ID NO: 11341 - DNA, 20 bp, Artificial Sequence
  sgRNA
gctgcgtagatgttccagag

SEQ ID NO: 11342 - DNA, 20 bp, Artificial Sequence
  sgRNA
ggtcgtgggttgtccgatgc

SEQ ID NO: 11343 - DNA, 20 bp, Artificial Sequence
  sgRNA
gcacagtgctcccgagggcg

SEQ ID NO: 11344 - DNA, 20 bp, Artificial Sequence
  sgRNA
cctttgtgcagccggaacta

SEQ ID NO: 11345 - DNA, 20 bp, Artificial Sequence
  sgRNA
gacacgctttcaagctgctg

SEQ ID NO: 11346 - DNA, 20 bp, Artificial Sequence
  sgRNA
tttggaggtgaatttagagc

SEQ ID NO: 11347 - DNA, 20 bp, Artificial Sequence
  sgRNA
tcgccctcctcgacctctcc

SEQ ID NO: 11348 - DNA, 20 bp, Artificial Sequence
  sgRNA
ggctgtcggcgaagcgacgg

SEQ ID NO: 11349 - DNA, 20 bp, Artificial Sequence
  sgRNA
ctagcctgtagcttatgccc

SEQ ID NO: 11350 - DNA, 20 bp, Artificial Sequence
  sgRNA
atcaacgacacccgggagcg

SEQ ID NO: 11351 - DNA, 20 bp, Artificial Sequence
  sgRNA
tatcactatttgcttctcga

SEQ ID NO: 11352 - DNA, 20 bp, Artificial Sequence
  sgRNA
tcactagtgggagctggaga

SEQ ID NO: 11353 - DNA, 20 bp, Artificial Sequence
  sgRNA
agggatagataattatctag

SEQ ID NO: 11354 - DNA, 20 bp, Artificial Sequence
  sgRNA
ctgaggtccctactctggtg

SEQ ID NO: 11355 - DNA, 20 bp, Artificial Sequence
  sgRNA
agtgcgcgccagaaagggac

SEQ ID NO: 11356 - DNA, 20 bp, Artificial Sequence
  sgRNA
ggtctttcatgaggtctagt

SEQ ID NO: 11357 - DNA, 20 bp, Artificial Sequence
  sgRNA
gttctttgtggtccgggcag

SEQ ID NO: 11358 - DNA, 20 bp, Artificial Sequence
  sgRNA
gaagggtcttaaccgaaagg

SEQ ID NO: 11359 - DNA, 20 bp, Artificial Sequence
  sgRNA
cgccagagccttcgcgccag

SEQ ID NO: 11360 - DNA, 20 bp, Artificial Sequence
  sgRNA
accaaataagaattcatgag

SEQ ID NO: 11361 - DNA, 20 bp, Artificial Sequence
  sgRNA
acaaagccctgggagggccc

SEQ ID NO: 11362 - DNA, 20 bp, Artificial Sequence
  sgRNA
cggcagcaactaaacttggg

SEQ ID NO: 11363 - DNA, 20 bp, Artificial Sequence
  sgRNA
agcatccgctctgtcatccc

SEQ ID NO: 11364 - DNA, 20 bp, Artificial Sequence
  sgRNA
ccacagccactccagtaatg

SEQ ID NO: 11365 - DNA, 20 bp, Artificial Sequence
  sgRNA
aggatgcaagatataaggct

SEQ ID NO: 11366 - DNA, 20 bp, Artificial Sequence
  sgRNA
agaaggacagattggtggat

SEQ ID NO: 11367 - DNA, 20 bp, Artificial Sequence
  sgRNA
gtgaagtttaccatatttca

SEQ ID NO: 11368 - DNA, 20 bp, Artificial Sequence
  sgRNA
cctgggagggacagactccc

SEQ ID NO: 11369 - DNA, 20 bp, Artificial Sequence
  sgRNA
ggagacagagaggagctggg

SEQ ID NO: 11370 - DNA, 20 bp, Artificial Sequence
  sgRNA
ttacctccagctagagatgc

SEQ ID NO: 11371 - DNA, 20 bp, Artificial Sequence
  sgRNA
caatgtttcctggtatggtt

SEQ ID NO: 11372 - DNA, 20 bp, Artificial Sequence
  sgRNA
gggtggtgcgcaaccgaaag

SEQ ID NO: 11373 - DNA, 20 bp, Artificial Sequence
  sgRNA
ggcgggaacacatcctgagg

SEQ ID NO: 11374 - DNA, 20 bp, Artificial Sequence
  sgRNA
agtgcaggccgctccaggat

SEQ ID NO: 11375 - DNA, 20 bp, Artificial Sequence
  sgRNA
cgcaccctttacacaaaccg

SEQ ID NO: 11376 - DNA, 20 bp, Artificial Sequence
  sgRNA
catcgggaccatctgcctag

SEQ ID NO: 11377 - DNA, 20 bp, Artificial Sequence
  sgRNA
agtccgggccggagcatttc

SEQ ID NO: 11378 - DNA, 20 bp, Artificial Sequence
  sgRNA
gcaaagctaaagccgtgcag

SEQ ID NO: 11379 - DNA, 20 bp, Artificial Sequence
  sgRNA
gcttctgcttgaatacttct

SEQ ID NO: 11380 - DNA, 20 bp, Artificial Sequence
  sgRNA
aaggactagtctccaccttt

SEQ ID NO: 11381 - DNA, 20 bp, Artificial Sequence
  sgRNA
gagtgtgaataggatctatg

SEQ ID NO: 11382 - DNA, 20 bp, Artificial Sequence
  sgRNA
ggaagtgacgccatattgcg

SEQ ID NO: 11383 - DNA, 20 bp, Artificial Sequence
  sgRNA
aaaggttctgcgaaagaggc

SEQ ID NO: 11384 - DNA, 20 bp, Artificial Sequence
  sgRNA
aaggtaggcttgatgacctg

SEQ ID NO: 11385 - DNA, 20 bp, Artificial Sequence
  sgRNA
ggtttgtcaagcttgtcatg

SEQ ID NO: 11386 - DNA, 20 bp, Artificial Sequence
  sgRNA
ccctggcctagggtggtgag

SEQ ID NO: 11387 - DNA, 20 bp, Artificial Sequence
  sgRNA
tgaggaaacaaactcgttca

SEQ ID NO: 11388 - DNA, 20 bp, Artificial Sequence
  sgRNA
tttaataggcccaggctcca

SEQ ID NO: 11389 - DNA, 20 bp, Artificial Sequence
  sgRNA
gcaagcaagcagtgattggc

SEQ ID NO: 11390 - DNA, 20 bp, Artificial Sequence
  sgRNA
ggaagtctcggcttcaagtc

SEQ ID NO: 11391 - DNA, 20 bp, Artificial Sequence
  sgRNA
tttggtaccagacagaatag

SEQ ID NO: 11392 - DNA, 20 bp, Artificial Sequence
  sgRNA
ggttaagccttccctcggcg

SEQ ID NO: 11393 - DNA, 20 bp, Artificial Sequence
  sgRNA
gtttctgctgcagggttctc

SEQ ID NO: 11394 - DNA, 20 bp, Artificial Sequence
  sgRNA
ataggtaaataaggcttgct

SEQ ID NO: 11395 - DNA, 20 bp, Artificial Sequence
  sgRNA
gatctgctaagctcgcgaca

SEQ ID NO: 11396 - DNA, 20 bp, Artificial Sequence
  sgRNA
cctgagtgctcgagctaagg

SEQ ID NO: 11397 - DNA, 20 bp, Artificial Sequence
  sgRNA
gcgggcacagaggttccgtg

SEQ ID NO: 11398 - DNA, 20 bp, Artificial Sequence
  sgRNA
tcatcctgaaagtcagggtt

SEQ ID NO: 11399 - DNA, 20 bp, Artificial Sequence
  sgRNA
tgaactcctcttataattct

SEQ ID NO: 11400 - DNA, 20 bp, Artificial Sequence
  sgRNA
ggagatgcttccgttctcgc

SEQ ID NO: 11401 - DNA, 20 bp, Artificial Sequence
  sgRNA
taatcagatctttgacgaag

SEQ ID NO: 11402 - DNA, 20 bp, Artificial Sequence
  sgRNA
gcgttcctcactgacgcttc

SEQ ID NO: 11403 - DNA, 20 bp, Artificial Sequence
  sgRNA
ggcgcgatgtcccggcgcgg

SEQ ID NO: 11404 - DNA, 20 bp, Artificial Sequence
  sgRNA
cgactcgctcattcgccgcc

SEQ ID NO: 11405 - DNA, 20 bp, Artificial Sequence
  sgRNA
tgaggtgtggctctaggcct

SEQ ID NO: 11406 - DNA, 20 bp, Artificial Sequence
  sgRNA
taatcggatcagagataatg

SEQ ID NO: 11407 - DNA, 20 bp, Artificial Sequence
  sgRNA
gtggtacccagagccggcca

SEQ ID NO: 11408 - DNA, 20 bp, Artificial Sequence
  sgRNA
gagccacctgatcatgactc

SEQ ID NO: 11409 - DNA, 20 bp, Artificial Sequence
  sgRNA
gaggatgactccgtacgggt

SEQ ID NO: 11410 - DNA, 20 bp, Artificial Sequence
  sgRNA
ttctgtttcctgagggtggg

SEQ ID NO: 11411 - DNA, 20 bp, Artificial Sequence
  sgRNA
acagccagcatcctctcggg

SEQ ID NO: 11412 - DNA, 20 bp, Artificial Sequence
  sgRNA
ccgcggcgctcggacgggcc

SEQ ID NO: 11413 - DNA, 20 bp, Artificial Sequence
  sgRNA
ggaccggcacatcgacatcc

SEQ ID NO: 11414 - DNA, 20 bp, Artificial Sequence
  sgRNA
ggccagtccgtctctataaa

SEQ ID NO: 11415 - DNA, 20 bp, Artificial Sequence
  sgRNA
tcctgaatcgccctcgcaat

SEQ ID NO: 11416 - DNA, 20 bp, Artificial Sequence
  sgRNA
ccacacgcagggccaaggag

SEQ ID NO: 11417 - DNA, 20 bp, Artificial Sequence
  sgRNA
cgaggctcggccctgccgtc

SEQ ID NO: 11418 - DNA, 20 bp, Artificial Sequence
  sgRNA
tggagacaaatgataacagc

SEQ ID NO: 11419 - DNA, 20 bp, Artificial Sequence
  sgRNA
tccacctcggtggcgacaac

SEQ ID NO: 11420 - DNA, 20 bp, Artificial Sequence
  sgRNA
ctctgctggcctcctaatcc

SEQ ID NO: 11421 - DNA, 20 bp, Artificial Sequence
  sgRNA
tctccggagcctgggcggtg

SEQ ID NO: 11422 - DNA, 20 bp, Artificial Sequence
  sgRNA
gctcctctggcaagggcagt

SEQ ID NO: 11423 - DNA, 20 bp, Artificial Sequence
  sgRNA
tctacactgacttaaatcca

SEQ ID NO: 11424 - DNA, 20 bp, Artificial Sequence
  sgRNA
tcaagtactgtacttgctat

SEQ ID NO: 11425 - DNA, 20 bp, Artificial Sequence
  sgRNA
agctaaccatggaggagact

SEQ ID NO: 11426 - DNA, 20 bp, Artificial Sequence
  sgRNA
catcgggaaggcttgagtct

SEQ ID NO: 11427 - DNA, 20 bp, Artificial Sequence
  sgRNA
cagcctggaaagcaagtagt

SEQ ID NO: 11428 - DNA, 20 bp, Artificial Sequence
  sgRNA
ctaggccaccttcagagccc

SEQ ID NO: 11429 - DNA, 20 bp, Artificial Sequence
  sgRNA
aaatgtttgagcagagcctg

SEQ ID NO: 11430 - DNA, 20 bp, Artificial Sequence
  sgRNA
ccaaatcctgctgctgagtc

SEQ ID NO: 11431 - DNA, 20 bp, Artificial Sequence
  sgRNA
gccggaaggcatcaagtcgc

SEQ ID NO: 11432 - DNA, 20 bp, Artificial Sequence
  sgRNA
tgggagggcgggtcaaacct

SEQ ID NO: 11433 - DNA, 20 bp, Artificial Sequence
  sgRNA
caatttgtgctcggagactg

SEQ ID NO: 11434 - DNA, 20 bp, Artificial Sequence
  sgRNA
atgaagacagacgcggttcc

SEQ ID NO: 11435 - DNA, 20 bp, Artificial Sequence
  sgRNA
cacctgaatttctttgggaa

SEQ ID NO: 11436 - DNA, 20 bp, Artificial Sequence
  sgRNA
tttctggtatgagccattct

SEQ ID NO: 11437 - DNA, 20 bp, Artificial Sequence
  sgRNA
ggagtcgccgagtggtgggc

SEQ ID NO: 11438 - DNA, 20 bp, Artificial Sequence
  sgRNA
tggcctgccgctctcccaat

SEQ ID NO: 11439 - DNA, 20 bp, Artificial Sequence
  sgRNA
ggaaacgtgagattagatga

SEQ ID NO: 11440 - DNA, 20 bp, Artificial Sequence
  sgRNA
cacccggtttccggaccttg

SEQ ID NO: 11441 - DNA, 20 bp, Artificial Sequence
  sgRNA
gggcggccgggcgcagcctg

SEQ ID NO: 11442 - DNA, 20 bp, Artificial Sequence
  sgRNA
ctcgtctgcagtccctgacc

SEQ ID NO: 11443 - DNA, 20 bp, Artificial Sequence
  sgRNA
caaattcctgcgcctccagg

SEQ ID NO: 11444 - DNA, 20 bp, Artificial Sequence
  sgRNA
tcattgtgatggcagttcca

SEQ ID NO: 11445 - DNA, 20 bp, Artificial Sequence
  sgRNA
ggaagggcagatatatgaac

SEQ ID NO: 11446 - DNA, 20 bp, Artificial Sequence
  sgRNA
cctgtggaactacatgtccc

SEQ ID NO: 11447 - DNA, 20 bp, Artificial Sequence
  sgRNA
ctagtccctacctgtagctc

SEQ ID NO: 11448 - DNA, 20 bp, Artificial Sequence
  sgRNA
aacagttacgtcagatgtgg

SEQ ID NO: 11449 - DNA, 20 bp, Artificial Sequence
  sgRNA
acagtagtgtcagatagaag

SEQ ID NO: 11450 - DNA, 20 bp, Artificial Sequence
  sgRNA
gaggtgcggcttgatgacaa

SEQ ID NO: 11451 - DNA, 20 bp, Artificial Sequence
  sgRNA
ggaaacacgagaggaccgcg

SEQ ID NO: 11452 - DNA, 20 bp, Artificial Sequence
  sgRNA
aaggtgtgtgctgccatgcc

SEQ ID NO: 11453 - DNA, 20 bp, Artificial Sequence
  sgRNA
ggttgattacttcagaaatt

SEQ ID NO: 11454 - DNA, 20 bp, Artificial Sequence
  sgRNA
tcccggccgcttcaaaccgc

SEQ ID NO: 11455 - DNA, 20 bp, Artificial Sequence
  sgRNA
agaggctcggcggcgacggg

SEQ ID NO: 11456 - DNA, 20 bp, Artificial Sequence
  sgRNA
ggtgtccctgagctcacacg

SEQ ID NO: 11457 - DNA, 20 bp, Artificial Sequence
  sgRNA
tttatttacaccacggagag

SEQ ID NO: 11458 - DNA, 20 bp, Artificial Sequence
  sgRNA
accaagtctgctaaatcgcc

SEQ ID NO: 11459 - DNA, 20 bp, Artificial Sequence
  sgRNA
cttcgagtctgaacccgccc

SEQ ID NO: 11460 - DNA, 20 bp, Artificial Sequence
  sgRNA
agtcccggaagtggctgtca

SEQ ID NO: 11461 - DNA, 20 bp, Artificial Sequence
  sgRNA
gctgcgggaagccgtgacgc

SEQ ID NO: 11462 - DNA, 20 bp, Artificial Sequence
  sgRNA
gacccacagacagagtagaa

SEQ ID NO: 11463 - DNA, 20 bp, Artificial Sequence
  sgRNA
gctgaaaccttattcgctta

SEQ ID NO: 11464 - DNA, 20 bp, Artificial Sequence
  sgRNA
gactggcgacggaggacgtg

SEQ ID NO: 11465 - DNA, 20 bp, Artificial Sequence
  sgRNA
cgtgtgattggcagccacag

SEQ ID NO: 11466 - DNA, 20 bp, Artificial Sequence
  sgRNA
ggtctaatcagcgactggtt

SEQ ID NO: 11467 - DNA, 20 bp, Artificial Sequence
  sgRNA
cccgcgtcgcctgccgtggg

SEQ ID NO: 11468 - DNA, 20 bp, Artificial Sequence
  sgRNA
ggtaaataactctagttagc

SEQ ID NO: 11469 - DNA, 20 bp, Artificial Sequence
  sgRNA
attggcccggtgtggtgggt

SEQ ID NO: 11470 - DNA, 20 bp, Artificial Sequence
  sgRNA
ggtctgaggcctgaaggcgg

SEQ ID NO: 11471 - DNA, 20 bp, Artificial Sequence
  sgRNA
cctgtcaattagcggaagca

SEQ ID NO: 11472 - DNA, 20 bp, Artificial Sequence
  sgRNA
ggccctctcagatcacatgc

SEQ ID NO: 11473 - DNA, 20 bp, Artificial Sequence
  sgRNA
atgtagttctcggcgtgaag

SEQ ID NO: 11474 - DNA, 20 bp, Artificial Sequence
  sgRNA
ttccaccggaagtgctccct

SEQ ID NO: 11475 - DNA, 20 bp, Artificial Sequence
  sgRNA
caccctggtctcacctccac

SEQ ID NO: 11476 - DNA, 20 bp, Artificial Sequence
  sgRNA
gtcattcagcatgggtttcc

SEQ ID NO: 11477 - DNA, 20 bp, Artificial Sequence
  sgRNA
aaagaagcaccgcccgctac

SEQ ID NO: 11478 - DNA, 20 bp, Artificial Sequence
  sgRNA
gaatggctgggccctgtagt

SEQ ID NO: 11479 - DNA, 20 bp, Artificial Sequence
  sgRNA
acgaagccaatacgagtggg

SEQ ID NO: 11480 - DNA, 20 bp, Artificial Sequence
  sgRNA
gaaagatgctcccagctgtt

SEQ ID NO: 11481 - DNA, 20 bp, Artificial Sequence
  sgRNA
aacgttaccctccaaagcga

SEQ ID NO: 11482 - DNA, 20 bp, Artificial Sequence
  sgRNA
aggcgtttgttgggacacgc

SEQ ID NO: 11483 - DNA, 20 bp, Artificial Sequence
  sgRNA
ccacacctgcagcattaccc

SEQ ID NO: 11484 - DNA, 20 bp, Artificial Sequence
  sgRNA
tctgaaaggaatcccaagag

SEQ ID NO: 11485 - DNA, 20 bp, Artificial Sequence
  sgRNA
gccagggaggctcagccatt

SEQ ID NO: 11486 - DNA, 20 bp, Artificial Sequence
  sgRNA
ctgaggactgcgtggaggag

SEQ ID NO: 11487 - DNA, 20 bp, Artificial Sequence
  sgRNA
tatgtggagatattggttca

SEQ ID NO: 11488 - DNA, 20 bp, Artificial Sequence
  sgRNA
tggctgatactggccactag

SEQ ID NO: 11489 - DNA, 20 bp, Artificial Sequence
  sgRNA
gcacttgttggagcagactg

SEQ ID NO: 11490 - DNA, 20 bp, Artificial Sequence
  sgRNA
tttgttcctcacttaccagc

SEQ ID NO: 11491 - DNA, 20 bp, Artificial Sequence
  sgRNA
gcgggactggttcttgaagt

SEQ ID NO: 11492 - DNA, 20 bp, Artificial Sequence
  sgRNA
ggtcgtacacctcggtgccc

SEQ ID NO: 11493 - DNA, 20 bp, Artificial Sequence
  sgRNA
gagcgaattccctcggagag

SEQ ID NO: 11494 - DNA, 20 bp, Artificial Sequence
  sgRNA
aacatggccgccgaggaggg

SEQ ID NO: 11495 - DNA, 20 bp, Artificial Sequence
  sgRNA
tccttggctgggtccagtga

SEQ ID NO: 11496 - DNA, 20 bp, Artificial Sequence
  sgRNA
cccgtctcgaggccggaggg

SEQ ID NO: 11497 - DNA, 20 bp, Artificial Sequence
  sgRNA
tccgcagactgactcctcac

SEQ ID NO: 11498 - DNA, 20 bp, Artificial Sequence
  sgRNA
cagagacttggaatcttact

SEQ ID NO: 11499 - DNA, 20 bp, Artificial Sequence
  sgRNA
tggtgtacagcgacaccatg

SEQ ID NO: 11500 - DNA, 20 bp, Artificial Sequence
  sgRNA
gttgcctccactgctgtagc

SEQ ID NO: 11501 - DNA, 20 bp, Artificial Sequence
  sgRNA
ccctaattgggcggcccgga

SEQ ID NO: 11502 - DNA, 20 bp, Artificial Sequence
  sgRNA
ttgcgtccggctctcagcca

SEQ ID NO: 11503 - DNA, 20 bp, Artificial Sequence
  sgRNA
gggcaggaacctgggacacg

SEQ ID NO: 11504 - DNA, 20 bp, Artificial Sequence
  sgRNA
gctgggcaaagaccagccaa

SEQ ID NO: 11505 - DNA, 20 bp, Artificial Sequence
  sgRNA
agaagctgtattcagctccc

SEQ ID NO: 11506 - DNA, 20 bp, Artificial Sequence
  sgRNA
ctcccacggctcggccggag

SEQ ID NO: 11507 - DNA, 20 bp, Artificial Sequence
  sgRNA
gttgttctctgaaatggacc

SEQ ID NO: 11508 - DNA, 20 bp, Artificial Sequence
  sgRNA
ccgcctcgaccgcgggaggg

SEQ ID NO: 11509 - DNA, 20 bp, Artificial Sequence
  sgRNA
gggagtcaggagaactctcc

SEQ ID NO: 11510 - DNA, 20 bp, Artificial Sequence
  sgRNA
gagataggtgcggttgtctc

SEQ ID NO: 11511 - DNA, 20 bp, Artificial Sequence
  sgRNA
cctctgccctcacttgattc

SEQ ID NO: 11512 - DNA, 20 bp, Artificial Sequence
  sgRNA
gacttcaatactcgttgttt

SEQ ID NO: 11513 - DNA, 20 bp, Artificial Sequence
  sgRNA
gcctctccactggcgaagag

SEQ ID NO: 11514 - DNA, 20 bp, Artificial Sequence
  sgRNA
cccagtgaagggcccatggg

SEQ ID NO: 11515 - DNA, 20 bp, Artificial Sequence
  sgRNA
ataatgggcattcagacata

SEQ ID NO: 11516 - DNA, 20 bp, Artificial Sequence
  sgRNA
atttgagaacagaccctaag

SEQ ID NO: 11517 - DNA, 20 bp, Artificial Sequence
  sgRNA
gctcatgggaggagggtctc

SEQ ID NO: 11518 - DNA, 20 bp, Artificial Sequence
  sgRNA
ggcaggctgtaggcgtcgat

SEQ ID NO: 11519 - DNA, 20 bp, Artificial Sequence
  sgRNA
ggcaggcgtgtgcataggcg

SEQ ID NO: 11520 - DNA, 20 bp, Artificial Sequence
  sgRNA
cggaaggatatacccgcttg

SEQ ID NO: 11521 - DNA, 20 bp, Artificial Sequence
  sgRNA
gggactgaataacacagaag

SEQ ID NO: 11522 - DNA, 20 bp, Artificial Sequence
  sgRNA
ggaagtgttgttgaccgtag

SEQ ID NO: 11523 - DNA, 20 bp, Artificial Sequence
  sgRNA
gccattgtgcggtgcattgt

SEQ ID NO: 11524 - DNA, 20 bp, Artificial Sequence
  sgRNA
agataggtcaaactccacat

SEQ ID NO: 11525 - DNA, 20 bp, Artificial Sequence
  sgRNA
gagagagagagagagaagag

SEQ ID NO: 11526 - DNA, 20 bp, Artificial Sequence
  sgRNA
aatcttaaccgcgttgccat

SEQ ID NO: 11527 - DNA, 20 bp, Artificial Sequence
  sgRNA
gtccgacggactgtacttta

SEQ ID NO: 11528 - DNA, 20 bp, Artificial Sequence
  sgRNA
gatggcaccgggacagggct

SEQ ID NO: 11529 - DNA, 20 bp, Artificial Sequence
  sgRNA
atatactggaatcatatgca

SEQ ID NO: 11530 - DNA, 20 bp, Artificial Sequence
  sgRNA
gcgttgtataaagtccctaa

SEQ ID NO: 11531 - DNA, 20 bp, Artificial Sequence
  sgRNA
gaaccaatgaaccttcttcc

SEQ ID NO: 11532 - DNA, 20 bp, Artificial Sequence
  sgRNA
ccgattcgcttcgaaacttg

SEQ ID NO: 11533 - DNA, 20 bp, Artificial Sequence
  sgRNA
gtgcctctaggcggaagtgc

SEQ ID NO: 11534 - DNA, 20 bp, Artificial Sequence
  sgRNA
gttgagcaattataggagct

SEQ ID NO: 11535 - DNA, 20 bp, Artificial Sequence
  sgRNA
cagcattggatgagctagcc

SEQ ID NO: 11536 - DNA, 20 bp, Artificial Sequence
  sgRNA
agaactgacaactcatctac

SEQ ID NO: 11537 - DNA, 20 bp, Artificial Sequence
  sgRNA
actgagatactgaatgagac

SEQ ID NO: 11538 - DNA, 20 bp, Artificial Sequence
  sgRNA
gtcttggagagaccaactcc

SEQ ID NO: 11539 - DNA, 20 bp, Artificial Sequence
  sgRNA
cgaccctttgtgatgtcacc

SEQ ID NO: 11540 - DNA, 20 bp, Artificial Sequence
  sgRNA
gcggccggtcgcagagcgcg

SEQ ID NO: 11541 - DNA, 20 bp, Artificial Sequence
  sgRNA
cgtggccaccggaattactt

SEQ ID NO: 11542 - DNA, 20 bp, Artificial Sequence
  sgRNA
aaaggtattacgtagtgttc

SEQ ID NO: 11543 - DNA, 20 bp, Artificial Sequence
  sgRNA
acatgcgcacggcgacccgc

SEQ ID NO: 11544 - DNA, 20 bp, Artificial Sequence
  sgRNA
atagggttccacaatggccg

SEQ ID NO: 11545 - DNA, 20 bp, Artificial Sequence
  sgRNA
cggaacacaacccgcttctc

SEQ ID NO: 11546 - DNA, 20 bp, Artificial Sequence
  sgRNA
gcacgccgctgctgctcagc

SEQ ID NO: 11547 - DNA, 20 bp, Artificial Sequence
  sgRNA
cgcgacgccgcaagacctga

SEQ ID NO: 11548 - DNA, 20 bp, Artificial Sequence
  sgRNA
aggactgctgatcctcctca

SEQ ID NO: 11549 - DNA, 20 bp, Artificial Sequence
  sgRNA
ggtcctcccttagactcgag

SEQ ID NO: 11550 - DNA, 20 bp, Artificial Sequence
  sgRNA
aggtctcacacttgtgtcat

SEQ ID NO: 11551 - DNA, 20 bp, Artificial Sequence
  sgRNA
gggcagccgacgtgtcaggg

SEQ ID NO: 11552 - DNA, 20 bp, Artificial Sequence
  sgRNA
cgcttcccgaaacgctttag

SEQ ID NO: 11553 - DNA, 20 bp, Artificial Sequence
  sgRNA
acgtcaggcggaagtgcctg

SEQ ID NO: 11554 - DNA, 20 bp, Artificial Sequence
  sgRNA
tgctgcatagagttaaagcc

SEQ ID NO: 11555 - DNA, 20 bp, Artificial Sequence
  sgRNA
gggcttgtaaccgaatccac

SEQ ID NO: 11556 - DNA, 20 bp, Artificial Sequence
  sgRNA
ttactgtgagggattaccaa

SEQ ID NO: 11557 - DNA, 20 bp, Artificial Sequence
  sgRNA
ctttaacaaggcgacccgcc

SEQ ID NO: 11558 - DNA, 20 bp, Artificial Sequence
  sgRNA
gagttccggccaggacctgg

SEQ ID NO: 11559 - DNA, 20 bp, Artificial Sequence
  sgRNA
gtggatttatgatgacacaa

SEQ ID NO: 11560 - DNA, 20 bp, Artificial Sequence
  sgRNA
agccgtccagcgctcaccgc

SEQ ID NO: 11561 - DNA, 20 bp, Artificial Sequence
  sgRNA
gtagacgggtcccttgcttt

SEQ ID NO: 11562 - DNA, 20 bp, Artificial Sequence
  sgRNA
ctgctcagggaagaggcggt

SEQ ID NO: 11563 - DNA, 20 bp, Artificial Sequence
  sgRNA
gctcagggctcccgcgtacc

SEQ ID NO: 11564 - DNA, 20 bp, Artificial Sequence
  sgRNA
ggagctccgccctgagtcat

SEQ ID NO: 11565 - DNA, 20 bp, Artificial Sequence
  sgRNA
gcaccgcgaaggttctccac

SEQ ID NO: 11566 - DNA, 20 bp, Artificial Sequence
  sgRNA
ggaacagggattctcccttg

SEQ ID NO: 11567 - DNA, 20 bp, Artificial Sequence
  sgRNA
aaataggtcagagttccaat

SEQ ID NO: 11568 - DNA, 20 bp, Artificial Sequence
  sgRNA
tgtgttggtacggtagcctt

SEQ ID NO: 11569 - DNA, 20 bp, Artificial Sequence
  sgRNA
gccttgccctcagacggtag

SEQ ID NO: 11570 - DNA, 20 bp, Artificial Sequence
  sgRNA
aaggtgcaaggtgactacgt

SEQ ID NO: 11571 - DNA, 20 bp, Artificial Sequence
  sgRNA
agtgcaagtgcgaggtacct

SEQ ID NO: 11572 - DNA, 20 bp, Artificial Sequence
  sgRNA
ttatttcatgtagctagaga

SEQ ID NO: 11573 - DNA, 20 bp, Artificial Sequence
  sgRNA
gctcccggctgctggttgat

SEQ ID NO: 11574 - DNA, 20 bp, Artificial Sequence
  sgRNA
atctggttcctccgcagaac

SEQ ID NO: 11575 - DNA, 20 bp, Artificial Sequence
  sgRNA
tgttcccggccttgaggatc

SEQ ID NO: 11576 - DNA, 20 bp, Artificial Sequence
  sgRNA
gtgggtacccggaccattga

SEQ ID NO: 11577 - DNA, 20 bp, Artificial Sequence
  sgRNA
acaatttaaaggcagtctag

SEQ ID NO: 11578 - DNA, 20 bp, Artificial Sequence
  sgRNA
tagggattgatagggttgtg

SEQ ID NO: 11579 - DNA, 20 bp, Artificial Sequence
  sgRNA
aaatgaggacaaagcccgcc

SEQ ID NO: 11580 - DNA, 20 bp, Artificial Sequence
  sgRNA
ggtctggcttgggatagctt

SEQ ID NO: 11581 - DNA, 20 bp, Artificial Sequence
  sgRNA
acatgggtgtgtctgaccag

SEQ ID NO: 11582 - DNA, 20 bp, Artificial Sequence
  sgRNA
gctgcttcgggagtgcgctt

SEQ ID NO: 11583 - DNA, 20 bp, Artificial Sequence
  sgRNA
ggctgcagaatagattctcc

SEQ ID NO: 11584 - DNA, 20 bp, Artificial Sequence
  sgRNA
gacagatgcaccaagaggtg

SEQ ID NO: 11585 - DNA, 20 bp, Artificial Sequence
  sgRNA
aagaacatctaaatgacccg

SEQ ID NO: 11586 - DNA, 20 bp, Artificial Sequence
  sgRNA
cctgacggtgccagggttgg

SEQ ID NO: 11587 - DNA, 20 bp, Artificial Sequence
  sgRNA
cggcaatcctggcttcgcag

SEQ ID NO: 11588 - DNA, 20 bp, Artificial Sequence
  sgRNA
tgcgaggtcctagacatcct

SEQ ID NO: 11589 - DNA, 20 bp, Artificial Sequence
  sgRNA
tttggaaatctttgagaact

SEQ ID NO: 11590 - DNA, 20 bp, Artificial Sequence
  sgRNA
cggagacagtaaagattaag

SEQ ID NO: 11591 - DNA, 20 bp, Artificial Sequence
  sgRNA
gaggttctgtgcagtgcggg

SEQ ID NO: 11592 - DNA, 20 bp, Artificial Sequence
  sgRNA
gcacgcgaccctaagctcgc

SEQ ID NO: 11593 - DNA, 20 bp, Artificial Sequence
  sgRNA
gagagagagagagaacagtc

SEQ ID NO: 11594 - DNA, 20 bp, Artificial Sequence
  sgRNA
ctgctggagataaacgcttg

SEQ ID NO: 11595 - DNA, 20 bp, Artificial Sequence
  sgRNA
ctgtacctacatcaggtatc

SEQ ID NO: 11596 - DNA, 20 bp, Artificial Sequence
  sgRNA
gaccaatcggtgtgcgcgcg

SEQ ID NO: 11597 - DNA, 20 bp, Artificial Sequence
  sgRNA
tatccctgatcgccttgcac

SEQ ID NO: 11598 - DNA, 20 bp, Artificial Sequence
  sgRNA
atactgcagcaacctgttgc

SEQ ID NO: 11599 - DNA, 20 bp, Artificial Sequence
  sgRNA
agcatgtggcaacgtcacag

SEQ ID NO: 11600 - DNA, 20 bp, Artificial Sequence
  sgRNA
cttcttccaagtgattatat

SEQ ID NO: 11601 - DNA, 20 bp, Artificial Sequence
  sgRNA
aggcatgagatccaactgta

SEQ ID NO: 11602 - DNA, 20 bp, Artificial Sequence
  sgRNA
ctttgctctcgccgctgcca

SEQ ID NO: 11603 - DNA, 20 bp, Artificial Sequence
  sgRNA
ctggaatgagccaccagagt

SEQ ID NO: 11604 - DNA, 20 bp, Artificial Sequence
  sgRNA
gggcgacttctgcaatcaag

SEQ ID NO: 11605 - DNA, 20 bp, Artificial Sequence
  sgRNA
tgagcatcccgagccgagcc

SEQ ID NO: 11606 - DNA, 20 bp, Artificial Sequence
  sgRNA
ttccaagcggtgcaacgagc

SEQ ID NO: 11607 - DNA, 20 bp, Artificial Sequence
  sgRNA
tcataaatatgcgcccgcca

SEQ ID NO: 11608 - DNA, 20 bp, Artificial Sequence
  sgRNA
aggagttaaaggaccgggat

SEQ ID NO: 11609 - DNA, 20 bp, Artificial Sequence
  sgRNA
gtgtgggccgtgattgtccc

SEQ ID NO: 11610 - DNA, 20 bp, Artificial Sequence
  sgRNA
gagcagagtccgcaccacct

SEQ ID NO: 11611 - DNA, 20 bp, Artificial Sequence
  sgRNA
gatgaggataagaagggcat

SEQ ID NO: 11612 - DNA, 20 bp, Artificial Sequence
  sgRNA
cctgctgtgttgacctcaag

SEQ ID NO: 11613 - DNA, 20 bp, Artificial Sequence
  sgRNA
taatcagttgctcagaaaga

SEQ ID NO: 11614 - DNA, 20 bp, Artificial Sequence
  sgRNA
gcgctcggtccttgacgacg

SEQ ID NO: 11615 - DNA, 20 bp, Artificial Sequence
  sgRNA
ttaaggagattatgagaaga

SEQ ID NO: 11616 - DNA, 20 bp, Artificial Sequence
  sgRNA
ctgtctgaaacataacagca

SEQ ID NO: 11617 - DNA, 20 bp, Artificial Sequence
  sgRNA
tcgtcaatcccacgcacata

SEQ ID NO: 11618 - DNA, 20 bp, Artificial Sequence
  sgRNA
caggcacccttagccaaccc

SEQ ID NO: 11619 - DNA, 20 bp, Artificial Sequence
  sgRNA
gttggctttccctctgcagg

SEQ ID NO: 11620 - DNA, 20 bp, Artificial Sequence
  sgRNA
aggaagcaccaactctgaag

SEQ ID NO: 11621 - DNA, 20 bp, Artificial Sequence
  sgRNA
tgagctcacaatcccggccg

SEQ ID NO: 11622 - DNA, 20 bp, Artificial Sequence
  sgRNA
tggtttatggaatatctgat

SEQ ID NO: 11623 - DNA, 20 bp, Artificial Sequence
  sgRNA
aaggagctggatagatcaac

SEQ ID NO: 11624 - DNA, 20 bp, Artificial Sequence
  sgRNA
aggcagagacgaccggcgct

SEQ ID NO: 11625 - DNA, 20 bp, Artificial Sequence
  sgRNA
cagcaatcgtccctttaaat

SEQ ID NO: 11626 - DNA, 20 bp, Artificial Sequence
  sgRNA
taactgtccaattaggaacg

SEQ ID NO: 11627 - DNA, 20 bp, Artificial Sequence
  sgRNA
tggcctaagccaaagaacag

SEQ ID NO: 11628 - DNA, 20 bp, Artificial Sequence
  sgRNA
gggcggaaactctcgggccc

SEQ ID NO: 11629 - DNA, 20 bp, Artificial Sequence
  sgRNA
actattctatgcacagaact

SEQ ID NO: 11630 - DNA, 20 bp, Artificial Sequence
  sgRNA
ccaaattaacccattattgt

SEQ ID NO: 11631 - DNA, 20 bp, Artificial Sequence
  sgRNA
agtgtgtcattacacagaac

SEQ ID NO: 11632 - DNA, 20 bp, Artificial Sequence
  sgRNA
agctcatcactgagatgcga

SEQ ID NO: 11633 - DNA, 20 bp, Artificial Sequence
  sgRNA
ggattctcagaagtgggtgg

SEQ ID NO: 11634 - DNA, 20 bp, Artificial Sequence
  sgRNA
gggacgcgggtaaggttggg

SEQ ID NO: 11635 - DNA, 20 bp, Artificial Sequence
  sgRNA
catcagagatcattgggcta

SEQ ID NO: 11636 - DNA, 20 bp, Artificial Sequence
  sgRNA
ttacagcccggctctgtgat

SEQ ID NO: 11637 - DNA, 20 bp, Artificial Sequence
  sgRNA
aaataaagccttgataatcc

SEQ ID NO: 11638 - DNA, 20 bp, Artificial Sequence
  sgRNA
gaggagcaggcacgtggttc

SEQ ID NO: 11639 - DNA, 20 bp, Artificial Sequence
  sgRNA
acggaaactaggcggaacgc

SEQ ID NO: 11640 - DNA, 20 bp, Artificial Sequence
  sgRNA
tcaatattaagccttagcta

SEQ ID NO: 11641 - DNA, 20 bp, Artificial Sequence
  sgRNA
cgcagcaggtgagatgaagg

SEQ ID NO: 11642 - DNA, 20 bp, Artificial Sequence
  sgRNA
tgcgcactggcgccggcgtg

SEQ ID NO: 11643 - DNA, 20 bp, Artificial Sequence
  sgRNA
gagagaggcgcggaatcaaa

SEQ ID NO: 11644 - DNA, 20 bp, Artificial Sequence
  sgRNA
tcttgcgcgctcaagtagaa

SEQ ID NO: 11645 - DNA, 20 bp, Artificial Sequence
  sgRNA
tgcactgagttaggcaaagc

SEQ ID NO: 11646 - DNA, 20 bp, Artificial Sequence
  sgRNA
gtgaagcctagctttctgcc

SEQ ID NO: 11647 - DNA, 20 bp, Artificial Sequence
  sgRNA
aatctttaaactagagcagg

SEQ ID NO: 11648 - DNA, 20 bp, Artificial Sequence
  sgRNA
tgaatatttcagcgtatatg

SEQ ID NO: 11649 - DNA, 20 bp, Artificial Sequence
  sgRNA
gtcacttccgcccaccggag

SEQ ID NO: 11650 - DNA, 20 bp, Artificial Sequence
  sgRNA
aggaaacaatgtagccggcg

SEQ ID NO: 11651 - DNA, 20 bp, Artificial Sequence
  sgRNA
ccaatgtggttctctaacgc

SEQ ID NO: 11652 - DNA, 20 bp, Artificial Sequence
  sgRNA
ggacgaacgcattgccaacc

SEQ ID NO: 11653 - DNA, 20 bp, Artificial Sequence
  sgRNA
gtctacgtcagaagtccgcg

SEQ ID NO: 11654 - DNA, 20 bp, Artificial Sequence
  sgRNA
acgttgggtttcagcgtccc

SEQ ID NO: 11655 - DNA, 20 bp, Artificial Sequence
  sgRNA
gggtcatacccaagttagat

SEQ ID NO: 11656 - DNA, 20 bp, Artificial Sequence
  sgRNA
cccagcccggtggacgggag

SEQ ID NO: 11657 - DNA, 20 bp, Artificial Sequence
  sgRNA
ttccagcagctgcgtttgcc

SEQ ID NO: 11658 - DNA, 20 bp, Artificial Sequence
  sgRNA
tggctgactgatgtccgcgg

SEQ ID NO: 11659 - DNA, 20 bp, Artificial Sequence
  sgRNA
gcagggcgcgttgaaacttt

SEQ ID NO: 11660 - DNA, 20 bp, Artificial Sequence
  sgRNA
gggcctctggcagctgacaa

SEQ ID NO: 11661 - DNA, 20 bp, Artificial Sequence
  sgRNA
ggttgctctcgcggcgcgcc

SEQ ID NO: 11662 - DNA, 20 bp, Artificial Sequence
  sgRNA
ggagggatggaggttgaagg

SEQ ID NO: 11663 - DNA, 20 bp, Artificial Sequence
  sgRNA
atcggaatcttcaacttctt

SEQ ID NO: 11664 - DNA, 20 bp, Artificial Sequence
  sgRNA
tcaatccttcagtactccgc

SEQ ID NO: 11665 - DNA, 20 bp, Artificial Sequence
  sgRNA
caggcacagcaggcgtggag

SEQ ID NO: 11666 - DNA, 20 bp, Artificial Sequence
  sgRNA
acagctgctacggccgaggg

SEQ ID NO: 11667 - DNA, 20 bp, Artificial Sequence
  sgRNA
ggctgcggcagatgaaatat

SEQ ID NO: 11668 - DNA, 20 bp, Artificial Sequence
  sgRNA
cgaatgctaatgagctgaaa

SEQ ID NO: 11669 - DNA, 20 bp, Artificial Sequence
  sgRNA
gagagggacgagacgctgca

SEQ ID NO: 11670 - DNA, 20 bp, Artificial Sequence
  sgRNA
cctgggtcctcccgtgccga

SEQ ID NO: 11671 - DNA, 20 bp, Artificial Sequence
  sgRNA
aaaggatgtaaactttacag

SEQ ID NO: 11672 - DNA, 20 bp, Artificial Sequence
  sgRNA
gcctgcgtccggacggcagc

SEQ ID NO: 11673 - DNA, 20 bp, Artificial Sequence
  sgRNA
tcaggcagacgtttccagtc

SEQ ID NO: 11674 - DNA, 20 bp, Artificial Sequence
  sgRNA
gctgaagatgggccacgccc

SEQ ID NO: 11675 - DNA, 20 bp, Artificial Sequence
  sgRNA
tgtcaggaagtggacagggt

SEQ ID NO: 11676 - DNA, 20 bp, Artificial Sequence
  sgRNA
ctttcatttactgcagagca

SEQ ID NO: 11677 - DNA, 20 bp, Artificial Sequence
  sgRNA
actgaacgcggctggacgcc

SEQ ID NO: 11678 - DNA, 20 bp, Artificial Sequence
  sgRNA
gcggatggatagcgtctttg

SEQ ID NO: 11679 - DNA, 20 bp, Artificial Sequence
  sgRNA
cacgtcgctcagggcttaga

SEQ ID NO: 11680 - DNA, 20 bp, Artificial Sequence
  sgRNA
tacaaacttctgctcctcta

SEQ ID NO: 11681 - DNA, 20 bp, Artificial Sequence
  sgRNA
gtcgggacgtgtgcttcact

SEQ ID NO: 11682 - DNA, 20 bp, Artificial Sequence
  sgRNA
ttcgctgggaagaactaggc

SEQ ID NO: 11683 - DNA, 20 bp, Artificial Sequence
  sgRNA
aagggttcctgagacagcca

SEQ ID NO: 11684 - DNA, 20 bp, Artificial Sequence
  sgRNA
ttgcactgaacgagggccgc

SEQ ID NO: 11685 - DNA, 20 bp, Artificial Sequence
  sgRNA
taaagaccacgccgcggccg

SEQ ID NO: 11686 - DNA, 20 bp, Artificial Sequence
  sgRNA
ttcgcggatccacagtaggg

SEQ ID NO: 11687 - DNA, 20 bp, Artificial Sequence
  sgRNA
gacatgaaccagctttgttt

SEQ ID NO: 11688 - DNA, 20 bp, Artificial Sequence
  sgRNA
ccaacctggtgccacaatat

SEQ ID NO: 11689 - DNA, 20 bp, Artificial Sequence
  sgRNA
cagggaaagactccacgcaa

SEQ ID NO: 11690 - DNA, 20 bp, Artificial Sequence
  sgRNA
cgtgggtgtgcaagggtgca

SEQ ID NO: 11691 - DNA, 20 bp, Artificial Sequence
  sgRNA
gcgcggcgggtagcgctccc

SEQ ID NO: 11692 - DNA, 20 bp, Artificial Sequence
  sgRNA
gcgcgggactagacacaaag

SEQ ID NO: 11693 - DNA, 20 bp, Artificial Sequence
  sgRNA
tcgcaggctcagatagcgcg

SEQ ID NO: 11694 - DNA, 20 bp, Artificial Sequence
  sgRNA
tgcagtatggtgtgtgtgtt

SEQ ID NO: 11695 - DNA, 20 bp, Artificial Sequence
  sgRNA
gctctccatcagtcgttccg

SEQ ID NO: 11696 - DNA, 20 bp, Artificial Sequence
  sgRNA
cccggcgccaactgtggagg

SEQ ID NO: 11697 - DNA, 20 bp, Artificial Sequence
  sgRNA
gggcagcgagcgaatccgat

SEQ ID NO: 11698 - DNA, 20 bp, Artificial Sequence
  sgRNA
aaagtgctggtatgtggaac

SEQ ID NO: 11699 - DNA, 20 bp, Artificial Sequence
  sgRNA
tcaagctcagtgctcttaac

SEQ ID NO: 11700 - DNA, 20 bp, Artificial Sequence
  sgRNA
gcccgcagactccttatttg

SEQ ID NO: 11701 - DNA, 20 bp, Artificial Sequence
  sgRNA
aggtttgacccgggctgcct

SEQ ID NO: 11702 - DNA, 20 bp, Artificial Sequence
  sgRNA
ccagttcacagggctcccaa

SEQ ID NO: 11703 - DNA, 20 bp, Artificial Sequence
  sgRNA
tgtcacttccttggtctgtg

SEQ ID NO: 11704 - DNA, 20 bp, Artificial Sequence
  sgRNA
cggtcctgaaatgctgtcct

SEQ ID NO: 11705 - DNA, 20 bp, Artificial Sequence
  sgRNA
agctgatgcttgaccagctc

SEQ ID NO: 11706 - DNA, 20 bp, Artificial Sequence
  sgRNA
tatagctcgcgggcttaggc

SEQ ID NO: 11707 - DNA, 20 bp, Artificial Sequence
  sgRNA
cccgcggcactgaccgtcgg

SEQ ID NO: 11708 - DNA, 20 bp, Artificial Sequence
  sgRNA
gcaacatggcagcttctacc

SEQ ID NO: 11709 - DNA, 20 bp, Artificial Sequence
  sgRNA
ttatagtatcctgggaacca

SEQ ID NO: 11710 - DNA, 20 bp, Artificial Sequence
  sgRNA
caaacgttaaaggcctcaac

SEQ ID NO: 11711 - DNA, 20 bp, Artificial Sequence
  sgRNA
aatgctatggcaacagtttc

SEQ ID NO: 11712 - DNA, 20 bp, Artificial Sequence
  sgRNA
ctgcacgaaatgcttctctt

SEQ ID NO: 11713 - DNA, 20 bp, Artificial Sequence
  sgRNA
tgagtaggcagatgtgacac

SEQ ID NO: 11714 - DNA, 20 bp, Artificial Sequence
  sgRNA
gtgcggagctgtgtctcggg

SEQ ID NO: 11715 - DNA, 20 bp, Artificial Sequence
  sgRNA
acgctgccacctacagcgtc

SEQ ID NO: 11716 - DNA, 20 bp, Artificial Sequence
  sgRNA
aagcagtatactcaaatctg

SEQ ID NO: 11717 - DNA, 20 bp, Artificial Sequence
  sgRNA
ttcatcccgcctgggatctg

SEQ ID NO: 11718 - DNA, 20 bp, Artificial Sequence
  sgRNA
gctggcgcgggcaggaggag

SEQ ID NO: 11719 - DNA, 20 bp, Artificial Sequence
  sgRNA
agcgccggcgatgattcaaa

SEQ ID NO: 11720 - DNA, 20 bp, Artificial Sequence
  sgRNA
cgggcgtcagcttggagctg

SEQ ID NO: 11721 - DNA, 20 bp, Artificial Sequence
  sgRNA
atgctggagtttggtcaatg

SEQ ID NO: 11722 - DNA, 20 bp, Artificial Sequence
  sgRNA
actggctgtacctggtggga

SEQ ID NO: 11723 - DNA, 20 bp, Artificial Sequence
  sgRNA
aaactgtcaagccagcgcct

SEQ ID NO: 11724 - DNA, 20 bp, Artificial Sequence
  sgRNA
taattacggcgtgatccgag

SEQ ID NO: 11725 - DNA, 20 bp, Artificial Sequence
  sgRNA
ttctcaattagcaatcaagg

SEQ ID NO: 11726 - DNA, 20 bp, Artificial Sequence
  sgRNA
tattggctggctcctttaca

SEQ ID NO: 11727 - DNA, 20 bp, Artificial Sequence
  sgRNA
ggctgtccagtacttaactc

SEQ ID NO: 11728 - DNA, 20 bp, Artificial Sequence
  sgRNA
tgtccacgcgttacctaatt

SEQ ID NO: 11729 - DNA, 20 bp, Artificial Sequence
  sgRNA
atcaagcctagagcaaagcc

SEQ ID NO: 11730 - DNA, 20 bp, Artificial Sequence
  sgRNA
aacttccaaatctcctgtaa

SEQ ID NO: 11731 - DNA, 20 bp, Artificial Sequence
  sgRNA
cccagcaacaccaataagct

SEQ ID NO: 11732 - DNA, 20 bp, Artificial Sequence
  sgRNA
aggtgtcattcggcactggg

SEQ ID NO: 11733 - DNA, 20 bp, Artificial Sequence
  sgRNA
ctccacgcaaatttggaccg

SEQ ID NO: 11734 - DNA, 20 bp, Artificial Sequence
  sgRNA
tggctgcttgagtgggccaa

SEQ ID NO: 11735 - DNA, 20 bp, Artificial Sequence
  sgRNA
tttccagcttcaagactttg

SEQ ID NO: 11736 - DNA, 20 bp, Artificial Sequence
  sgRNA
aggcgaggatggaggaggag

SEQ ID NO: 11737 - DNA, 20 bp, Artificial Sequence
  sgRNA
gtgctgctctgggactgaac

SEQ ID NO: 11738 - DNA, 20 bp, Artificial Sequence
  sgRNA
gtactgggttctttagctcc

SEQ ID NO: 11739 - DNA, 20 bp, Artificial Sequence
  sgRNA
ctgtcataaatgggtgggca

SEQ ID NO: 11740 - DNA, 20 bp, Artificial Sequence
  sgRNA
agatgaagaaagaggcaagt

SEQ ID NO: 11741 - DNA, 20 bp, Artificial Sequence
  sgRNA
ggctgggaccgcacccaggc

SEQ ID NO: 11742 - DNA, 20 bp, Artificial Sequence
  sgRNA
gccttctattggcccagtga

SEQ ID NO: 11743 - DNA, 20 bp, Artificial Sequence
  sgRNA
cgtgacgtcagcccagagac

SEQ ID NO: 11744 - DNA, 20 bp, Artificial Sequence
  sgRNA
tccagttgggattagctcat

SEQ ID NO: 11745 - DNA, 20 bp, Artificial Sequence
  sgRNA
cagcatcagtacctcacttt

SEQ ID NO: 11746 - DNA, 20 bp, Artificial Sequence
  sgRNA
tatttggtagtttgatctca

SEQ ID NO: 11747 - DNA, 20 bp, Artificial Sequence
  sgRNA
ggtctttcagcatcacctcc

SEQ ID NO: 11748 - DNA, 20 bp, Artificial Sequence
  sgRNA
cccacggtaggaggacgcag

SEQ ID NO: 11749 - DNA, 20 bp, Artificial Sequence
  sgRNA
gaattggcccgccgcggccc

SEQ ID NO: 11750 - DNA, 20 bp, Artificial Sequence
  sgRNA
gagttaatgaagtactaggc

SEQ ID NO: 11751 - DNA, 20 bp, Artificial Sequence
  sgRNA
ggctgtgctagagcatctaa

SEQ ID NO: 11752 - DNA, 20 bp, Artificial Sequence
  sgRNA
cagataaaggttcaaacctg

SEQ ID NO: 11753 - DNA, 20 bp, Artificial Sequence
  sgRNA
tttgcttcatgatgaccatg

SEQ ID NO: 11754 - DNA, 20 bp, Artificial Sequence
  sgRNA
gagcaagcctgttgggcacg

SEQ ID NO: 11755 - DNA, 20 bp, Artificial Sequence
  sgRNA
ctcaattgagaaggtagttc

SEQ ID NO: 11756 - DNA, 20 bp, Artificial Sequence
  sgRNA
atctttgacttctagcttgg

SEQ ID NO: 11757 - DNA, 20 bp, Artificial Sequence
  sgRNA
catccgggccagggatactc

SEQ ID NO: 11758 - DNA, 20 bp, Artificial Sequence
  sgRNA
ctgtgaatgagactggtctc

SEQ ID NO: 11759 - DNA, 20 bp, Artificial Sequence
  sgRNA
agaagcgggtatcactgcgt

SEQ ID NO: 11760 - DNA, 20 bp, Artificial Sequence
  sgRNA
gtctgtaccgctactactaa

SEQ ID NO: 11761 - DNA, 20 bp, Artificial Sequence
  sgRNA
attactattgctttctggaa

SEQ ID NO: 11762 - DNA, 20 bp, Artificial Sequence
  sgRNA
ttcaaggagcaccgtctcta

SEQ ID NO: 11763 - DNA, 20 bp, Artificial Sequence
  sgRNA
ccgcccgcctcatcaatccc

SEQ ID NO: 11764 - DNA, 20 bp, Artificial Sequence
  sgRNA
ggcgagggagaggacgccct

SEQ ID NO: 11765 - DNA, 20 bp, Artificial Sequence
  sgRNA
tggttaggttaccactagct

SEQ ID NO: 11766 - DNA, 20 bp, Artificial Sequence
  sgRNA
ctgctctgccaaagtgcacc

SEQ ID NO: 11767 - DNA, 20 bp, Artificial Sequence
  sgRNA
tccgtgcgcagcacacagag

SEQ ID NO: 11768 - DNA, 20 bp, Artificial Sequence
  sgRNA
gggcgcggagggataccgcc

SEQ ID NO: 11769 - DNA, 20 bp, Artificial Sequence
  sgRNA
gctactgctgacagctgatt

SEQ ID NO: 11770 - DNA, 20 bp, Artificial Sequence
  sgRNA
ctacatcgttcatggagtgc

SEQ ID NO: 11771 - DNA, 20 bp, Artificial Sequence
  sgRNA
agcgtcacagactcccgcat

SEQ ID NO: 11772 - DNA, 20 bp, Artificial Sequence
  sgRNA
cggaggctggaactcacctg

SEQ ID NO: 11773 - DNA, 20 bp, Artificial Sequence
  sgRNA
tcagcgtggaattcatgaag

SEQ ID NO: 11774 - DNA, 20 bp, Artificial Sequence
  sgRNA
ggcaagtgcgccttgttcta

SEQ ID NO: 11775 - DNA, 20 bp, Artificial Sequence
  sgRNA
ccagttcaggctcagtttcc

SEQ ID NO: 11776 - DNA, 20 bp, Artificial Sequence
  sgRNA
gaggtgctaagcagacgtcc

SEQ ID NO: 11777 - DNA, 20 bp, Artificial Sequence
  sgRNA
gtcctcccatctgaagaccc

SEQ ID NO: 11778 - DNA, 20 bp, Artificial Sequence
  sgRNA
cctaccttattaacttagtg

SEQ ID NO: 11779 - DNA, 20 bp, Artificial Sequence
  sgRNA
ccaggcacccgaccctgcgt

SEQ ID NO: 11780 - DNA, 20 bp, Artificial Sequence
  sgRNA
ggcaggcagatctaagtgtg

SEQ ID NO: 11781 - DNA, 20 bp, Artificial Sequence
  sgRNA
gtcgaggagcggctccttaa

SEQ ID NO: 11782 - DNA, 20 bp, Artificial Sequence
  sgRNA
ccactacaatggcgtcgtag

SEQ ID NO: 11783 - DNA, 20 bp, Artificial Sequence
  sgRNA
cccttgcacgatctgtgggc

SEQ ID NO: 11784 - DNA, 20 bp, Artificial Sequence
  sgRNA
gtgtgaaggtaggatgtggc

SEQ ID NO: 11785 - DNA, 20 bp, Artificial Sequence
  sgRNA
tggtcacctcaatccctgca

SEQ ID NO: 11786 - DNA, 20 bp, Artificial Sequence
  sgRNA
cccagttatgggtggagcta

SEQ ID NO: 11787 - DNA, 20 bp, Artificial Sequence
  sgRNA
cgagttcacctatagtacat

SEQ ID NO: 11788 - DNA, 20 bp, Artificial Sequence
  sgRNA
gggaaagttataaagagaac

SEQ ID NO: 11789 - DNA, 20 bp, Artificial Sequence
  sgRNA
cacccttctcaggacggtgg

SEQ ID NO: 11790 - DNA, 20 bp, Artificial Sequence
  sgRNA
ggctcataggttctagatgt

SEQ ID NO: 11791 - DNA, 20 bp, Artificial Sequence
  sgRNA
gcttgacagacccactgtgg

SEQ ID NO: 11792 - DNA, 20 bp, Artificial Sequence
  sgRNA
tgacaagctagatccctttc

SEQ ID NO: 11793 - DNA, 20 bp, Artificial Sequence
  sgRNA
agggaggaggaatgagagag

SEQ ID NO: 11794 - DNA, 20 bp, Artificial Sequence
  sgRNA
gtccttattgcgggccgcgc

SEQ ID NO: 11795 - DNA, 20 bp, Artificial Sequence
  sgRNA
cccagataggctgagtaata

SEQ ID NO: 11796 - DNA, 20 bp, Artificial Sequence
  sgRNA
tctggccctagatatagcag

SEQ ID NO: 11797 - DNA, 20 bp, Artificial Sequence
  sgRNA
ggagggacggagacgcagac

SEQ ID NO: 11798 - DNA, 20 bp, Artificial Sequence
  sgRNA
cttcgctgtggctcttatag

SEQ ID NO: 11799 - DNA, 20 bp, Artificial Sequence
  sgRNA
agtcaaaggtcggtaaatag

SEQ ID NO: 11800 - DNA, 20 bp, Artificial Sequence
  sgRNA
aagtgactgactgggtagtc

SEQ ID NO: 11801 - DNA, 20 bp, Artificial Sequence
  sgRNA
gcaccgacgcgctcgctctg

SEQ ID NO: 11802 - DNA, 20 bp, Artificial Sequence
  sgRNA
ggtccgtgcgcttccttacc

SEQ ID NO: 11803 - DNA, 20 bp, Artificial Sequence
  sgRNA
gaggtgggtgtggacggctg

SEQ ID NO: 11804 - DNA, 20 bp, Artificial Sequence
  sgRNA
tactgagaattgttccgttg

SEQ ID NO: 11805 - DNA, 20 bp, Artificial Sequence
  sgRNA
tgttgggcccgcctctcctc

SEQ ID NO: 11806 - DNA, 20 bp, Artificial Sequence
  sgRNA
ggagagagagagaggagagc

SEQ ID NO: 11807 - DNA, 20 bp, Artificial Sequence
  sgRNA
acagccagctgctattggag

SEQ ID NO: 11808 - DNA, 20 bp, Artificial Sequence
  sgRNA
gctttgagttgtctagtcca

SEQ ID NO: 11809 - DNA, 20 bp, Artificial Sequence
  sgRNA
cacgacctttcaccctcaat

SEQ ID NO: 11810 - DNA, 20 bp, Artificial Sequence
  sgRNA
attggatgacgcagggaaag

SEQ ID NO: 11811 - DNA, 20 bp, Artificial Sequence
  sgRNA
aagactggagggcccgctat

SEQ ID NO: 11812 - DNA, 20 bp, Artificial Sequence
  sgRNA
agagtccgtttgtaaacctt

SEQ ID NO: 11813 - DNA, 20 bp, Artificial Sequence
  sgRNA
cgccttatctctacggccat

SEQ ID NO: 11814 - DNA, 20 bp, Artificial Sequence
  sgRNA
ctacgaaccagtccggagcg

SEQ ID NO: 11815 - DNA, 20 bp, Artificial Sequence
  sgRNA
tggatcgggttccattggcc

SEQ ID NO: 11816 - DNA, 20 bp, Artificial Sequence
  sgRNA
ttgctctgctcccgaagccc

SEQ ID NO: 11817 - DNA, 20 bp, Artificial Sequence
  sgRNA
cgcaattaaggatttaacca

SEQ ID NO: 11818 - DNA, 20 bp, Artificial Sequence
  sgRNA
atccaatcagaagcgccgat

SEQ ID NO: 11819 - DNA, 20 bp, Artificial Sequence
  sgRNA
gtgaagcggacgttcctcac

SEQ ID NO: 11820 - DNA, 20 bp, Artificial Sequence
  sgRNA
ctgtgctccgtggtactaat

SEQ ID NO: 11821 - DNA, 20 bp, Artificial Sequence
  sgRNA
ggaagtgtccgcagttcgcc

SEQ ID NO: 11822 - DNA, 20 bp, Artificial Sequence
  sgRNA
acgcctagacaccgacttaa

SEQ ID NO: 11823 - DNA, 20 bp, Artificial Sequence
  sgRNA
tggcggacatcacctgttcg

SEQ ID NO: 11824 - DNA, 20 bp, Artificial Sequence
  sgRNA
gcccaaaggagggagcgcgc

SEQ ID NO: 11825 - DNA, 20 bp, Artificial Sequence
  sgRNA
gggcgcggcttcgaccagcc

SEQ ID NO: 11826 - DNA, 20 bp, Artificial Sequence
  sgRNA
gggctcgaggcctaagtcta

SEQ ID NO: 11827 - DNA, 20 bp, Artificial Sequence
  sgRNA
agtgtgccagcctaagcctg

SEQ ID NO: 11828 - DNA, 20 bp, Artificial Sequence
  sgRNA
acgctggagcgcagagcatg

SEQ ID NO: 11829 - DNA, 20 bp, Artificial Sequence
  sgRNA
gcgcgcatctagaacatcac

SEQ ID NO: 11830 - DNA, 20 bp, Artificial Sequence
  sgRNA
ggccaggttcagatgaaaca

SEQ ID NO: 11831 - DNA, 20 bp, Artificial Sequence
  sgRNA
cgaggtccctatcacgcgcg

SEQ ID NO: 11832 - DNA, 20 bp, Artificial Sequence
  sgRNA
aacgagggtgtggcgaggcg

SEQ ID NO: 11833 - DNA, 20 bp, Artificial Sequence
  sgRNA
agcgggagtcttggagacct

SEQ ID NO: 11834 - DNA, 20 bp, Artificial Sequence
  sgRNA
ttgggtagcatcccactctc

SEQ ID NO: 11835 - DNA, 20 bp, Artificial Sequence
  sgRNA
gcgagtggcgagtgtcgggc

SEQ ID NO: 11836 - DNA, 20 bp, Artificial Sequence
  sgRNA
tgcgtggtaacctagcaacc

SEQ ID NO: 11837 - DNA, 20 bp, Artificial Sequence
  sgRNA
cgctgagctgattggacaac

SEQ ID NO: 11838 - DNA, 20 bp, Artificial Sequence
  sgRNA
aaactcaaccttgcgacgcc

SEQ ID NO: 11839 - DNA, 20 bp, Artificial Sequence
  sgRNA
ttgctttaaacgaccttctt

SEQ ID NO: 11840 - DNA, 20 bp, Artificial Sequence
  sgRNA
ggcgcagggctcagacgttc

SEQ ID NO: 11841 - DNA, 20 bp, Artificial Sequence
  sgRNA
gggtaaagcttattagcagt

SEQ ID NO: 11842 - DNA, 20 bp, Artificial Sequence
  sgRNA
aagttgagtgactgcgggac

SEQ ID NO: 11843 - DNA, 20 bp, Artificial Sequence
  sgRNA
cgcggctaagcttgcctaag

SEQ ID NO: 11844 - DNA, 20 bp, Artificial Sequence
  sgRNA
cgtctacagaaccgagaccc

SEQ ID NO: 11845 - DNA, 20 bp, Artificial Sequence
  sgRNA
acatcatcgtcgcgcagccc

SEQ ID NO: 11846 - DNA, 20 bp, Artificial Sequence
  sgRNA
gctcgcaccaatcgccggtg

SEQ ID NO: 11847 - DNA, 20 bp, Artificial Sequence
  sgRNA
ttcattaaaggcctccttat

SEQ ID NO: 11848 - DNA, 20 bp, Artificial Sequence
  sgRNA
ggcctccgagtgggagcccg

SEQ ID NO: 11849 - DNA, 20 bp, Artificial Sequence
  sgRNA
tgcagtcatctaattcctcc

SEQ ID NO: 11850 - DNA, 20 bp, Artificial Sequence
  sgRNA
acagcggccaagcacagcgc

SEQ ID NO: 11851 - DNA, 20 bp, Artificial Sequence
  sgRNA
ccgatgtccgcagatacagt

SEQ ID NO: 11852 - DNA, 20 bp, Artificial Sequence
  sgRNA
ttacaatacgagcgcacata

SEQ ID NO: 11853 - DNA, 20 bp, Artificial Sequence
  sgRNA
acgcctccttgtgcggcgac

SEQ ID NO: 11854 - DNA, 20 bp, Artificial Sequence
  sgRNA
gccacgtccgtccggcagcc

SEQ ID NO: 11855 - DNA, 20 bp, Artificial Sequence
  sgRNA
gtcccatctgtaatctgaca

SEQ ID NO: 11856 - DNA, 20 bp, Artificial Sequence
  sgRNA
tccaggctgtttgggtgaag

SEQ ID NO: 11857 - DNA, 20 bp, Artificial Sequence
  sgRNA
cagcagaaggagctactccc

SEQ ID NO: 11858 - DNA, 20 bp, Artificial Sequence
  sgRNA
ctggtcacagtgcagcggcc

SEQ ID NO: 11859 - DNA, 20 bp, Artificial Sequence
  sgRNA
gctctacggagagaccctag

SEQ ID NO: 11860 - DNA, 20 bp, Artificial Sequence
  sgRNA
aatgagtcactccttctcat

SEQ ID NO: 11861 - DNA, 20 bp, Artificial Sequence
  sgRNA
tggtatggctctaaacccac

SEQ ID NO: 11862 - DNA, 20 bp, Artificial Sequence
  sgRNA
tctactgagttgcagctgtc

SEQ ID NO: 11863 - DNA, 20 bp, Artificial Sequence
  sgRNA
actttgagttagtctctttg

SEQ ID NO: 11864 - DNA, 20 bp, Artificial Sequence
  sgRNA
cattaaaggcaaccataatt

SEQ ID NO: 11865 - DNA, 20 bp, Artificial Sequence
  sgRNA
tcacattaactgatgtgaga

SEQ ID NO: 11866 - DNA, 20 bp, Artificial Sequence
  sgRNA
ccgaacgtgcggagggaagg

SEQ ID NO: 11867 - DNA, 20 bp, Artificial Sequence
  sgRNA
tgtcaaacttcccattccgc

SEQ ID NO: 11868 - DNA, 20 bp, Artificial Sequence
  sgRNA
cgcaggatgctgctgcgccc

SEQ ID NO: 11869 - DNA, 20 bp, Artificial Sequence
  sgRNA
gaggacggaagaaaccgcgg

SEQ ID NO: 11870 - DNA, 20 bp, Artificial Sequence
  sgRNA
gcaaggaaatagcgggttga

SEQ ID NO: 11871 - DNA, 20 bp, Artificial Sequence
  sgRNA
ggcggtagtgccgggagagg

SEQ ID NO: 11872 - DNA, 20 bp, Artificial Sequence
  sgRNA
agagattactgatggacttt

SEQ ID NO: 11873 - DNA, 20 bp, Artificial Sequence
  sgRNA
ccagtagcctagggctgtct

SEQ ID NO: 11874 - DNA, 20 bp, Artificial Sequence
  sgRNA
gtgggtgtgttcacattgat

SEQ ID NO: 11875 - DNA, 20 bp, Artificial Sequence
  sgRNA
gtggtggccgttgaaccagc

SEQ ID NO: 11876 - DNA, 20 bp, Artificial Sequence
  sgRNA
gacagcatgcacatatatgg

SEQ ID NO: 11877 - DNA, 20 bp, Artificial Sequence
  sgRNA
gctgctatctcagtagctgg

SEQ ID NO: 11878 - DNA, 20 bp, Artificial Sequence
  sgRNA
ttattgtgcttctggaagtt

SEQ ID NO: 11879 - DNA, 20 bp, Artificial Sequence
  sgRNA
aacacaagatagtctcagtc

SEQ ID NO: 11880 - DNA, 20 bp, Artificial Sequence
  sgRNA
ggcacaggtccataaagaga

SEQ ID NO: 11881 - DNA, 20 bp, Artificial Sequence
  sgRNA
cagataatggttcaaataac

SEQ ID NO: 11882 - DNA, 20 bp, Artificial Sequence
  sgRNA
gggagagagagttacactcg

SEQ ID NO: 11883 - DNA, 20 bp, Artificial Sequence
  sgRNA
tttctgttaccatactaggg

SEQ ID NO: 11884 - DNA, 20 bp, Artificial Sequence
  sgRNA
tgaggacagacaggaggccc

SEQ ID NO: 11885 - DNA, 20 bp, Artificial Sequence
  sgRNA
tggcttgctctgtgagagga

SEQ ID NO: 11886 - DNA, 20 bp, Artificial Sequence
  sgRNA
agctgaaactcaggctccct

SEQ ID NO: 11887 - DNA, 20 bp, Artificial Sequence
  sgRNA
cgaggcagggagagagcagc

SEQ ID NO: 11888 - DNA, 20 bp, Artificial Sequence
  sgRNA
tgccacatgatgacgtctcc

SEQ ID NO: 11889 - DNA, 20 bp, Artificial Sequence
  sgRNA
tgaagggagggcacagggtg

SEQ ID NO: 11890 - DNA, 20 bp, Artificial Sequence
  sgRNA
caggcgaggcggtgtctgag

SEQ ID NO: 11891 - DNA, 20 bp, Artificial Sequence
  sgRNA
gagtagtaaccaagatgatc

SEQ ID NO: 11892 - DNA, 20 bp, Artificial Sequence
  sgRNA
cacccaatgcgcacgtgcgc

SEQ ID NO: 11893 - DNA, 20 bp, Artificial Sequence
  sgRNA
cagcaagagtctcccgtgag

SEQ ID NO: 11894 - DNA, 20 bp, Artificial Sequence
  sgRNA
gagctgagctccagatgtcg

SEQ ID NO: 11895 - DNA, 20 bp, Artificial Sequence
  sgRNA
acttcttgagcttagaaact

SEQ ID NO: 11896 - DNA, 20 bp, Artificial Sequence
  sgRNA
gtcgggagcgcgcttcttaa

SEQ ID NO: 11897 - DNA, 20 bp, Artificial Sequence
  sgRNA
ggctgctcaatttgcatgct

SEQ ID NO: 11898 - DNA, 20 bp, Artificial Sequence
  sgRNA
ggtgaagaaacacgggaggt

SEQ ID NO: 11899 - DNA, 20 bp, Artificial Sequence
  sgRNA
acaggcacacacgtgtgccc

SEQ ID NO: 11900 - DNA, 20 bp, Artificial Sequence
  sgRNA
gcgcatgtgacacgccgccg

SEQ ID NO: 11901 - DNA, 20 bp, Artificial Sequence
  sgRNA
gcaggtcccattaggcttgg

SEQ ID NO: 11902 - DNA, 20 bp, Artificial Sequence
  sgRNA
gccctctcctctcgggtact

SEQ ID NO: 11903 - DNA, 20 bp, Artificial Sequence
  sgRNA
ggagggagggaggtgcaaag

SEQ ID NO: 11904 - DNA, 20 bp, Artificial Sequence
  sgRNA
ctgtgactcactcagctttg

SEQ ID NO: 11905 - DNA, 20 bp, Artificial Sequence
  sgRNA
tagaacccgcttctcgggag

SEQ ID NO: 11906 - DNA, 20 bp, Artificial Sequence
  sgRNA
tgggcgtgcctgaacgtgca

SEQ ID NO: 11907 - DNA, 20 bp, Artificial Sequence
  sgRNA
agaagggaccacagcttgtg

SEQ ID NO: 11908 - DNA, 20 bp, Artificial Sequence
  sgRNA
cgggtcttatgccggtttca

SEQ ID NO: 11909 - DNA, 20 bp, Artificial Sequence
  sgRNA
tttgccagagagtcccgcag

SEQ ID NO: 11910 - DNA, 20 bp, Artificial Sequence
  sgRNA
tccggctatcgagtgcggcg

SEQ ID NO: 11911 - DNA, 20 bp, Artificial Sequence
  sgRNA
agaccgtgccttacatggcc

SEQ ID NO: 11912 - DNA, 20 bp, Artificial Sequence
  sgRNA
caaacacacgtggctgtgca

SEQ ID NO: 11913 - DNA, 20 bp, Artificial Sequence
  sgRNA
gcctggacttatgtagccaa

SEQ ID NO: 11914 - DNA, 20 bp, Artificial Sequence
  sgRNA
aaaggctgatgagctgtggt

SEQ ID NO: 11915 - DNA, 20 bp, Artificial Sequence
  sgRNA
catctggcaccagtgtgtgg

SEQ ID NO: 11916 - DNA, 20 bp, Artificial Sequence
  sgRNA
gactcggccaaagatttagc

SEQ ID NO: 11917 - DNA, 20 bp, Artificial Sequence
  sgRNA
cccgcgctgtgctgttctgg

SEQ ID NO: 11918 - DNA, 20 bp, Artificial Sequence
  sgRNA
agtcgccaggcagaacggaa

SEQ ID NO: 11919 - DNA, 20 bp, Artificial Sequence
  sgRNA
ccgctctcggcccagcaaca

SEQ ID NO: 11920 - DNA, 20 bp, Artificial Sequence
  sgRNA
tgggataacccaagctccgg

SEQ ID NO: 11921 - DNA, 20 bp, Artificial Sequence
  sgRNA
actacgcatgcgcgagcgac

SEQ ID NO: 11922 - DNA, 20 bp, Artificial Sequence
  sgRNA
ctacatttcccaagcagcgc

SEQ ID NO: 11923 - DNA, 20 bp, Artificial Sequence
  sgRNA
atccagtggcttgctgcttg

SEQ ID NO: 11924 - DNA, 20 bp, Artificial Sequence
  sgRNA
tccttcagtggccaagtggg

SEQ ID NO: 11925 - DNA, 20 bp, Artificial Sequence
  sgRNA
agtattacgtgtcagctgtg

SEQ ID NO: 11926 - DNA, 20 bp, Artificial Sequence
  sgRNA
ccacccgggtcccgccgcga

SEQ ID NO: 11927 - DNA, 20 bp, Artificial Sequence
  sgRNA
ccgccgcgcctcgctttcgg

SEQ ID NO: 11928 - DNA, 20 bp, Artificial Sequence
  sgRNA
gctggacacgcgccggctcc

SEQ ID NO: 11929 - DNA, 20 bp, Artificial Sequence
  sgRNA
ggagaagcaccagatgcaag

SEQ ID NO: 11930 - DNA, 20 bp, Artificial Sequence
  sgRNA
gagcagagtaccctgggacg

SEQ ID NO: 11931 - DNA, 20 bp, Artificial Sequence
  sgRNA
ctcctctggccataaatggg

SEQ ID NO: 11932 - DNA, 20 bp, Artificial Sequence
  sgRNA
ccaaatcatgctgctgagtc

SEQ ID NO: 11933 - DNA, 20 bp, Artificial Sequence
  sgRNA
cagtgtgagatgtgtcaaga

SEQ ID NO: 11934 - DNA, 20 bp, Artificial Sequence
  sgRNA
tgaccttgtcctggaggctg

SEQ ID NO: 11935 - DNA, 20 bp, Artificial Sequence
  sgRNA
tctgggagttgagacacagg

SEQ ID NO: 11936 - DNA, 20 bp, Artificial Sequence
  sgRNA
ggcgtaaggaaggcgtcccg

SEQ ID NO: 11937 - DNA, 20 bp, Artificial Sequence
  sgRNA
gctggatccactgcaatggc

SEQ ID NO: 11938 - DNA, 20 bp, Artificial Sequence
  sgRNA
gacatataggtggcctctgc

SEQ ID NO: 11939 - DNA, 20 bp, Artificial Sequence
  sgRNA
ttcaccgggagctctgaccc

SEQ ID NO: 11940 - DNA, 20 bp, Artificial Sequence
  sgRNA
tcctgctagaccgccatctg

SEQ ID NO: 11941 - DNA, 20 bp, Artificial Sequence
  sgRNA
tcggatttcatctaacatta

SEQ ID NO: 11942 - DNA, 20 bp, Artificial Sequence
  sgRNA
gcacgctcttgaacaaacgc

SEQ ID NO: 11943 - DNA, 20 bp, Artificial Sequence
  sgRNA
acggtcacgtgagtgacagc

SEQ ID NO: 11944 - DNA, 20 bp, Artificial Sequence
  sgRNA
cgtgcttaaacggcacagca

SEQ ID NO: 11945 - DNA, 20 bp, Artificial Sequence
  sgRNA
tgttgctaaacatgattaag

SEQ ID NO: 11946 - DNA, 20 bp, Artificial Sequence
  sgRNA
gcttattgttgggcagtgta

SEQ ID NO: 11947 - DNA, 20 bp, Artificial Sequence
  sgRNA
gctcccgctgtgcgtcgggc

SEQ ID NO: 11948 - DNA, 20 bp, Artificial Sequence
  sgRNA
gatgaacatcgcctagtcta

SEQ ID NO: 11949 - DNA, 20 bp, Artificial Sequence
  sgRNA
ctaagaccctggcattgagc

SEQ ID NO: 11950 - DNA, 20 bp, Artificial Sequence
  sgRNA
ggacaaagtacaaataatgt

SEQ ID NO: 11951 - DNA, 20 bp, Artificial Sequence
  sgRNA
gtttcacttcctgtggcgac

SEQ ID NO: 11952 - DNA, 20 bp, Artificial Sequence
  sgRNA
aggccgagagaagggcttcg

SEQ ID NO: 11953 - DNA, 20 bp, Artificial Sequence
  sgRNA
acctaggccgcgcagatcag

SEQ ID NO: 11954 - DNA, 20 bp, Artificial Sequence
  sgRNA
ggactttatgaagagaggct

SEQ ID NO: 11955 - DNA, 20 bp, Artificial Sequence
  sgRNA
tagatggcgatctagaagga

SEQ ID NO: 11956 - DNA, 20 bp, Artificial Sequence
  sgRNA
gggagttgtagtctgaactc

SEQ ID NO: 11957 - DNA, 20 bp, Artificial Sequence
  sgRNA
ggagaattcctagaggtttc

SEQ ID NO: 11958 - DNA, 20 bp, Artificial Sequence
  sgRNA
tttgcctacacctcaagcgc

SEQ ID NO: 11959 - DNA, 20 bp, Artificial Sequence
  sgRNA
tgccagcatgggagactcag

SEQ ID NO: 11960 - DNA, 20 bp, Artificial Sequence
  sgRNA
atgttacctccctgtattgg

SEQ ID NO: 11961 - DNA, 20 bp, Artificial Sequence
  sgRNA
cagaacccaaattggtcaag

SEQ ID NO: 11962 - DNA, 20 bp, Artificial Sequence
  sgRNA
gggtcacgcctgcgcactgg

SEQ ID NO: 11963 - DNA, 20 bp, Artificial Sequence
  sgRNA
cccacctccgcgattgcggg

SEQ ID NO: 11964 - DNA, 20 bp, Artificial Sequence
  sgRNA
ggcgcagagactgacagctg

SEQ ID NO: 11965 - DNA, 20 bp, Artificial Sequence
  sgRNA
cgccgggctccaagcagctc

SEQ ID NO: 11966 - DNA, 20 bp, Artificial Sequence
  sgRNA
aacgggactttcgactaccc

SEQ ID NO: 11967 - DNA, 20 bp, Artificial Sequence
  sgRNA
aggagcggtccaggcaagcg

SEQ ID NO: 11968 - DNA, 20 bp, Artificial Sequence
  sgRNA
agctatgtaaggcactctct

SEQ ID NO: 11969 - DNA, 20 bp, Artificial Sequence
  sgRNA
tacttcatgcaaattagggc

SEQ ID NO: 11970 - DNA, 20 bp, Artificial Sequence
  sgRNA
tgactcaaatttattgcaag

SEQ ID NO: 11971 - DNA, 20 bp, Artificial Sequence
  sgRNA
gagcccattgtttagtgttg

SEQ ID NO: 11972 - DNA, 20 bp, Artificial Sequence
  sgRNA
gatgggcggaagccagtacg

SEQ ID NO: 11973 - DNA, 20 bp, Artificial Sequence
  sgRNA
agaagcttctaggaggcggg

SEQ ID NO: 11974 - DNA, 20 bp, Artificial Sequence
  sgRNA
gatgctaggcgaagcattct

SEQ ID NO: 11975 - DNA, 20 bp, Artificial Sequence
  sgRNA
ggatcgtccggagctagccc

SEQ ID NO: 11976 - DNA, 20 bp, Artificial Sequence
  sgRNA
gaccgagaaggccagcctct

SEQ ID NO: 11977 - DNA, 20 bp, Artificial Sequence
  sgRNA
ccttcctggagtcctcatgg

SEQ ID NO: 11978 - DNA, 20 bp, Artificial Sequence
  sgRNA
cgaggaagtcggaaagtatc

SEQ ID NO: 11979 - DNA, 20 bp, Artificial Sequence
  sgRNA
gaagtcggctcgggcggatt

SEQ ID NO: 11980 - DNA, 20 bp, Artificial Sequence
  sgRNA
gatgcaggagactcagaatc

SEQ ID NO: 11981 - DNA, 20 bp, Artificial Sequence
  sgRNA
agtcatgagaatttctgata

SEQ ID NO: 11982 - DNA, 20 bp, Artificial Sequence
  sgRNA
tgcagtcgacaccttattat

SEQ ID NO: 11983 - DNA, 20 bp, Artificial Sequence
  sgRNA
ggtgagggcaggaaatcatc

SEQ ID NO: 11984 - DNA, 20 bp, Artificial Sequence
  sgRNA
gatgaggcagcccgtccact

SEQ ID NO: 11985 - DNA, 20 bp, Artificial Sequence
  sgRNA
tgctcaccaccgcgtgcgac

SEQ ID NO: 11986 - DNA, 20 bp, Artificial Sequence
  sgRNA
tggagctagtcagggcccaa

SEQ ID NO: 11987 - DNA, 20 bp, Artificial Sequence
  sgRNA
ctcttcagatcctgtgggtg

SEQ ID NO: 11988 - DNA, 20 bp, Artificial Sequence
  sgRNA
ctgaggagtgcataggctgc

SEQ ID NO: 11989 - DNA, 20 bp, Artificial Sequence
  sgRNA
tgtagactacgcgtactaag

SEQ ID NO: 11990 - DNA, 20 bp, Artificial Sequence
  sgRNA
aagctatacacagtgccctc

SEQ ID NO: 11991 - DNA, 20 bp, Artificial Sequence
  sgRNA
tgcaaactttgaccgtgctg

SEQ ID NO: 11992 - DNA, 20 bp, Artificial Sequence
  sgRNA
cacgtcagaggcgaggcttc

SEQ ID NO: 11993 - DNA, 20 bp, Artificial Sequence
  sgRNA
ctaggctgagggtaaagttg

SEQ ID NO: 11994 - DNA, 20 bp, Artificial Sequence
  sgRNA
acgaacgaggacctacgggc

SEQ ID NO: 11995 - DNA, 20 bp, Artificial Sequence
  sgRNA
cttctcagcagcacccgcat

SEQ ID NO: 11996 - DNA, 20 bp, Artificial Sequence
  sgRNA
gaagggtgcacgcccttggg

SEQ ID NO: 11997 - DNA, 20 bp, Artificial Sequence
  sgRNA
agctgtttcctttgcgttta

SEQ ID NO: 11998 - DNA, 20 bp, Artificial Sequence
  sgRNA
tgtctgctaaatgcttcacc

SEQ ID NO: 11999 - DNA, 20 bp, Artificial Sequence
  sgRNA
ccatgctgtgagtgaacttt

SEQ ID NO: 12000 - DNA, 20 bp, Artificial Sequence
  sgRNA
gtagtgcagagcccatgctc

SEQ ID NO: 12001 - DNA, 20 bp, Artificial Sequence
  sgRNA
tggaggtgctctgtgcgcca

SEQ ID NO: 12002 - DNA, 20 bp, Artificial Sequence
  sgRNA
ctcaacaggtcatgcccgcg

SEQ ID NO: 12003 - DNA, 20 bp, Artificial Sequence
  sgRNA
ggtgctgctgtcaaggctgg

SEQ ID NO: 12004 - DNA, 20 bp, Artificial Sequence
  sgRNA
tagactgttaacttcttgag

SEQ ID NO: 12005 - DNA, 20 bp, Artificial Sequence
  sgRNA
ggataaacatcccaggcgga

SEQ ID NO: 12006 - DNA, 20 bp, Artificial Sequence
  sgRNA
agaggttaactgaagcatta

SEQ ID NO: 12007 - DNA, 20 bp, Artificial Sequence
  sgRNA
ctctcccatagacctagtcc

SEQ ID NO: 12008 - DNA, 20 bp, Artificial Sequence
  sgRNA
actctcactctcaaagactc

SEQ ID NO: 12009 - DNA, 20 bp, Artificial Sequence
  sgRNA
tgcacatacacagtaagagt

SEQ ID NO: 12010 - DNA, 20 bp, Artificial Sequence
  sgRNA
gcactagtaaatagttcaat

SEQ ID NO: 12011 - DNA, 20 bp, Artificial Sequence
  sgRNA
ttcagggtttagtaaactct

SEQ ID NO: 12012 - DNA, 20 bp, Artificial Sequence
  sgRNA
tgtaaactcttctacaggac

SEQ ID NO: 12013 - DNA, 20 bp, Artificial Sequence
  sgRNA
gttagatgcagttcctaccc

SEQ ID NO: 12014 - DNA, 20 bp, Artificial Sequence
  sgRNA
ctctctgctgttaccgcctt

SEQ ID NO: 12015 - DNA, 20 bp, Artificial Sequence
  sgRNA
agcttacccagacagccaat

SEQ ID NO: 12016 - DNA, 20 bp, Artificial Sequence
  sgRNA
aacgcggtcacttccgtttc

SEQ ID NO: 12017 - DNA, 20 bp, Artificial Sequence
  sgRNA
tggctccgccgtctgacgtt

SEQ ID NO: 12018 - DNA, 20 bp, Artificial Sequence
  sgRNA
ggatcagggattacagattc

SEQ ID NO: 12019 - DNA, 20 bp, Artificial Sequence
  sgRNA
atattgttaaagaaccaccc

SEQ ID NO: 12020 - DNA, 20 bp, Artificial Sequence
  sgRNA
ggatctcaggttaatgggtt

SEQ ID NO: 12021 - DNA, 20 bp, Artificial Sequence
  sgRNA
ttacctgcctaacactcatg

SEQ ID NO: 12022 - DNA, 20 bp, Artificial Sequence
  sgRNA
gcaggtgtccgcccaaggcg

SEQ ID NO: 12023 - DNA, 20 bp, Artificial Sequence
  sgRNA
gaagggagatgctctttagg

SEQ ID NO: 12024 - DNA, 20 bp, Artificial Sequence
  sgRNA
actcgctcgggcccgtgccc

SEQ ID NO: 12025 - DNA, 20 bp, Artificial Sequence
  sgRNA
gtagagctgaggcgggatgc

SEQ ID NO: 12026 - DNA, 20 bp, Artificial Sequence
  sgRNA
cccaccctctcagccatagg

SEQ ID NO: 12027 - DNA, 20 bp, Artificial Sequence
  sgRNA
tcacatgacgcagcccatca

SEQ ID NO: 12028 - DNA, 20 bp, Artificial Sequence
  sgRNA
atcatagtgcaccacgccct

SEQ ID NO: 12029 - DNA, 20 bp, Artificial Sequence
  sgRNA
gcgaagcgacactcgggttc

SEQ ID NO: 12030 - DNA, 20 bp, Artificial Sequence
  sgRNA
gcctgacagctgatggcgga

SEQ ID NO: 12031 - DNA, 20 bp, Artificial Sequence
  sgRNA
gccgtcggcgggtcgcgtag

SEQ ID NO: 12032 - DNA, 20 bp, Artificial Sequence
  sgRNA
cagtgagtcccgttacccac

SEQ ID NO: 12033 - DNA, 20 bp, Artificial Sequence
  sgRNA
taccggttgctatagcgccc

SEQ ID NO: 12034 - DNA, 20 bp, Artificial Sequence
  sgRNA
ctgggtccgggctgtggtgt

SEQ ID NO: 12035 - DNA, 20 bp, Artificial Sequence
  sgRNA
gacgtgcgcgcgcccgacag

SEQ ID NO: 12036 - DNA, 20 bp, Artificial Sequence
  sgRNA
ccctcccggaaatggccttg

SEQ ID NO: 12037 - DNA, 20 bp, Artificial Sequence
  sgRNA
tggaagttgatggattggac

SEQ ID NO: 12038 - DNA, 20 bp, Artificial Sequence
  sgRNA
tgaaatgaagagtgagttct

SEQ ID NO: 12039 - DNA, 20 bp, Artificial Sequence
  sgRNA
actacttaatgagatgggag

SEQ ID NO: 12040 - DNA, 20 bp, Artificial Sequence
  sgRNA
ccaccagatcctgttaagaa

SEQ ID NO: 12041 - DNA, 20 bp, Artificial Sequence
  sgRNA
ggcaagaggcagagcattgt

SEQ ID NO: 12042 - DNA, 20 bp, Artificial Sequence
  sgRNA
ctctccggcatctctagttt

SEQ ID NO: 12043 - DNA, 20 bp, Artificial Sequence
  sgRNA
gcagccgggctgccgctgcg

SEQ ID NO: 12044 - DNA, 20 bp, Artificial Sequence
  sgRNA
ccggcagcagcggcggtggg

SEQ ID NO: 12045 - DNA, 20 bp, Artificial Sequence
  sgRNA
tacgcagggccgccggcagg

SEQ ID NO: 12046 - DNA, 20 bp, Artificial Sequence
  sgRNA
tgatcagatcatgcccttag

SEQ ID NO: 12047 - DNA, 20 bp, Artificial Sequence
  sgRNA
tttcatcatgatgtattgtg

SEQ ID NO: 12048 - DNA, 20 bp, Artificial Sequence
  sgRNA
ctgacgcctcctttcggccc

SEQ ID NO: 12049 - DNA, 20 bp, Artificial Sequence
  sgRNA
tgcttgggttgaggtgccaa

SEQ ID NO: 12050 - DNA, 20 bp, Artificial Sequence
  sgRNA
ctcctgtccgtgaatggagg

SEQ ID NO: 12051 - DNA, 20 bp, Artificial Sequence
  sgRNA
cactttaactcattgtcatc

SEQ ID NO: 12052 - DNA, 20 bp, Artificial Sequence
  sgRNA
atttctccaattgggaatga

SEQ ID NO: 12053 - DNA, 20 bp, Artificial Sequence
  sgRNA
tgacacaaggaatactcaca

SEQ ID NO: 12054 - DNA, 20 bp, Artificial Sequence
  sgRNA
aagttcgaacccagtttgtg

SEQ ID NO: 12055 - DNA, 20 bp, Artificial Sequence
  sgRNA
ggtcgagacgtgccgtgagg

SEQ ID NO: 12056 - DNA, 20 bp, Artificial Sequence
  sgRNA
aacgtgcgcgttgacgtacg

SEQ ID NO: 12057 - DNA, 20 bp, Artificial Sequence
  sgRNA
agcacgtctcctaagagctg

SEQ ID NO: 12058 - DNA, 20 bp, Artificial Sequence
  sgRNA
caatcccgcgctagagactt

SEQ ID NO: 12059 - DNA, 20 bp, Artificial Sequence
  sgRNA
gtagaagagagacgcccagt

SEQ ID NO: 12060 - DNA, 20 bp, Artificial Sequence
  sgRNA
tgaatgtgaaatacccacac

SEQ ID NO: 12061 - DNA, 20 bp, Artificial Sequence
  sgRNA
ctgtgtctgggcctacactg

SEQ ID NO: 12062 - DNA, 20 bp, Artificial Sequence
  sgRNA
cagctcatggtttgagaatt

SEQ ID NO: 12063 - DNA, 20 bp, Artificial Sequence
  sgRNA
atctttgcgacacagcctga

SEQ ID NO: 12064 - DNA, 20 bp, Artificial Sequence
  sgRNA
gcagtatcattcacagcagg

SEQ ID NO: 12065 - DNA, 20 bp, Artificial Sequence
  sgRNA
caaagaggaagtctgtgcct

SEQ ID NO: 12066 - DNA, 20 bp, Artificial Sequence
  sgRNA
ctctttaatctgccttgccc

SEQ ID NO: 12067 - DNA, 20 bp, Artificial Sequence
  sgRNA
ctcgacttcaaatgtggttt

SEQ ID NO: 12068 - DNA, 20 bp, Artificial Sequence
  sgRNA
gcagacaaagagcaacatcc

SEQ ID NO: 12069 - DNA, 20 bp, Artificial Sequence
  sgRNA
acatacccaaacccagtgtc

SEQ ID NO: 12070 - DNA, 20 bp, Artificial Sequence
  sgRNA
gatgtggacaactggttaag

SEQ ID NO: 12071 - DNA, 20 bp, Artificial Sequence
  sgRNA
agaaagactggaaatggaaa

SEQ ID NO: 12072 - DNA, 20 bp, Artificial Sequence
  sgRNA
ggaacgatgtcgtgggaagc

SEQ ID NO: 12073 - DNA, 20 bp, Artificial Sequence
  sgRNA
cctccctgagacccggatgc

SEQ ID NO: 12074 - DNA, 20 bp, Artificial Sequence
  sgRNA
actcaggctccgtcctcgcc

SEQ ID NO: 12075 - DNA, 20 bp, Artificial Sequence
  sgRNA
gactattctccaagagccta

SEQ ID NO: 12076 - DNA, 20 bp, Artificial Sequence
  sgRNA
tcagaattctcgtgattggc

SEQ ID NO: 12077 - DNA, 20 bp, Artificial Sequence
  sgRNA
cttctggcgcggcttctcat

SEQ ID NO: 12078 - DNA, 20 bp, Artificial Sequence
  sgRNA
ttctctgactgttcaactca

SEQ ID NO: 12079 - DNA, 20 bp, Artificial Sequence
  sgRNA
aatctctggagactgaagct

SEQ ID NO: 12080 - DNA, 20 bp, Artificial Sequence
  sgRNA
taagagcaggtcacgtggca

SEQ ID NO: 12081 - DNA, 20 bp, Artificial Sequence
  sgRNA
gaggaccttgaattaaggac

SEQ ID NO: 12082 - DNA, 20 bp, Artificial Sequence
  sgRNA
atggtcacccaagtgggagg

SEQ ID NO: 12083 - DNA, 20 bp, Artificial Sequence
  sgRNA
cagggacttcccaccagtct

SEQ ID NO: 12084 - DNA, 20 bp, Artificial Sequence
  sgRNA
taggtcatcgctagcaggtt

SEQ ID NO: 12085 - DNA, 20 bp, Artificial Sequence
  sgRNA
ttgggttctataagaagagc

SEQ ID NO: 12086 - DNA, 20 bp, Artificial Sequence
  sgRNA
aggcatgagatccaactgta

SEQ ID NO: 12087 - DNA, 20 bp, Artificial Sequence
  sgRNA
tcttacgcaagtgtgctctt

SEQ ID NO: 12088 - DNA, 20 bp, Artificial Sequence
  sgRNA
gatgatactcgtgttcagtg

SEQ ID NO: 12089 - DNA, 20 bp, Artificial Sequence
  sgRNA
agtctgtttcagcgggtctg

SEQ ID NO: 12090 - DNA, 20 bp, Artificial Sequence
  sgRNA
gacaggagcccagaactacc

SEQ ID NO: 12091 - DNA, 20 bp, Artificial Sequence
  sgRNA
attgcaagatctggaatgct

SEQ ID NO: 12092 - DNA, 20 bp, Artificial Sequence
  sgRNA
cccagaactgctagagaggg

SEQ ID NO: 12093 - DNA, 20 bp, Artificial Sequence
  sgRNA
ctcgggtccttgccctattc

SEQ ID NO: 12094 - DNA, 20 bp, Artificial Sequence
  sgRNA
gtaactcgggcgggtctgcc

SEQ ID NO: 12095 - DNA, 20 bp, Artificial Sequence
  sgRNA
gactaacactgaagccaccc

SEQ ID NO: 12096 - DNA, 20 bp, Artificial Sequence
  sgRNA
gagaggctcaagtagagccc

SEQ ID NO: 12097 - DNA, 20 bp, Artificial Sequence
  sgRNA
gcgcagcaggcacttcatga

SEQ ID NO: 12098 - DNA, 20 bp, Artificial Sequence
  sgRNA
atgcgtacctagcgtcgtcc

SEQ ID NO: 12099 - DNA, 20 bp, Artificial Sequence
  sgRNA
tcagtctgtagccatttgag

SEQ ID NO: 12100 - DNA, 20 bp, Artificial Sequence
  sgRNA
ctccctttggtcaacgcacg

SEQ ID NO: 12101 - DNA, 20 bp, Artificial Sequence
  sgRNA
ggcaaacccttgcttacaaa

SEQ ID NO: 12102 - DNA, 20 bp, Artificial Sequence
  sgRNA
aaagctgatgactcatggaa

SEQ ID NO: 12103 - DNA, 20 bp, Artificial Sequence
  sgRNA
ccttaaaccaacgcataagc

SEQ ID NO: 12104 - DNA, 20 bp, Artificial Sequence
  sgRNA
taagcaggaggttgggctag

SEQ ID NO: 12105 - DNA, 20 bp, Artificial Sequence
  sgRNA
ctccctgtggtggaggctcg

SEQ ID NO: 12106 - DNA, 20 bp, Artificial Sequence
  sgRNA
gagcaatacagcaggagtcg

SEQ ID NO: 12107 - DNA, 20 bp, Artificial Sequence
  sgRNA
ctgctcacagcaggtagaac

SEQ ID NO: 12108 - DNA, 20 bp, Artificial Sequence
  sgRNA
tgggtaccgcataaagaaca

SEQ ID NO: 12109 - DNA, 20 bp, Artificial Sequence
  sgRNA
aagaatgttccaaagtgcaa

SEQ ID NO: 12110 - DNA, 20 bp, Artificial Sequence
  sgRNA
cagatcaatccattgcactt

SEQ ID NO: 12111 - DNA, 20 bp, Artificial Sequence
  sgRNA
aatagttggagcgggagtct

SEQ ID NO: 12112 - DNA, 20 bp, Artificial Sequence
  sgRNA
ccaatggccgacgggactcc

SEQ ID NO: 12113 - DNA, 20 bp, Artificial Sequence
  sgRNA
cccaccctgttcaggatggt

SEQ ID NO: 12114 - DNA, 20 bp, Artificial Sequence
  sgRNA
gacgcacacgcagccgaccc

SEQ ID NO: 12115 - DNA, 20 bp, Artificial Sequence
  sgRNA
gcatgcgcgaggtggctccc

SEQ ID NO: 12116 - DNA, 20 bp, Artificial Sequence
  sgRNA
cgaggtcccgccctcaaccg

SEQ ID NO: 12117 - DNA, 20 bp, Artificial Sequence
  sgRNA
tgggcatttatcaccttggg

SEQ ID NO: 12118 - DNA, 20 bp, Artificial Sequence
  sgRNA
cgggactgcgcatgtaccct

SEQ ID NO: 12119 - DNA, 20 bp, Artificial Sequence
  sgRNA
gcgggccttcagaatccgat

SEQ ID NO: 12120 - DNA, 20 bp, Artificial Sequence
  sgRNA
gagaaaggagaaagaaaggg

SEQ ID NO: 12121 - DNA, 20 bp, Artificial Sequence
  sgRNA
ggcagaaagtgagagcacac

SEQ ID NO: 12122 - DNA, 20 bp, Artificial Sequence
  sgRNA
gaaactggctgcttctgaga

SEQ ID NO: 12123 - DNA, 20 bp, Artificial Sequence
  sgRNA
tgcattccaacatgagtctt

SEQ ID NO: 12124 - DNA, 20 bp, Artificial Sequence
  sgRNA
cattggtggaaaggttatgg

SEQ ID NO: 12125 - DNA, 20 bp, Artificial Sequence
  sgRNA
ggctcacatatttaaaccta

SEQ ID NO: 12126 - DNA, 20 bp, Artificial Sequence
  sgRNA
aagcaggagtagaaatagag

SEQ ID NO: 12127 - DNA, 20 bp, Artificial Sequence
  sgRNA
gcacgcggcctctaccaatt

SEQ ID NO: 12128 - DNA, 20 bp, Artificial Sequence
  sgRNA
ttgcagctcacagccagagc

SEQ ID NO: 12129 - DNA, 20 bp, Artificial Sequence
  sgRNA
gaccacccggcacgtcctcg

SEQ ID NO: 12130 - DNA, 20 bp, Artificial Sequence
  sgRNA
gtgccgtttatatggagact

SEQ ID NO: 12131 - DNA, 20 bp, Artificial Sequence
  sgRNA
gctaagggctggaggagtgg

SEQ ID NO: 12132 - DNA, 20 bp, Artificial Sequence
  sgRNA
tgataagacagtgaatacca

SEQ ID NO: 12133 - DNA, 20 bp, Artificial Sequence
  sgRNA
gaacgtgtaggtaatcgttt

SEQ ID NO: 12134 - DNA, 20 bp, Artificial Sequence
  sgRNA
agagatgcgactaggttgcc

SEQ ID NO: 12135 - DNA, 20 bp, Artificial Sequence
  sgRNA
acggctgggctggccaggtg

SEQ ID NO: 12136 - DNA, 20 bp, Artificial Sequence
  sgRNA
gtgaatcagaccgtcagtat

SEQ ID NO: 12137 - DNA, 20 bp, Artificial Sequence
  sgRNA
aagaagtctgcggcagggca

SEQ ID NO: 12138 - DNA, 20 bp, Artificial Sequence
  sgRNA
ggcgggcctaagcagggtag

SEQ ID NO: 12139 - DNA, 20 bp, Artificial Sequence
  sgRNA
gggtttctgacagtcgcaga

SEQ ID NO: 12140 - DNA, 20 bp, Artificial Sequence
  sgRNA
ggagagatctaccaaagcag

SEQ ID NO: 12141 - DNA, 20 bp, Artificial Sequence
  sgRNA
gccgggtgctcttcagccaa

SEQ ID NO: 12142 - DNA, 20 bp, Artificial Sequence
  sgRNA
atcagcttccgtctgcgcat

SEQ ID NO: 12143 - DNA, 20 bp, Artificial Sequence
  sgRNA
cgctcagggtcgtaacaaca

SEQ ID NO: 12144 - DNA, 20 bp, Artificial Sequence
  sgRNA
gttcctgagacctgagcgct

SEQ ID NO: 12145 - DNA, 20 bp, Artificial Sequence
  sgRNA
ggagacgcggtgacacggcg

SEQ ID NO: 12146 - DNA, 20 bp, Artificial Sequence
  sgRNA
gcgtgatcacacgcttagcc

SEQ ID NO: 12147 - DNA, 20 bp, Artificial Sequence
  sgRNA
gcgaccatagagttccagca

SEQ ID NO: 12148 - DNA, 20 bp, Artificial Sequence
  sgRNA
ggctagagaggaagtgcgga

SEQ ID NO: 12149 - DNA, 20 bp, Artificial Sequence
  sgRNA
cagtacttagtctgaatgcg

SEQ ID NO: 12150 - DNA, 20 bp, Artificial Sequence
  sgRNA
ctctcagcagagtctaaaga

SEQ ID NO: 12151 - DNA, 20 bp, Artificial Sequence
  sgRNA
agagaggagggacgattggc

SEQ ID NO: 12152 - DNA, 20 bp, Artificial Sequence
  sgRNA
ctgctgtagactgaccacaa

SEQ ID NO: 12153 - DNA, 20 bp, Artificial Sequence
  sgRNA
gtttggcctggtggtttcca

SEQ ID NO: 12154 - DNA, 20 bp, Artificial Sequence
  sgRNA
agagacaggttctctcctac

SEQ ID NO: 12155 - DNA, 20 bp, Artificial Sequence
  sgRNA
gggaacgccctcttgcacgc

SEQ ID NO: 12156 - DNA, 20 bp, Artificial Sequence
  sgRNA
acctagttgtccggcgggag

SEQ ID NO: 12157 - DNA, 20 bp, Artificial Sequence
  sgRNA
gtgaagcgccctcctttaga

SEQ ID NO: 12158 - DNA, 20 bp, Artificial Sequence
  sgRNA
gaacaaaggactggagttgg

SEQ ID NO: 12159 - DNA, 20 bp, Artificial Sequence
  sgRNA
ggaccatccatcaagaagaa

SEQ ID NO: 12160 - DNA, 20 bp, Artificial Sequence
  sgRNA
cagattctccaaggctgatg

SEQ ID NO: 12161 - DNA, 20 bp, Artificial Sequence
  sgRNA
cccgctggacaatgcacctg

SEQ ID NO: 12162 - DNA, 20 bp, Artificial Sequence
  sgRNA
agggacacgctgagatcgcc

SEQ ID NO: 12163 - DNA, 20 bp, Artificial Sequence
  sgRNA
cagatgtagaaagtagtccc

SEQ ID NO: 12164 - DNA, 20 bp, Artificial Sequence
  sgRNA
gacgcctgctcggctttccc

SEQ ID NO: 12165 - DNA, 20 bp, Artificial Sequence
  sgRNA
tcgcgagacgaggtgagagc

SEQ ID NO: 12166 - DNA, 20 bp, Artificial Sequence
  sgRNA
gagagagagcgggagggctg

SEQ ID NO: 12167 - DNA, 20 bp, Artificial Sequence
  sgRNA
agtggaccggaatgcctgtc

SEQ ID NO: 12168 - DNA, 20 bp, Artificial Sequence
  sgRNA
cagaactctaagcttcccat

SEQ ID NO: 12169 - DNA, 20 bp, Artificial Sequence
  sgRNA
ggtgaggtcagtcacacaac

SEQ ID NO: 12170 - DNA, 20 bp, Artificial Sequence
  sgRNA
gagaacgccctagagcctgg

SEQ ID NO: 12171 - DNA, 20 bp, Artificial Sequence
  sgRNA
tgtagaagaggccgagcctg

SEQ ID NO: 12172 - DNA, 20 bp, Artificial Sequence
  sgRNA
ggcaagctgggcgctttagg

SEQ ID NO: 12173 - DNA, 20 bp, Artificial Sequence
  sgRNA
tacacacgatgggctgtgtg

SEQ ID NO: 12174 - DNA, 20 bp, Artificial Sequence
  sgRNA
cagtcttaaagcagcagcag

SEQ ID NO: 12175 - DNA, 20 bp, Artificial Sequence
  sgRNA
agtgcggcggatcacgcagt

SEQ ID NO: 12176 - DNA, 20 bp, Artificial Sequence
  sgRNA
gaggagggccgcgacgagcc

SEQ ID NO: 12177 - DNA, 20 bp, Artificial Sequence
  sgRNA
cccggcggagcagccgactc

SEQ ID NO: 12178 - DNA, 20 bp, Artificial Sequence
  sgRNA
ccggcgcggacgtgcgcacc

SEQ ID NO: 12179 - DNA, 20 bp, Artificial Sequence
  sgRNA
gagaatttctggaactttca

SEQ ID NO: 12180 - DNA, 20 bp, Artificial Sequence
  sgRNA
cacctttgattggtttatga

SEQ ID NO: 12181 - DNA, 20 bp, Artificial Sequence
  sgRNA
attcaaatgagggatgtgaa

SEQ ID NO: 12182 - DNA, 20 bp, Artificial Sequence
  sgRNA
acggttaaccttagcgggcg

SEQ ID NO: 12183 - DNA, 20 bp, Artificial Sequence
  sgRNA
acttgggatagcctgcagtg

SEQ ID NO: 12184 - DNA, 20 bp, Artificial Sequence
  sgRNA
ttgcaggcatctgaggtttc

SEQ ID NO: 12185 - DNA, 20 bp, Artificial Sequence
  sgRNA
actgataaggcagaagccac

SEQ ID NO: 12186 - DNA, 20 bp, Artificial Sequence
  sgRNA
tacaaattcctgcttggacc

SEQ ID NO: 12187 - DNA, 20 bp, Artificial Sequence
  sgRNA
ggagacaagagccaacaagc

SEQ ID NO: 12188 - DNA, 20 bp, Artificial Sequence
  sgRNA
ttacgtcagtgtgctgtttc

SEQ ID NO: 12189 - DNA, 20 bp, Artificial Sequence
  sgRNA
agcttcctttctcacatctc

SEQ ID NO: 12190 - DNA, 20 bp, Artificial Sequence
  sgRNA
gtacatcacagtagccgatg

SEQ ID NO: 12191 - DNA, 20 bp, Artificial Sequence
  sgRNA
tgacttgatggctgagcaca

SEQ ID NO: 12192 - DNA, 20 bp, Artificial Sequence
  sgRNA
cccgccatggattggttgag

SEQ ID NO: 12193 - DNA, 20 bp, Artificial Sequence
  sgRNA
cctcggcccagagttctaat

SEQ ID NO: 12194 - DNA, 20 bp, Artificial Sequence
  sgRNA
gaggcagcctacacacttcc

SEQ ID NO: 12195 - DNA, 20 bp, Artificial Sequence
  sgRNA
gacttggtgacatattgttc

SEQ ID NO: 12196 - DNA, 20 bp, Artificial Sequence
  sgRNA
ctgagatgaaatggatagag

SEQ ID NO: 12197 - DNA, 20 bp, Artificial Sequence
  sgRNA
tgctgcagcctgggattgcc

SEQ ID NO: 12198 - DNA, 20 bp, Artificial Sequence
  sgRNA
ctcacagctttgtttaaacc

SEQ ID NO: 12199 - DNA, 20 bp, Artificial Sequence
  sgRNA
tgaatcgctggcccggacag

SEQ ID NO: 12200 - DNA, 20 bp, Artificial Sequence
  sgRNA
cgcacggagcaaccggctag

SEQ ID NO: 12201 - DNA, 20 bp, Artificial Sequence
  sgRNA
aaattggtgcgcatgcccgg

SEQ ID NO: 12202 - DNA, 20 bp, Artificial Sequence
  sgRNA
cgtcgctagtgcccacctcc

SEQ ID NO: 12203 - DNA, 20 bp, Artificial Sequence
  sgRNA
ggagagcggcagtgtcgccc

SEQ ID NO: 12204 - DNA, 20 bp, Artificial Sequence
  sgRNA
gctgcgcttcctcagcccga

SEQ ID NO: 12205 - DNA, 20 bp, Artificial Sequence
  sgRNA
gaagcgggccgagcgtgcgc

SEQ ID NO: 12206 - DNA, 20 bp, Artificial Sequence
  sgRNA
gaactgcgagcacaccaccc

SEQ ID NO: 12207 - DNA, 20 bp, Artificial Sequence
  sgRNA
tgcgcggttgctaagcgacg

SEQ ID NO: 12208 - DNA, 20 bp, Artificial Sequence
  sgRNA
cggtccgcagggagaccacg

SEQ ID NO: 12209 - DNA, 20 bp, Artificial Sequence
  sgRNA
cccggaaccgtggaaggcgt

SEQ ID NO: 12210 - DNA, 20 bp, Artificial Sequence
  sgRNA
gagcgacgggcgggcagtga

SEQ ID NO: 12211 - DNA, 20 bp, Artificial Sequence
  sgRNA
agccgcggagcttcgggacc

SEQ ID NO: 12212 - DNA, 20 bp, Artificial Sequence
  sgRNA
ctcacgcgctgccatatgat

SEQ ID NO: 12213 - DNA, 20 bp, Artificial Sequence
  sgRNA
catcattcgatcctgtccat

SEQ ID NO: 12214 - DNA, 20 bp, Artificial Sequence
  sgRNA
cgtgctgtccaataggcgac

SEQ ID NO: 12215 - DNA, 20 bp, Artificial Sequence
  sgRNA
gcatttagactgctttggcg

SEQ ID NO: 12216 - DNA, 20 bp, Artificial Sequence
  sgRNA
agcaggctttatgttggtat

SEQ ID NO: 12217 - DNA, 20 bp, Artificial Sequence
  sgRNA
aaagggaatcattgtttaga

SEQ ID NO: 12218 - DNA, 20 bp, Artificial Sequence
  sgRNA
gagaaagctaaactcagaaa

SEQ ID NO: 12219 - DNA, 20 bp, Artificial Sequence
  sgRNA
tctttattactggacatgat

SEQ ID NO: 12220 - DNA, 20 bp, Artificial Sequence
  sgRNA
taaactgagtttgaagagtt

SEQ ID NO: 12221 - DNA, 20 bp, Artificial Sequence
  sgRNA
gaggagggtggtgggaggag

SEQ ID NO: 12222 - DNA, 20 bp, Artificial Sequence
  sgRNA
gtcgtcacactgaggcctgg

SEQ ID NO: 12223 - DNA, 20 bp, Artificial Sequence
  sgRNA
gctaatgtttcctgtttgcc

SEQ ID NO: 12224 - DNA, 20 bp, Artificial Sequence
  sgRNA
acaagttattctaactagga

SEQ ID NO: 12225 - DNA, 20 bp, Artificial Sequence
  sgRNA
aggaaacaggagaaatttca

SEQ ID NO: 12226 - DNA, 20 bp, Artificial Sequence
  sgRNA
gggcgggatgaatcaccgcg

SEQ ID NO: 12227 - DNA, 20 bp, Artificial Sequence
  sgRNA
ctccggacgttgctcgcgct

SEQ ID NO: 12228 - DNA, 20 bp, Artificial Sequence
  sgRNA
ccgcccagcctttgccgcag

SEQ ID NO: 12229 - DNA, 20 bp, Artificial Sequence
  sgRNA
cctcgcggccgagagaggtt

SEQ ID NO: 12230 - DNA, 20 bp, Artificial Sequence
  sgRNA
cgcacgcgcggcgtgtcacg

SEQ ID NO: 12231 - DNA, 20 bp, Artificial Sequence
  sgRNA
tgggagtctccagttccttc

SEQ ID NO: 12232 - DNA, 20 bp, Artificial Sequence
  sgRNA
gggccacccgcactagcctc

SEQ ID NO: 12233 - DNA, 20 bp, Artificial Sequence
  sgRNA
gggtagcacaccagggtcag

SEQ ID NO: 12234 - DNA, 20 bp, Artificial Sequence
  sgRNA
cgtcgctctgccggcgctgg

SEQ ID NO: 12235 - DNA, 20 bp, Artificial Sequence
  sgRNA
cggtctccgccttcaatttg

SEQ ID NO: 12236 - DNA, 20 bp, Artificial Sequence
  sgRNA
agggagggcgtgtctcgggc

SEQ ID NO: 12237 - DNA, 20 bp, Artificial Sequence
  sgRNA
ccgtgggcgtgaactcgagg

SEQ ID NO: 12238 - DNA, 20 bp, Artificial Sequence
  sgRNA
tgtttagctcttaaagccct

SEQ ID NO: 12239 - DNA, 20 bp, Artificial Sequence
  sgRNA
ttgacatcttcccacgtaag

SEQ ID NO: 12240 - DNA, 20 bp, Artificial Sequence
  sgRNA
tggccgccgccaacgcgatg

SEQ ID NO: 12241 - DNA, 20 bp, Artificial Sequence
  sgRNA
acatggtggcgctgcaggac

SEQ ID NO: 12242 - DNA, 20 bp, Artificial Sequence
  sgRNA
caatgacctgcatagtcaca

SEQ ID NO: 12243 - DNA, 20 bp, Artificial Sequence
  sgRNA
atgtttctcaacagcagctc

SEQ ID NO: 12244 - DNA, 20 bp, Artificial Sequence
  sgRNA
ggtgcttaaaccaaatcatg

SEQ ID NO: 12245 - DNA, 20 bp, Artificial Sequence
  sgRNA
tttctagacactgacatgtc

SEQ ID NO: 12246 - DNA, 20 bp, Artificial Sequence
  sgRNA
agttgaaaggtacatctgaa

SEQ ID NO: 12247 - DNA, 20 bp, Artificial Sequence
  sgRNA
cgctgtccgagccgagttcg

SEQ ID NO: 12248 - DNA, 20 bp, Artificial Sequence
  sgRNA
gctcccacgggacgcatccg

SEQ ID NO: 12249 - DNA, 20 bp, Artificial Sequence
  sgRNA
ggcccacctgcgtgagtggc

SEQ ID NO: 12250 - DNA, 20 bp, Artificial Sequence
  sgRNA
gagcgaagaatcctcactct

SEQ ID NO: 12251 - DNA, 20 bp, Artificial Sequence
  sgRNA
taatccttagtcaccacatg

SEQ ID NO: 12252 - DNA, 20 bp, Artificial Sequence
  sgRNA
cacaaaccttccttccctag

SEQ ID NO: 12253 - DNA, 20 bp, Artificial Sequence
  sgRNA
cacttgcagagattctctgg

SEQ ID NO: 12254 - DNA, 20 bp, Artificial Sequence
  sgRNA
aaccacacccaactagggag

SEQ ID NO: 12255 - DNA, 20 bp, Artificial Sequence
  sgRNA
tgtaggtgtggtcacaagac

SEQ ID NO: 12256 - DNA, 20 bp, Artificial Sequence
  sgRNA
catcagatagcaccaaccca

SEQ ID NO: 12257 - DNA, 20 bp, Artificial Sequence
  sgRNA
cttgcctttcggacctcatt

SEQ ID NO: 12258 - DNA, 20 bp, Artificial Sequence
  sgRNA
cttcgacggatttagtttcc

SEQ ID NO: 12259 - DNA, 20 bp, Artificial Sequence
  sgRNA
aagccgggaaagggagttcc

SEQ ID NO: 12260 - DNA, 20 bp, Artificial Sequence
  sgRNA
cgagggccggccaggccgta

SEQ ID NO: 12261 - DNA, 20 bp, Artificial Sequence
  sgRNA
tgggtaatgtggtttgccaa

SEQ ID NO: 12262 - DNA, 20 bp, Artificial Sequence
  sgRNA
tccatgctttatagtgccaa

SEQ ID NO: 12263 - DNA, 20 bp, Artificial Sequence
  sgRNA
ggaagtactggagttgcctg

SEQ ID NO: 12264 - DNA, 20 bp, Artificial Sequence
  sgRNA
ccctgccacacaactgcgag

SEQ ID NO: 12265 - DNA, 20 bp, Artificial Sequence
  sgRNA
gcattctagctgtcactagt

SEQ ID NO: 12266 - DNA, 20 bp, Artificial Sequence
  sgRNA
gggtgagtacctagcaaccc

SEQ ID NO: 12267 - DNA, 20 bp, Artificial Sequence
  sgRNA
gaagggttctctgctttatg

SEQ ID NO: 12268 - DNA, 20 bp, Artificial Sequence
  sgRNA
ttgcctggcccggagactcc

SEQ ID NO: 12269 - DNA, 20 bp, Artificial Sequence
  sgRNA
gtaggcattagagtgagccc

SEQ ID NO: 12270 - DNA, 20 bp, Artificial Sequence
  sgRNA
gatgtgctctacagcccagc

SEQ ID NO: 12271 - DNA, 20 bp, Artificial Sequence
  sgRNA
cgggaacgcgcccgtgattc

SEQ ID NO: 12272 - DNA, 20 bp, Artificial Sequence
  sgRNA
ctgaacccgcttcaggaaga

SEQ ID NO: 12273 - DNA, 20 bp, Artificial Sequence
  sgRNA
gaaagaacctgaagagcgga

SEQ ID NO: 12274 - DNA, 20 bp, Artificial Sequence
  sgRNA
aaatgctcaatgtttaactg

SEQ ID NO: 12275 - DNA, 20 bp, Artificial Sequence
  sgRNA
tcctgctaaatttgccgcca

SEQ ID NO: 12276 - DNA, 20 bp, Artificial Sequence
  sgRNA
ttatctaatccctagaaagc

SEQ ID NO: 12277 - DNA, 20 bp, Artificial Sequence
  sgRNA
gctgctgcagggcgcgggcg

SEQ ID NO: 12278 - DNA, 20 bp, Artificial Sequence
  sgRNA
tggaagaatgaagaatcatg

SEQ ID NO: 12279 - DNA, 20 bp, Artificial Sequence
  sgRNA
atctcacgtaataaccactg

SEQ ID NO: 12280 - DNA, 20 bp, Artificial Sequence
  sgRNA
tccagcacgagtcacattac

SEQ ID NO: 12281 - DNA, 20 bp, Artificial Sequence
  sgRNA
ggtgattactcatttggctg

SEQ ID NO: 12282 - DNA, 20 bp, Artificial Sequence
  sgRNA
cggcccacaggcaaactgac

SEQ ID NO: 12283 - DNA, 20 bp, Artificial Sequence
  sgRNA
tgtgcatgacacgccaggtg

SEQ ID NO: 12284 - DNA, 20 bp, Artificial Sequence
  sgRNA
agccctgagagatgctgata

SEQ ID NO: 12285 - DNA, 20 bp, Artificial Sequence
  sgRNA
atcaggatcaacaagaatac

SEQ ID NO: 12286 - DNA, 20 bp, Artificial Sequence
  sgRNA
tccatgggcagtcctattat

SEQ ID NO: 12287 - DNA, 20 bp, Artificial Sequence
  sgRNA
ggaaagcaacttgagagaaa

SEQ ID NO: 12288 - DNA, 20 bp, Artificial Sequence
  sgRNA
acttgcttgtgcgcaggtcc

SEQ ID NO: 12289 - DNA, 20 bp, Artificial Sequence
  sgRNA
cacctgaagcaggattcctc

SEQ ID NO: 12290 - DNA, 20 bp, Artificial Sequence
  sgRNA
ataacttacctggttgtgac

SEQ ID NO: 12291 - DNA, 20 bp, Artificial Sequence
  sgRNA
gttattcacattgctcccac

SEQ ID NO: 12292 - DNA, 20 bp, Artificial Sequence
  sgRNA
tgctcttctcgtggattact

SEQ ID NO: 12293 - DNA, 20 bp, Artificial Sequence
  sgRNA
gacttcaagtttacgcagct

SEQ ID NO: 12294 - DNA, 20 bp, Artificial Sequence
  sgRNA
tgaacaccactacctaacta

SEQ ID NO: 12295 - DNA, 20 bp, Artificial Sequence
  sgRNA
ctcttccttataaatgtgac

SEQ ID NO: 12296 - DNA, 20 bp, Artificial Sequence
  sgRNA
ggaggtaatgcaaatagcca

SEQ ID NO: 12297 - DNA, 20 bp, Artificial Sequence
  sgRNA
tgttgatatgtctcatgcat

SEQ ID NO: 12298 - DNA, 20 bp, Artificial Sequence
  sgRNA
agtcctgcgaagagtttgtc

SEQ ID NO: 12299 - DNA, 20 bp, Artificial Sequence
  sgRNA
agcattcaccaggatattgt

SEQ ID NO: 12300 - DNA, 20 bp, Artificial Sequence
  sgRNA
gaaccttcgctgttcgtcct

SEQ ID NO: 12301 - DNA, 20 bp, Artificial Sequence
  sgRNA
tcgcccgccattagggagcg

SEQ ID NO: 12302 - DNA, 20 bp, Artificial Sequence
  sgRNA
ggccgtgcccttacgagtgc

SEQ ID NO: 12303 - DNA, 20 bp, Artificial Sequence
  sgRNA
ggttggtctaatcgtaatga

SEQ ID NO: 12304 - DNA, 20 bp, Artificial Sequence
  sgRNA
gcgagcctggagctaggcgc

SEQ ID NO: 12305 - DNA, 20 bp, Artificial Sequence
  sgRNA
atcaagcgctacagtccgag

SEQ ID NO: 12306 - DNA, 20 bp, Artificial Sequence
  sgRNA
tttggaccggccaatggcac

SEQ ID NO: 12307 - DNA, 20 bp, Artificial Sequence
  sgRNA
cccaaggatagcgctctaat

SEQ ID NO: 12308 - DNA, 20 bp, Artificial Sequence
  sgRNA
gcgggcgggtgcgtcaagtt

SEQ ID NO: 12309 - DNA, 20 bp, Artificial Sequence
  sgRNA
ttggaccgtcgccgcgtctc

SEQ ID NO: 12310 - DNA, 20 bp, Artificial Sequence
  sgRNA
ggtgaccatcacagccaatc

SEQ ID NO: 12311 - DNA, 20 bp, Artificial Sequence
  sgRNA
gacgctaaacggcttctagc

SEQ ID NO: 12312 - DNA, 20 bp, Artificial Sequence
  sgRNA
aagggcggttagggttgggc

SEQ ID NO: 12313 - DNA, 20 bp, Artificial Sequence
  sgRNA
tcagatggcgttgtgaactc

SEQ ID NO: 12314 - DNA, 20 bp, Artificial Sequence
  sgRNA
atgattcagcagctgcccaa

SEQ ID NO: 12315 - DNA, 20 bp, Artificial Sequence
  sgRNA
gaatgggtcaaattgatctg

SEQ ID NO: 12316 - DNA, 20 bp, Artificial Sequence
  sgRNA
aaggcacgatccattctgtg

SEQ ID NO: 12317 - DNA, 20 bp, Artificial Sequence
  sgRNA
ggcggttcaggtgctgccac

SEQ ID NO: 12318 - DNA, 20 bp, Artificial Sequence
  sgRNA
ttgtggcaccagacgcgtcg

SEQ ID NO: 12319 - DNA, 20 bp, Artificial Sequence
  sgRNA
tgcttacccagtcatcatgc

SEQ ID NO: 12320 - DNA, 20 bp, Artificial Sequence
  sgRNA
tttgcagctactggcgggaa

SEQ ID NO: 12321 - DNA, 20 bp, Artificial Sequence
  sgRNA
agcaggaacggctcagaaac

SEQ ID NO: 12322 - DNA, 20 bp, Artificial Sequence
  sgRNA
aggaatgggaaatgggatct

SEQ ID NO: 12323 - DNA, 20 bp, Artificial Sequence
  sgRNA
caaatctactctttcaatct

SEQ ID NO: 12324 - DNA, 20 bp, Artificial Sequence
  sgRNA
tggtttatggaatatctgat

SEQ ID NO: 12325 - DNA, 20 bp, Artificial Sequence
  sgRNA
tcagtcccggaggcctccct

SEQ ID NO: 12326 - DNA, 20 bp, Artificial Sequence
  sgRNA
gatactggcgggtgactcag

SEQ ID NO: 12327 - DNA, 20 bp, Artificial Sequence
  sgRNA
gggccaacaaaggcgttcag

SEQ ID NO: 12328 - DNA, 20 bp, Artificial Sequence
  sgRNA
ggaagcgcgcagcaggacag

SEQ ID NO: 12329 - DNA, 20 bp, Artificial Sequence
  sgRNA
aagtgtagtccactcgcgtg

SEQ ID NO: 12330 - DNA, 20 bp, Artificial Sequence
  sgRNA
gcagtgggacaaaggtccct

SEQ ID NO: 12331 - DNA, 20 bp, Artificial Sequence
  sgRNA
atcagatgcaactttggatc

SEQ ID NO: 12332 - DNA, 20 bp, Artificial Sequence
  sgRNA
ttccttgccctttgcaaact

SEQ ID NO: 12333 - DNA, 20 bp, Artificial Sequence
  sgRNA
tgttcaagagaactgccaac

SEQ ID NO: 12334 - DNA, 20 bp, Artificial Sequence
  sgRNA
ggagtcgaagttgcaagcgg

SEQ ID NO: 12335 - DNA, 20 bp, Artificial Sequence
  sgRNA
tgaccaagcctcctctacga

SEQ ID NO: 12336 - DNA, 20 bp, Artificial Sequence
  sgRNA
gcattgggattctcgtggtc

SEQ ID NO: 12337 - DNA, 20 bp, Artificial Sequence
  sgRNA
ttgtgccaggagtctcgcgg

SEQ ID NO: 12338 - DNA, 20 bp, Artificial Sequence
  sgRNA
gtctaagatatagagctgtg

SEQ ID NO: 12339 - DNA, 20 bp, Artificial Sequence
  sgRNA
gatagtcgccataacaagta

SEQ ID NO: 12340 - DNA, 20 bp, Artificial Sequence
  sgRNA
gcgtgccgggccgtaaagcg

SEQ ID NO: 12341 - DNA, 20 bp, Artificial Sequence
  sgRNA
gagcagctgctttagaactt

SEQ ID NO: 12342 - DNA, 20 bp, Artificial Sequence
  sgRNA
gatcagaggccagacccgcg

SEQ ID NO: 12343 - DNA, 20 bp, Artificial Sequence
  sgRNA
ctctctcatccacgcaccgc

SEQ ID NO: 12344 - DNA, 20 bp, Artificial Sequence
  sgRNA
ggatacaggtgaatccaatt

SEQ ID NO: 12345 - DNA, 20 bp, Artificial Sequence
  sgRNA
gtgtcttatatgaggaagtc

SEQ ID NO: 12346 - DNA, 20 bp, Artificial Sequence
  sgRNA
tgcccgcgccagcctgccat

SEQ ID NO: 12347 - DNA, 20 bp, Artificial Sequence
  sgRNA
cgccaacggacgctgctgcc

SEQ ID NO: 12348 - DNA, 20 bp, Artificial Sequence
  sgRNA
tccgaggagaagcgcagacc

SEQ ID NO: 12349 - DNA, 20 bp, Artificial Sequence
  sgRNA
aaatggttgaacatagagcc

SEQ ID NO: 12350 - DNA, 20 bp, Artificial Sequence
  sgRNA
gaccgtggctgcgcctcaag

SEQ ID NO: 12351 - DNA, 20 bp, Artificial Sequence
  sgRNA
gacaggcagtctcaagatcc

SEQ ID NO: 12352 - DNA, 20 bp, Artificial Sequence
  sgRNA
gtgttccgggataggcatcc

SEQ ID NO: 12353 - DNA, 20 bp, Artificial Sequence
  sgRNA
gttaacccgaagttaactgg

SEQ ID NO: 12354 - DNA, 20 bp, Artificial Sequence
  sgRNA
ctgggcaagtatctttagcc

SEQ ID NO: 12355 - DNA, 20 bp, Artificial Sequence
  sgRNA
cggctcagaaactgggtgtg

SEQ ID NO: 12356 - DNA, 20 bp, Artificial Sequence
  sgRNA
atatatagagagtcacgttt

SEQ ID NO: 12357 - DNA, 20 bp, Artificial Sequence
  sgRNA
ctgggcgcccagcagcgacc

SEQ ID NO: 12358 - DNA, 20 bp, Artificial Sequence
  sgRNA
cagaataatcctgaaccgtc

SEQ ID NO: 12359 - DNA, 20 bp, Artificial Sequence
  sgRNA
aagatcactcacaagtccac

SEQ ID NO: 12360 - DNA, 20 bp, Artificial Sequence
  sgRNA
caaagtaggaaagtcagctt

SEQ ID NO: 12361 - DNA, 20 bp, Artificial Sequence
  sgRNA
gtaaagggagctatggcaaa

SEQ ID NO: 12362 - DNA, 20 bp, Artificial Sequence
  sgRNA
taggtagacaattgatccta

SEQ ID NO: 12363 - DNA, 20 bp, Artificial Sequence
  sgRNA
tagtgtgtcatgtggcaact

SEQ ID NO: 12364 - DNA, 20 bp, Artificial Sequence
  sgRNA
aagtcatgcagcgcgtcaac

SEQ ID NO: 12365 - DNA, 20 bp, Artificial Sequence
  sgRNA
gggcagatccggaaagcgcc

SEQ ID NO: 12366 - DNA, 20 bp, Artificial Sequence
  sgRNA
aattggcttataaaggaggc

SEQ ID NO: 12367 - DNA, 20 bp, Artificial Sequence
  sgRNA
gattggctgaaggacttaga

SEQ ID NO: 12368 - DNA, 20 bp, Artificial Sequence
  sgRNA
tgatcagctcaatctttctc

SEQ ID NO: 12369 - DNA, 20 bp, Artificial Sequence
  sgRNA
ccttctgcgtttgtccgtcc

SEQ ID NO: 12370 - DNA, 20 bp, Artificial Sequence
  sgRNA
tgtgcccagagttattctag

SEQ ID NO: 12371 - DNA, 20 bp, Artificial Sequence
  sgRNA
agatgttgggcccgccctct

SEQ ID NO: 12372 - DNA, 20 bp, Artificial Sequence
  sgRNA
gtatcacgtcatttccggcg

SEQ ID NO: 12373 - DNA, 20 bp, Artificial Sequence
  sgRNA
acctctcccgggcgaggtgc

SEQ ID NO: 12374 - DNA, 20 bp, Artificial Sequence
  sgRNA
gctttccgcgcgcggccagg

SEQ ID NO: 12375 - DNA, 20 bp, Artificial Sequence
  sgRNA
gccggtctttatatagcagc

SEQ ID NO: 12376 - DNA, 20 bp, Artificial Sequence
  sgRNA
tgacagcagcaactcaagtc

SEQ ID NO: 12377 - DNA, 20 bp, Artificial Sequence
  sgRNA
cggctctctgtttcgctccc

SEQ ID NO: 12378 - DNA, 20 bp, Artificial Sequence
  sgRNA
gaattggcccgccgcggccc

SEQ ID NO: 12379 - DNA, 20 bp, Artificial Sequence
  sgRNA
gcataaactgttccctctta

SEQ ID NO: 12380 - DNA, 20 bp, Artificial Sequence
  sgRNA
gtgagaaatcagcgctcgga

SEQ ID NO: 12381 - DNA, 20 bp, Artificial Sequence
  sgRNA
agggcggtgcaaacactagt

SEQ ID NO: 12382 - DNA, 20 bp, Artificial Sequence
  sgRNA
gctctgggcgtaccgccaga

SEQ ID NO: 12383 - DNA, 20 bp, Artificial Sequence
  sgRNA
tcgacgcggcggtggtgtcc

SEQ ID NO: 12384 - DNA, 20 bp, Artificial Sequence
  sgRNA
caccctgctacccgaggttg

SEQ ID NO: 12385 - DNA, 20 bp, Artificial Sequence
  sgRNA
gccttgttagagatagagta

SEQ ID NO: 12386 - DNA, 20 bp, Artificial Sequence
  sgRNA
tgaactttaagcctaactcc

SEQ ID NO: 12387 - DNA, 20 bp, Artificial Sequence
  sgRNA
gatctgataaggtagtggaa

SEQ ID NO: 12388 - DNA, 20 bp, Artificial Sequence
  sgRNA
gaagcggaagactcggcgag

SEQ ID NO: 12389 - DNA, 20 bp, Artificial Sequence
  sgRNA
gtgtctcatctataactgtc

SEQ ID NO: 12390 - DNA, 20 bp, Artificial Sequence
  sgRNA
ccggaagacgggccagcgtc

SEQ ID NO: 12391 - DNA, 20 bp, Artificial Sequence
  sgRNA
ccgtcacgagcacaggaagg

SEQ ID NO: 12392 - DNA, 20 bp, Artificial Sequence
  sgRNA
ataaactcggcggcgcgggt

SEQ ID NO: 12393 - DNA, 20 bp, Artificial Sequence
  sgRNA
tggctgggtacgagctttgg

SEQ ID NO: 12394 - DNA, 20 bp, Artificial Sequence
  sgRNA
atttgactagtctcacttgt

SEQ ID NO: 12395 - DNA, 20 bp, Artificial Sequence
  sgRNA
actcttagttgctaaccagc

SEQ ID NO: 12396 - DNA, 20 bp, Artificial Sequence
  sgRNA
tattaagtgtcccgttaaat

SEQ ID NO: 12397 - DNA, 20 bp, Artificial Sequence
  sgRNA
tttagtcatgaggcctgaag

SEQ ID NO: 12398 - DNA, 20 bp, Artificial Sequence
  sgRNA
aaggttctgggcctctgagc

SEQ ID NO: 12399 - DNA, 20 bp, Artificial Sequence
  sgRNA
gaatggtggttagggcgggc

SEQ ID NO: 12400 - DNA, 20 bp, Artificial Sequence
  sgRNA
caatggcagcgcaggcgcgc

SEQ ID NO: 12401 - DNA, 20 bp, Artificial Sequence
  sgRNA
gggatcgggtggcccgctcc

SEQ ID NO: 12402 - DNA, 20 bp, Artificial Sequence
  sgRNA
ggccgcgcgggcgtcaggta

SEQ ID NO: 12403 - DNA, 20 bp, Artificial Sequence
  sgRNA
ttcccagcagccaacagcag

SEQ ID NO: 12404 - DNA, 20 bp, Artificial Sequence
  sgRNA
ggacattgccttcccttccc

SEQ ID NO: 12405 - DNA, 20 bp, Artificial Sequence
  sgRNA
agctaaccatggaggagact

SEQ ID NO: 12406 - DNA, 20 bp, Artificial Sequence
  sgRNA
ttcggttggcattcggctaa

SEQ ID NO: 12407 - DNA, 20 bp, Artificial Sequence
  sgRNA
tcatctgggagatgagcctc

SEQ ID NO: 12408 - DNA, 20 bp, Artificial Sequence
  sgRNA
agctggccgtgcagagagga

SEQ ID NO: 12409 - DNA, 20 bp, Artificial Sequence
  sgRNA
ggactttaggcgctcgaggc

SEQ ID NO: 12410 - DNA, 20 bp, Artificial Sequence
  sgRNA
cctcaggtaacccgggaaac

SEQ ID NO: 12411 - DNA, 20 bp, Artificial Sequence
  sgRNA
agattctccacgcatcacgt

SEQ ID NO: 12412 - DNA, 20 bp, Artificial Sequence
  sgRNA
gcttgaaatgaagtgcagtt

SEQ ID NO: 12413 - DNA, 20 bp, Artificial Sequence
  sgRNA
ctgttgttacttccatatct

SEQ ID NO: 12414 - DNA, 20 bp, Artificial Sequence
  sgRNA
ttgtggccaatgatgaataa

SEQ ID NO: 12415 - DNA, 20 bp, Artificial Sequence
  sgRNA
atctctgaacgtcccgttat

SEQ ID NO: 12416 - DNA, 20 bp, Artificial Sequence
  sgRNA
tggcttgagacccgagtcta

SEQ ID NO: 12417 - DNA, 20 bp, Artificial Sequence
  sgRNA
gaatagaacaaactaatcgg

SEQ ID NO: 12418 - DNA, 20 bp, Artificial Sequence
  sgRNA
aacgcgctcgggagccgtta

SEQ ID NO: 12419 - DNA, 20 bp, Artificial Sequence
  sgRNA
ggtgggacccttcgtaggag

SEQ ID NO: 12420 - DNA, 20 bp, Artificial Sequence
  sgRNA
cgcctagtcgtttcccgtgg

SEQ ID NO: 12421 - DNA, 20 bp, Artificial Sequence
  sgRNA
gtcccggaagcactaccagt

SEQ ID NO: 12422 - DNA, 20 bp, Artificial Sequence
  sgRNA
gttgttgttgtgtcagccgt

SEQ ID NO: 12423 - DNA, 20 bp, Artificial Sequence
  sgRNA
aaggacgcatcagagccgcc

SEQ ID NO: 12424 - DNA, 20 bp, Artificial Sequence
  sgRNA
ttggactccctttgcgttgg

SEQ ID NO: 12425 - DNA, 20 bp, Artificial Sequence
  sgRNA
tgttagctcccagagggcag

SEQ ID NO: 12426 - DNA, 20 bp, Artificial Sequence
  sgRNA
agctgctctagacaggagct

SEQ ID NO: 12427 - DNA, 20 bp, Artificial Sequence
  sgRNA
aaccgaacccagggtcgagg

SEQ ID NO: 12428 - DNA, 20 bp, Artificial Sequence
  sgRNA
cagggcgcgcgtgtgagtcc

SEQ ID NO: 12429 - DNA, 20 bp, Artificial Sequence
  sgRNA
agactgcgggtcctgccctt

SEQ ID NO: 12430 - DNA, 20 bp, Artificial Sequence
  sgRNA
taagtgcgacgcacgccgct

SEQ ID NO: 12431 - DNA, 20 bp, Artificial Sequence
  sgRNA
cggcttgcaaactgctaacc

SEQ ID NO: 12432 - DNA, 20 bp, Artificial Sequence
  sgRNA
cctgctgggctggatgaatg

SEQ ID NO: 12433 - DNA, 20 bp, Artificial Sequence
  sgRNA
gatgtgtttcgccctgccaa

SEQ ID NO: 12434 - DNA, 20 bp, Artificial Sequence
  sgRNA
tattccattcatttgcaagg

SEQ ID NO: 12435 - DNA, 20 bp, Artificial Sequence
  sgRNA
tctagctgctcgggtctcac

SEQ ID NO: 12436 - DNA, 20 bp, Artificial Sequence
  sgRNA
cctggaaatggctagcttgt

SEQ ID NO: 12437 - DNA, 20 bp, Artificial Sequence
  sgRNA
tgcagtatggtgtgtgtgtt

SEQ ID NO: 12438 - DNA, 20 bp, Artificial Sequence
  sgRNA
gactgtgatgacaagcagtg

SEQ ID NO: 12439 - DNA, 20 bp, Artificial Sequence
  sgRNA
tagaggtgtttgtagactgg

SEQ ID NO: 12440 - DNA, 20 bp, Artificial Sequence
  sgRNA
gggaaactgccaaccttctt

SEQ ID NO: 12441 - DNA, 20 bp, Artificial Sequence
  sgRNA
ccggtgcgtggctccatctg

SEQ ID NO: 12442 - DNA, 20 bp, Artificial Sequence
  sgRNA
agcctggcccagaggtcgca

SEQ ID NO: 12443 - DNA, 20 bp, Artificial Sequence
  sgRNA
gggaggcaccggcgcactgg

SEQ ID NO: 12444 - DNA, 20 bp, Artificial Sequence
  sgRNA
atcttgttggaggcgggaag

SEQ ID NO: 12445 - DNA, 20 bp, Artificial Sequence
  sgRNA
cgcagtccaatccctcattc

SEQ ID NO: 12446 - DNA, 20 bp, Artificial Sequence
  sgRNA
gagtgtggctgccggaaacc

SEQ ID NO: 12447 - DNA, 20 bp, Artificial Sequence
  sgRNA
cttctttcgctttcatttcc

SEQ ID NO: 12448 - DNA, 20 bp, Artificial Sequence
  sgRNA
attccaatcctgggatagcg

SEQ ID NO: 12449 - DNA, 20 bp, Artificial Sequence
  sgRNA
gaagatagaaactaaggacg

SEQ ID NO: 12450 - DNA, 20 bp, Artificial Sequence
  sgRNA
gaggacagtagctctcgtct

SEQ ID NO: 12451 - DNA, 20 bp, Artificial Sequence
  sgRNA
agaccaagtgctcgcactac

SEQ ID NO: 12452 - DNA, 20 bp, Artificial Sequence
  sgRNA
aagcatttccagagttcttg

SEQ ID NO: 12453 - DNA, 20 bp, Artificial Sequence
  sgRNA
aaccttctctgccttagtca

SEQ ID NO: 12454 - DNA, 20 bp, Artificial Sequence
  sgRNA
gggcagcacgagatgcgcgc

SEQ ID NO: 12455 - DNA, 20 bp, Artificial Sequence
  sgRNA
tttgcggtgtgcggcgctgg

SEQ ID NO: 12456 - DNA, 20 bp, Artificial Sequence
  sgRNA
ctgagtcacctcggtaaagt

SEQ ID NO: 12457 - DNA, 20 bp, Artificial Sequence
  sgRNA
ggcgtggacgctatcacagt

SEQ ID NO: 12458 - DNA, 20 bp, Artificial Sequence
  sgRNA
ggaagtgtacaatgctaacc

SEQ ID NO: 12459 - DNA, 20 bp, Artificial Sequence
  sgRNA
ggcggctccgcttgcaggcg

SEQ ID NO: 12460 - DNA, 20 bp, Artificial Sequence
  sgRNA
ggaacagggctgcggagctg

SEQ ID NO: 12461 - DNA, 20 bp, Artificial Sequence
  sgRNA
tcggcagccgacggcgaccc

SEQ ID NO: 12462 - DNA, 20 bp, Artificial Sequence
  sgRNA
aggtttaggttctcctgctg

SEQ ID NO: 12463 - DNA, 20 bp, Artificial Sequence
  sgRNA
ataccacccgctcgccatcg

SEQ ID NO: 12464 - DNA, 20 bp, Artificial Sequence
  sgRNA
cgtcacccatctcaagacct

SEQ ID NO: 12465 - DNA, 20 bp, Artificial Sequence
  sgRNA
tgcgccttctggaggtgggc

SEQ ID NO: 12466 - DNA, 20 bp, Artificial Sequence
  sgRNA
aggtcgggcggtaagggctg

SEQ ID NO: 12467 - DNA, 20 bp, Artificial Sequence
  sgRNA
cgtggccgggtgcctgtcca

SEQ ID NO: 12468 - DNA, 20 bp, Artificial Sequence
  sgRNA
gctagaaggcgggtgcgcag

SEQ ID NO: 12469 - DNA, 20 bp, Artificial Sequence
  sgRNA
tttaagtggttggccgacca

SEQ ID NO: 12470 - DNA, 20 bp, Artificial Sequence
  sgRNA
tcttgaaatgggtacccact

SEQ ID NO: 12471 - DNA, 20 bp, Artificial Sequence
  sgRNA
gtgcagatgggaaggttacg

SEQ ID NO: 12472 - DNA, 20 bp, Artificial Sequence
  sgRNA
tgagttctatccactccctc

SEQ ID NO: 12473 - DNA, 20 bp, Artificial Sequence
  sgRNA
ggctatgagatgggacatgg

SEQ ID NO: 12474 - DNA, 20 bp, Artificial Sequence
  sgRNA
cagctcagtctaaggactgc

SEQ ID NO: 12475 - DNA, 20 bp, Artificial Sequence
  sgRNA
tagtagtgacgctttgacta

SEQ ID NO: 12476 - DNA, 20 bp, Artificial Sequence
  sgRNA
cgttaagactccgttatatc

SEQ ID NO: 12477 - DNA, 20 bp, Artificial Sequence
  sgRNA
agtgaaggtagcggcggcta

SEQ ID NO: 12478 - DNA, 20 bp, Artificial Sequence
  sgRNA
aaggccgtttgcgacgcgaa

SEQ ID NO: 12479 - DNA, 20 bp, Artificial Sequence
  sgRNA
gattgagtgaggagtcgagg

SEQ ID NO: 12480 - DNA, 20 bp, Artificial Sequence
  sgRNA
tctcaggtgagtcatgccaa

SEQ ID NO: 12481 - DNA, 20 bp, Artificial Sequence
  sgRNA
actgtggtgggtggagtgct

SEQ ID NO: 12482 - DNA, 20 bp, Artificial Sequence
  sgRNA
ctgagtcggtttaacacacg

SEQ ID NO: 12483 - DNA, 20 bp, Artificial Sequence
  sgRNA
gaatcaggaagtgatagccg

SEQ ID NO: 12484 - DNA, 20 bp, Artificial Sequence
  sgRNA
gctttaggatgtcccgccca

SEQ ID NO: 12485 - DNA, 20 bp, Artificial Sequence
  sgRNA
aaggcctagtcgccaggccc

SEQ ID NO: 12486 - DNA, 20 bp, Artificial Sequence
  sgRNA
aaccatggcaatgaccactg

SEQ ID NO: 12487 - DNA, 20 bp, Artificial Sequence
  sgRNA
tgacaggtgtgtcatgagtg

SEQ ID NO: 12488 - DNA, 20 bp, Artificial Sequence
  sgRNA
cactgattaaccagccctgt

SEQ ID NO: 12489 - DNA, 20 bp, Artificial Sequence
  sgRNA
cactggagctgaggcccacg

SEQ ID NO: 12490 - DNA, 20 bp, Artificial Sequence
  sgRNA
aatcgtgttgcagtctgtgt

SEQ ID NO: 12491 - DNA, 20 bp, Artificial Sequence
  sgRNA
ttcctcttcctgcgaaagag

SEQ ID NO: 12492 - DNA, 20 bp, Artificial Sequence
  sgRNA
tgagggagggcctgcgagtg

SEQ ID NO: 12493 - DNA, 20 bp, Artificial Sequence
  sgRNA
ctgactcctgtctccggaat

SEQ ID NO: 12494 - DNA, 20 bp, Artificial Sequence
  sgRNA
agttacaaactgtggcgcat

SEQ ID NO: 12495 - DNA, 20 bp, Artificial Sequence
  sgRNA
gtaggtactgtgctctgcca

SEQ ID NO: 12496 - DNA, 20 bp, Artificial Sequence
  sgRNA
atgctcgcacagtgtcctca

SEQ ID NO: 12497 - DNA, 20 bp, Artificial Sequence
  sgRNA
gcacacgtgcagagaacata

SEQ ID NO: 12498 - DNA, 20 bp, Artificial Sequence
  sgRNA
agaaccacgcggacgctgtg

SEQ ID NO: 12499 - DNA, 20 bp, Artificial Sequence
  sgRNA
gagacaggttctggaccgga

SEQ ID NO: 12500 - DNA, 20 bp, Artificial Sequence
  sgRNA
acgaagggcagttccttcac

SEQ ID NO: 12501 - DNA, 20 bp, Artificial Sequence
  sgRNA
atagagactaagtaaccctt

SEQ ID NO: 12502 - DNA, 20 bp, Artificial Sequence
  sgRNA
aggcagctgatcagtaggca

SEQ ID NO: 12503 - DNA, 20 bp, Artificial Sequence
  sgRNA
ggcaagcaaagtgagggact

SEQ ID NO: 12504 - DNA, 20 bp, Artificial Sequence
  sgRNA
tttatgactcagcatgacat

SEQ ID NO: 12505 - DNA, 20 bp, Artificial Sequence
  sgRNA
ctagcataggacctccagag

SEQ ID NO: 12506 - DNA, 20 bp, Artificial Sequence
  sgRNA
gaatttcaccagctccagag

SEQ ID NO: 12507 - DNA, 20 bp, Artificial Sequence
  sgRNA
ctccaagatggacggccgcg

SEQ ID NO: 12508 - DNA, 20 bp, Artificial Sequence
  sgRNA
gcgggctgggtgttacagcg

SEQ ID NO: 12509 - DNA, 20 bp, Artificial Sequence
  sgRNA
cgggcaatagaagctacgcg

SEQ ID NO: 12510 - DNA, 20 bp, Artificial Sequence
  sgRNA
tgtccgtgctccacctacct

SEQ ID NO: 12511 - DNA, 20 bp, Artificial Sequence
  sgRNA
gggccgggcagacgccttaa

SEQ ID NO: 12512 - DNA, 20 bp, Artificial Sequence
  sgRNA
gaaacagatacgacctggcc

SEQ ID NO: 12513 - DNA, 20 bp, Artificial Sequence
  sgRNA
gggacgggagggccgcggcg

SEQ ID NO: 12514 - DNA, 20 bp, Artificial Sequence
  sgRNA
cgcggcctcggcggcctcgg

SEQ ID NO: 12515 - DNA, 20 bp, Artificial Sequence
  sgRNA
cagaagggccactcggccag

SEQ ID NO: 12516 - DNA, 20 bp, Artificial Sequence
  sgRNA
caaatctcggttggcgccgg

SEQ ID NO: 12517 - DNA, 20 bp, Artificial Sequence
  sgRNA
ttctcgcgggaactcgggag

SEQ ID NO: 12518 - DNA, 20 bp, Artificial Sequence
  sgRNA
gcgggacttggagcccaagg

SEQ ID NO: 12519 - DNA, 20 bp, Artificial Sequence
  sgRNA
cctattgaaggtgcaaacct

SEQ ID NO: 12520 - DNA, 20 bp, Artificial Sequence
  sgRNA
gaggctgaagggtcagaccc

SEQ ID NO: 12521 - DNA, 20 bp, Artificial Sequence
  sgRNA
cgtcacgtgggatgccgcgc

SEQ ID NO: 12522 - DNA, 20 bp, Artificial Sequence
  sgRNA
taattcataccgccgctgag

SEQ ID NO: 12523 - DNA, 20 bp, Artificial Sequence
  sgRNA
agctgaacgtcgccctctgc

SEQ ID NO: 12524 - DNA, 20 bp, Artificial Sequence
  sgRNA
ctaattgttgccgatttcca

SEQ ID NO: 12525 - DNA, 20 bp, Artificial Sequence
  sgRNA
aggcatgtctccaccaaata

SEQ ID NO: 12526 - DNA, 20 bp, Artificial Sequence
  sgRNA
cgcagctctcatgatggtcg

SEQ ID NO: 12527 - DNA, 20 bp, Artificial Sequence
  sgRNA
gcaggccatgtcaactcacc

SEQ ID NO: 12528 - DNA, 20 bp, Artificial Sequence
  sgRNA
cttagattacataactgagc

SEQ ID NO: 12529 - DNA, 20 bp, Artificial Sequence
  sgRNA
cccagtactcagattacaag

SEQ ID NO: 12530 - DNA, 20 bp, Artificial Sequence
  sgRNA
cttccttccaaagagctctc

SEQ ID NO: 12531 - DNA, 20 bp, Artificial Sequence
  sgRNA
cccggaatcaggcctccagc

SEQ ID NO: 12532 - DNA, 20 bp, Artificial Sequence
  sgRNA
ggtagaatccctttcagaag

SEQ ID NO: 12533 - DNA, 20 bp, Artificial Sequence
  sgRNA
tctgtggctgttgttacctc

SEQ ID NO: 12534 - DNA, 20 bp, Artificial Sequence
  sgRNA
gtgagatacctacttatgcc

SEQ ID NO: 12535 - DNA, 20 bp, Artificial Sequence
  sgRNA
gagccgtgccacgttcaccc

SEQ ID NO: 12536 - DNA, 20 bp, Artificial Sequence
  sgRNA
gtgactcagccacatgaccg

SEQ ID NO: 12537 - DNA, 20 bp, Artificial Sequence
  sgRNA
cttacagaatggataggaca

SEQ ID NO: 12538 - DNA, 20 bp, Artificial Sequence
  sgRNA
aagatgtgaaagagggtaac

SEQ ID NO: 12539 - DNA, 20 bp, Artificial Sequence
  sgRNA
ttctttatccttcgctgctg

SEQ ID NO: 12540 - DNA, 20 bp, Artificial Sequence
  sgRNA
cagaggaatacggtaacagc

SEQ ID NO: 12541 - DNA, 20 bp, Artificial Sequence
  sgRNA
tatcaagcgtggagggatga

SEQ ID NO: 12542 - DNA, 20 bp, Artificial Sequence
  sgRNA
atgggacagagaaacaggaa

SEQ ID NO: 12543 - DNA, 20 bp, Artificial Sequence
  sgRNA
cagcgtacagtagcgcgcgg

SEQ ID NO: 12544 - DNA, 20 bp, Artificial Sequence
  sgRNA
ggagaccgacggccaatcac

SEQ ID NO: 12545 - DNA, 20 bp, Artificial Sequence
  sgRNA
ttgagcagagcttagcagag

SEQ ID NO: 12546 - DNA, 20 bp, Artificial Sequence
  sgRNA
gcttggcggccaatggagca

SEQ ID NO: 12547 - DNA, 20 bp, Artificial Sequence
  sgRNA
ctgagcgcaacgagtgcctt

SEQ ID NO: 12548 - DNA, 20 bp, Artificial Sequence
  sgRNA
ggagtcaaagcgggttccag

SEQ ID NO: 12549 - DNA, 20 bp, Artificial Sequence
  sgRNA
ctgagtcaccaatagttata

SEQ ID NO: 12550 - DNA, 20 bp, Artificial Sequence
  sgRNA
gtgagatagggagaggcaaa

SEQ ID NO: 12551 - DNA, 20 bp, Artificial Sequence
  sgRNA
aggacttcacatcagaagcc

SEQ ID NO: 12552 - DNA, 20 bp, Artificial Sequence
  sgRNA
gaacttgatagactgaacta

SEQ ID NO: 12553 - DNA, 20 bp, Artificial Sequence
  sgRNA
gctgaatctttgtactatac

SEQ ID NO: 12554 - DNA, 20 bp, Artificial Sequence
  sgRNA
atcatcagattgctaaggaa

SEQ ID NO: 12555 - DNA, 20 bp, Artificial Sequence
  sgRNA
atgcgtagcattagctcccg

SEQ ID NO: 12556 - DNA, 20 bp, Artificial Sequence
  sgRNA
atgtgggcgtgccctttgtg

SEQ ID NO: 12557 - DNA, 20 bp, Artificial Sequence
  sgRNA
caagaggcgtgatcttgtgg

SEQ ID NO: 12558 - DNA, 20 bp, Artificial Sequence
  sgRNA
ggtgtggcctgaccaaactg

SEQ ID NO: 12559 - DNA, 20 bp, Artificial Sequence
  sgRNA
gcccaacgttggccagagag

SEQ ID NO: 12560 - DNA, 20 bp, Artificial Sequence
  sgRNA
acctttggtggcggtgggcg

SEQ ID NO: 12561 - DNA, 20 bp, Artificial Sequence
  sgRNA
ggcccacgccttgcacccag

SEQ ID NO: 12562 - DNA, 20 bp, Artificial Sequence
  sgRNA
agtcttaaagcgcacctcgg

SEQ ID NO: 12563 - DNA, 20 bp, Artificial Sequence
  sgRNA
tgcggtcgggattccgacgt

SEQ ID NO: 12564 - DNA, 20 bp, Artificial Sequence
  sgRNA
gggctccgagctgtcagtca

SEQ ID NO: 12565 - DNA, 20 bp, Artificial Sequence
  sgRNA
catggagtacatacagcctt

SEQ ID NO: 12566 - DNA, 20 bp, Artificial Sequence
  sgRNA
gaagctgaatggccctttcc

SEQ ID NO: 12567 - DNA, 20 bp, Artificial Sequence
  sgRNA
cgctgctgcccacagccgct

SEQ ID NO: 12568 - DNA, 20 bp, Artificial Sequence
  sgRNA
gcccgcggcgaggtgagaag

SEQ ID NO: 12569 - DNA, 20 bp, Artificial Sequence
  sgRNA
acagcacggcgcgcctcctc

SEQ ID NO: 12570 - DNA, 20 bp, Artificial Sequence
  sgRNA
cgcctactgttggtcttcac

SEQ ID NO: 12571 - DNA, 20 bp, Artificial Sequence
  sgRNA
ctaagataagtatttactcc

SEQ ID NO: 12572 - DNA, 20 bp, Artificial Sequence
  sgRNA
tttccgtaattccttgtact

SEQ ID NO: 12573 - DNA, 20 bp, Artificial Sequence
  sgRNA
gaatgaaccaagtgtccgcc

SEQ ID NO: 12574 - DNA, 20 bp, Artificial Sequence
  sgRNA
tcgcccgccgccgaggagaa

SEQ ID NO: 12575 - DNA, 20 bp, Artificial Sequence
  sgRNA
gctcagggctcccgcgtacc

SEQ ID NO: 12576 - DNA, 20 bp, Artificial Sequence
  sgRNA
gctttcgaccagtcctcacc

SEQ ID NO: 12577 - DNA, 20 bp, Artificial Sequence
  sgRNA
aggcggctcaccgagaagcc

SEQ ID NO: 12578 - DNA, 20 bp, Artificial Sequence
  sgRNA
ggaggctagctgggcgggac

SEQ ID NO: 12579 - DNA, 20 bp, Artificial Sequence
  sgRNA
gaagcgttatcatgtgaggc

SEQ ID NO: 12580 - DNA, 20 bp, Artificial Sequence
  sgRNA
ggtcgtagggcgtggcgaag

SEQ ID NO: 12581 - DNA, 20 bp, Artificial Sequence
  sgRNA
gtccgtacggcgaagtgatg

SEQ ID NO: 12582 - DNA, 20 bp, Artificial Sequence
  sgRNA
ggctgcctgccttctcggcg

SEQ ID NO: 12583 - DNA, 20 bp, Artificial Sequence
  sgRNA
ggactaccagcaagcctgtg

SEQ ID NO: 12584 - DNA, 20 bp, Artificial Sequence
  sgRNA
tcgcaggctcagatagcgcg

SEQ ID NO: 12585 - DNA, 20 bp, Artificial Sequence
  sgRNA
cagcatcaccactctgggcg

SEQ ID NO: 12586 - DNA, 20 bp, Artificial Sequence
  sgRNA
gtgccgtgccagttccacct

SEQ ID NO: 12587 - DNA, 20 bp, Artificial Sequence
  sgRNA
atgaggattgcctagttgag

SEQ ID NO: 12588 - DNA, 20 bp, Artificial Sequence
  sgRNA
cccattgacaacaaacttgg

SEQ ID NO: 12589 - DNA, 20 bp, Artificial Sequence
  sgRNA
ggcgcgcgaagcggctcatg

SEQ ID NO: 12590 - DNA, 20 bp, Artificial Sequence
  sgRNA
ccaggcttgcattagccaat

SEQ ID NO: 12591 - DNA, 20 bp, Artificial Sequence
  sgRNA
ggtggcgcggctgcgtcgtg

SEQ ID NO: 12592 - DNA, 20 bp, Artificial Sequence
  sgRNA
ctcgtctctctcggcggcaa

SEQ ID NO: 12593 - DNA, 20 bp, Artificial Sequence
  sgRNA
agacacgcggaccgcgacag

SEQ ID NO: 12594 - DNA, 20 bp, Artificial Sequence
  sgRNA
ccattcaacccaagtctgcc

SEQ ID NO: 12595 - DNA, 20 bp, Artificial Sequence
  sgRNA
gctatgttcggagtattaag

SEQ ID NO: 12596 - DNA, 20 bp, Artificial Sequence
  sgRNA
ggaatcagttacaattcctc

SEQ ID NO: 12597 - DNA, 20 bp, Artificial Sequence
  sgRNA
ccggaatcgagcgtgcgcaa

SEQ ID NO: 12598 - DNA, 20 bp, Artificial Sequence
  sgRNA
aactcttaactacgacttcc

SEQ ID NO: 12599 - DNA, 20 bp, Artificial Sequence
  sgRNA
cgcggcccggaacacgctag

SEQ ID NO: 12600 - DNA, 20 bp, Artificial Sequence
  sgRNA
tttgtcctatcagaagaacg

SEQ ID NO: 12601 - DNA, 20 bp, Artificial Sequence
  sgRNA
ggcaactccaggacgaccag

SEQ ID NO: 12602 - DNA, 20 bp, Artificial Sequence
  sgRNA
cttccgggtcgttaatgctg

SEQ ID NO: 12603 - DNA, 20 bp, Artificial Sequence
  sgRNA
aaacaagaaccaagtcctac

SEQ ID NO: 12604 - DNA, 20 bp, Artificial Sequence
  sgRNA
cccagacgcccgcacaaaga

SEQ ID NO: 12605 - DNA, 20 bp, Artificial Sequence
  sgRNA
gacctccctcttcaaagagc

SEQ ID NO: 12606 - DNA, 20 bp, Artificial Sequence
  sgRNA
cgggaaccggcggccgcggc

SEQ ID NO: 12607 - DNA, 20 bp, Artificial Sequence
  sgRNA
agggaggacgtggcgcgcag

SEQ ID NO: 12608 - DNA, 20 bp, Artificial Sequence
  sgRNA
cccgcgagcatcccgggtcc

SEQ ID NO: 12609 - DNA, 20 bp, Artificial Sequence
  sgRNA
aacttgggcacgcatgccca

SEQ ID NO: 12610 - DNA, 20 bp, Artificial Sequence
  sgRNA
gctgcgctaaactttgtgtg

SEQ ID NO: 12611 - DNA, 20 bp, Artificial Sequence
  sgRNA
tgccacttccaggctcgctg

SEQ ID NO: 12612 - DNA, 20 bp, Artificial Sequence
  sgRNA
tgtgtggtgctcggttgagg

SEQ ID NO: 12613 - DNA, 20 bp, Artificial Sequence
  sgRNA
tgtggtgaggctgatcactg

SEQ ID NO: 12614 - DNA, 20 bp, Artificial Sequence
  sgRNA
ggctgtttgtttgactccct

SEQ ID NO: 12615 - DNA, 20 bp, Artificial Sequence
  sgRNA
tgcaagttagcacagcttaa

SEQ ID NO: 12616 - DNA, 20 bp, Artificial Sequence
  sgRNA
tatataaagtcaagaggtcc

SEQ ID NO: 12617 - DNA, 20 bp, Artificial Sequence
  sgRNA
caaggaaatgagcaactaat

SEQ ID NO: 12618 - DNA, 20 bp, Artificial Sequence
  sgRNA
gcgcacgccgctattgtgtg

SEQ ID NO: 12619 - DNA, 20 bp, Artificial Sequence
  sgRNA
tgcggccgtgggccggcggt

SEQ ID NO: 12620 - DNA, 20 bp, Artificial Sequence
  sgRNA
ggagccgtcctccgcagagc

SEQ ID NO: 12621 - DNA, 20 bp, Artificial Sequence
  sgRNA
gccggcgggcgtccgctcac

SEQ ID NO: 12622 - DNA, 20 bp, Artificial Sequence
  sgRNA
tgcacctgtcacggccgccc

SEQ ID NO: 12623 - DNA, 20 bp, Artificial Sequence
  sgRNA
gaagccgcagacgttcggtc

SEQ ID NO: 12624 - DNA, 20 bp, Artificial Sequence
  sgRNA
gtctgcaaagtgctgctccc

SEQ ID NO: 12625 - DNA, 20 bp, Artificial Sequence
  sgRNA
ctcgccgtggcgctgcaggc

SEQ ID NO: 12626 - DNA, 20 bp, Artificial Sequence
  sgRNA
atgagagttggagctggagc

SEQ ID NO: 12627 - DNA, 20 bp, Artificial Sequence
  sgRNA
gccacgcctacagtcttccc

SEQ ID NO: 12628 - DNA, 20 bp, Artificial Sequence
  sgRNA
aaccacacccaacttgggag

SEQ ID NO: 12629 - DNA, 20 bp, Artificial Sequence
  sgRNA
ctacagcaagttatttgaag

SEQ ID NO: 12630 - DNA, 20 bp, Artificial Sequence
  sgRNA
gcggctcgggctggccgctt

SEQ ID NO: 12631 - DNA, 20 bp, Artificial Sequence
  sgRNA
catggacagaggcgccaccc

SEQ ID NO: 12632 - DNA, 20 bp, Artificial Sequence
  sgRNA
gggagtggcgcccacggatc

SEQ ID NO: 12633 - DNA, 20 bp, Artificial Sequence
  sgRNA
tttgcttcacgttcacttcc

SEQ ID NO: 12634 - DNA, 20 bp, Artificial Sequence
  sgRNA
ctattgcgaggcgagacagc

SEQ ID NO: 12635 - DNA, 20 bp, Artificial Sequence
  sgRNA
gcccatggtgaacctagata

SEQ ID NO: 12636 - DNA, 20 bp, Artificial Sequence
  sgRNA
taaagggcatgcatgcctcc

SEQ ID NO: 12637 - DNA, 20 bp, Artificial Sequence
  sgRNA
atcatcgggcaacagtgctt

SEQ ID NO: 12638 - DNA, 20 bp, Artificial Sequence
  sgRNA
taggagctttgcggcccggt

SEQ ID NO: 12639 - DNA, 20 bp, Artificial Sequence
  sgRNA
tttcaaggagccctccctcc

SEQ ID NO: 12640 - DNA, 20 bp, Artificial Sequence
  sgRNA
tacgtcgggctgaagcttta

SEQ ID NO: 12641 - DNA, 20 bp, Artificial Sequence
  sgRNA
agcgaagctcccggatcgca

SEQ ID NO: 12642 - DNA, 20 bp, Artificial Sequence
  sgRNA
tgaatcttggtgtaggattc

SEQ ID NO: 12643 - DNA, 20 bp, Artificial Sequence
  sgRNA
atctgctatctgtagatacc

SEQ ID NO: 12644 - DNA, 20 bp, Artificial Sequence
  sgRNA
tgccgtatccggagtgcatc

SEQ ID NO: 12645 - DNA, 20 bp, Artificial Sequence
  sgRNA
atgatcattgtagccggctc

SEQ ID NO: 12646 - DNA, 20 bp, Artificial Sequence
  sgRNA
gctagataggtggcgttctg

SEQ ID NO: 12647 - DNA, 20 bp, Artificial Sequence
  sgRNA
cgccggcctttgccaagcgg

SEQ ID NO: 12648 - DNA, 20 bp, Artificial Sequence
  sgRNA
aggaacctctgccattgatc

SEQ ID NO: 12649 - DNA, 20 bp, Artificial Sequence
  sgRNA
cttacttcactgtattacat

SEQ ID NO: 12650 - DNA, 20 bp, Artificial Sequence
  sgRNA
cgtttccacattcaaatttc

SEQ ID NO: 12651 - DNA, 20 bp, Artificial Sequence
  sgRNA
gctgtgcgcccttggcgtga

SEQ ID NO: 12652 - DNA, 20 bp, Artificial Sequence
  sgRNA
gagcttgaaggcgtagctcc

SEQ ID NO: 12653 - DNA, 20 bp, Artificial Sequence
  sgRNA
agttgtgggcaggacgagcc

SEQ ID NO: 12654 - DNA, 20 bp, Artificial Sequence
  sgRNA
gtgaagactacccagcccgc

SEQ ID NO: 12655 - DNA, 20 bp, Artificial Sequence
  sgRNA
ggctatgtccctctacgtga

SEQ ID NO: 12656 - DNA, 20 bp, Artificial Sequence
  sgRNA
agaggaagcacaagctcccg

SEQ ID NO: 12657 - DNA, 20 bp, Artificial Sequence
  sgRNA
gcaggaagctcttgcagata

SEQ ID NO: 12658 - DNA, 20 bp, Artificial Sequence
  sgRNA
cagcctccagcagattcgct

SEQ ID NO: 12659 - DNA, 20 bp, Artificial Sequence
  sgRNA
gcaggacagctgatggtttc

SEQ ID NO: 12660 - DNA, 20 bp, Artificial Sequence
  sgRNA
gctgaagttgatataaggac

SEQ ID NO: 12661 - DNA, 20 bp, Artificial Sequence
  sgRNA
agaccaagctgcgcatgagt

SEQ ID NO: 12662 - DNA, 20 bp, Artificial Sequence
  sgRNA
ggaggaactacctattgccg

SEQ ID NO: 12663 - DNA, 20 bp, Artificial Sequence
  sgRNA
ggtgactagattaagcctct

SEQ ID NO: 12664 - DNA, 20 bp, Artificial Sequence
  sgRNA
atctgaagtatctgtagggt

SEQ ID NO: 12665 - DNA, 20 bp, Artificial Sequence
  sgRNA
ggatgatcaggttcagggtc

SEQ ID NO: 12666 - DNA, 20 bp, Artificial Sequence
  sgRNA
aggatatgagtctcctgaag

SEQ ID NO: 12667 - DNA, 20 bp, Artificial Sequence
  sgRNA
ctgaaggagtgcggattccc

SEQ ID NO: 12668 - DNA, 20 bp, Artificial Sequence
  sgRNA
tagctacgtcatcagttacc

SEQ ID NO: 12669 - DNA, 20 bp, Artificial Sequence
  sgRNA
gtaagcacgctgtgggttat

SEQ ID NO: 12670 - DNA, 20 bp, Artificial Sequence
  sgRNA
agcattacctccgatgccag

SEQ ID NO: 12671 - DNA, 20 bp, Artificial Sequence
  sgRNA
ggaagaaaccatgcggtgca

SEQ ID NO: 12672 - DNA, 20 bp, Artificial Sequence
  sgRNA
tcagagatcatggacagcta

SEQ ID NO: 12673 - DNA, 20 bp, Artificial Sequence
  sgRNA
gggaggattcctctgacttg

SEQ ID NO: 12674 - DNA, 20 bp, Artificial Sequence
  sgRNA
tcttccctggtgcctgtcct

SEQ ID NO: 12675 - DNA, 20 bp, Artificial Sequence
  sgRNA
atcattgacattcttcagga

SEQ ID NO: 12676 - DNA, 20 bp, Artificial Sequence
  sgRNA
ctagtactgttcaacttgtg

SEQ ID NO: 12677 - DNA, 20 bp, Artificial Sequence
  sgRNA
tttgctgatcaaagagcaac

SEQ ID NO: 12678 - DNA, 20 bp, Artificial Sequence
  sgRNA
aagcattcaagttcagaaag

SEQ ID NO: 12679 - DNA, 20 bp, Artificial Sequence
  sgRNA
catgcgtcttatttgggaaa

SEQ ID NO: 12680 - DNA, 20 bp, Artificial Sequence
  sgRNA
aggatttgcttcttaccgag

SEQ ID NO: 12681 - DNA, 20 bp, Artificial Sequence
  sgRNA
tttctgtttagctctgtcct

SEQ ID NO: 12682 - DNA, 20 bp, Artificial Sequence
  sgRNA
cagcattccctggcgcgagg

SEQ ID NO: 12683 - DNA, 20 bp, Artificial Sequence
  sgRNA
ttccaattagaagcttcttc

SEQ ID NO: 12684 - DNA, 20 bp, Artificial Sequence
  sgRNA
gcgtggctggatgtccctgt

SEQ ID NO: 12685 - DNA, 20 bp, Artificial Sequence
  sgRNA
gggctccaggcgcgagatgc

SEQ ID NO: 12686 - DNA, 20 bp, Artificial Sequence
  sgRNA
ccggaattctgagagcgcgc

SEQ ID NO: 12687 - DNA, 20 bp, Artificial Sequence
  sgRNA
gctcgccgccgccgccaagc

SEQ ID NO: 12688 - DNA, 20 bp, Artificial Sequence
  sgRNA
gacacagggatctaacccag

SEQ ID NO: 12689 - DNA, 20 bp, Artificial Sequence
  sgRNA
ccgcagcgaactcgaattaa

SEQ ID NO: 12690 - DNA, 20 bp, Artificial Sequence
  sgRNA
ggtggctgctctggaagccc

SEQ ID NO: 12691 - DNA, 20 bp, Artificial Sequence
  sgRNA
gctgaccgctggccactctg

SEQ ID NO: 12692 - DNA, 20 bp, Artificial Sequence
  sgRNA
aaggatgacgtgatgctctt

SEQ ID NO: 12693 - DNA, 20 bp, Artificial Sequence
  sgRNA
cgcaaggcaatgggtgcggc

SEQ ID NO: 12694 - DNA, 20 bp, Artificial Sequence
  sgRNA
actgcacgccttgggagcac

SEQ ID NO: 12695 - DNA, 20 bp, Artificial Sequence
  sgRNA
gccgcgggtctgggcatccc

SEQ ID NO: 12696 - DNA, 20 bp, Artificial Sequence
  sgRNA
ggatcctcgagagtgggcgt

SEQ ID NO: 12697 - DNA, 20 bp, Artificial Sequence
  sgRNA
gggctcatcaggcgctcacc

SEQ ID NO: 12698 - DNA, 20 bp, Artificial Sequence
  sgRNA
ggtgacgcagggtaggcgcc

SEQ ID NO: 12699 - DNA, 20 bp, Artificial Sequence
  sgRNA
gagcccaagtccctgtgtgg

SEQ ID NO: 12700 - DNA, 20 bp, Artificial Sequence
  sgRNA
cagaggccaacctgtcctct

SEQ ID NO: 12701 - DNA, 20 bp, Artificial Sequence
  sgRNA
gcatggcaaccgctctctga

SEQ ID NO: 12702 - DNA, 20 bp, Artificial Sequence
  sgRNA
tcgcggtctgcgcgcacacg

SEQ ID NO: 12703 - DNA, 20 bp, Artificial Sequence
  sgRNA
agtgaggcgagctggcggcg

SEQ ID NO: 12704 - DNA, 20 bp, Artificial Sequence
  sgRNA
cacgcccgagagccttggcg

SEQ ID NO: 12705 - DNA, 20 bp, Artificial Sequence
  sgRNA
agagccttgctgtagaagcc

SEQ ID NO: 12706 - DNA, 20 bp, Artificial Sequence
  sgRNA
gctggaccattctcaagagg

SEQ ID NO: 12707 - DNA, 20 bp, Artificial Sequence
  sgRNA
tttgtgaaggtctgtgggcg

SEQ ID NO: 12708 - DNA, 20 bp, Artificial Sequence
  sgRNA
tagaaggtaagggaaacgcc

SEQ ID NO: 12709 - DNA, 20 bp, Artificial Sequence
  sgRNA
cgacagcgatctgacagcga

SEQ ID NO: 12710 - DNA, 20 bp, Artificial Sequence
  sgRNA
gattggaagtttcttccgcc

SEQ ID NO: 12711 - DNA, 20 bp, Artificial Sequence
  sgRNA
taaagggtgtgtgtgttggg

SEQ ID NO: 12712 - DNA, 20 bp, Artificial Sequence
  sgRNA
cacagaggaaagtaaattat

SEQ ID NO: 12713 - DNA, 20 bp, Artificial Sequence
  sgRNA
acacacttgtcaagcctgct

SEQ ID NO: 12714 - DNA, 20 bp, Artificial Sequence
  sgRNA
aagaagagatgatcatcatt

SEQ ID NO: 12715 - DNA, 20 bp, Artificial Sequence
  sgRNA
tgcagtcaagttgctagact

SEQ ID NO: 12716 - DNA, 20 bp, Artificial Sequence
  sgRNA
agccacagttaacaggcgta

SEQ ID NO: 12717 - DNA, 20 bp, Artificial Sequence
  sgRNA
tttgccttggttcccggagc

SEQ ID NO: 12718 - DNA, 20 bp, Artificial Sequence
  sgRNA
gatggccttggccctaactg

SEQ ID NO: 12719 - DNA, 20 bp, Artificial Sequence
  sgRNA
ctgtgggtgagctcgggatt

SEQ ID NO: 12720 - DNA, 20 bp, Artificial Sequence
  sgRNA
aatgttcggagcaccttgcc

SEQ ID NO: 12721 - DNA, 20 bp, Artificial Sequence
  sgRNA
gctccgcccacgccggatat

SEQ ID NO: 12722 - DNA, 20 bp, Artificial Sequence
  sgRNA
tcgactgtcctcacataaag

SEQ ID NO: 12723 - DNA, 20 bp, Artificial Sequence
  sgRNA
acacttatcagccaagagct

SEQ ID NO: 12724 - DNA, 20 bp, Artificial Sequence
  sgRNA
gcgccgcagatcgtgcgtgc

SEQ ID NO: 12725 - DNA, 20 bp, Artificial Sequence
  sgRNA
gtcgttatgacaaccgcgtc

SEQ ID NO: 12726 - DNA, 20 bp, Artificial Sequence
  sgRNA
actgaccaattaacgtgaaa

SEQ ID NO: 12727 - DNA, 20 bp, Artificial Sequence
  sgRNA
ccaatagaagctccgggaga

SEQ ID NO: 12728 - DNA, 20 bp, Artificial Sequence
  sgRNA
gcaccaggagttgtcgcaag

SEQ ID NO: 12729 - DNA, 20 bp, Artificial Sequence
  sgRNA
tgcacctccttaccctctag

SEQ ID NO: 12730 - DNA, 20 bp, Artificial Sequence
  sgRNA
gggtccagggaatttcccaa

SEQ ID NO: 12731 - DNA, 20 bp, Artificial Sequence
  sgRNA
agagtcaagaaggttggcag

SEQ ID NO: 12732 - DNA, 20 bp, Artificial Sequence
  sgRNA
cagaacctccagagagtgtg

SEQ ID NO: 12733 - DNA, 20 bp, Artificial Sequence
  sgRNA
cattgttgtgatcactgcac

SEQ ID NO: 12734 - DNA, 20 bp, Artificial Sequence
  sgRNA
tgcttatgcctaacagatct

SEQ ID NO: 12735 - DNA, 20 bp, Artificial Sequence
  sgRNA
gcggaagtcagacacgcacc

SEQ ID NO: 12736 - DNA, 20 bp, Artificial Sequence
  sgRNA
gaggacggagcctgcgctgc

SEQ ID NO: 12737 - DNA, 20 bp, Artificial Sequence
  sgRNA
tgatgacgatgggcgccacc

SEQ ID NO: 12738 - DNA, 20 bp, Artificial Sequence
  sgRNA
aacggagcatgagagaggcg

SEQ ID NO: 12739 - DNA, 20 bp, Artificial Sequence
  sgRNA
gctgaggctcctggcagcca

SEQ ID NO: 12740 - DNA, 20 bp, Artificial Sequence
  sgRNA
tcaggaaaggtagatgcaag

SEQ ID NO: 12741 - DNA, 20 bp, Artificial Sequence
  sgRNA
caaggtcagctaaccaaagc

SEQ ID NO: 12742 - DNA, 20 bp, Artificial Sequence
  sgRNA
ggcgccagataggcctgcgg

SEQ ID NO: 12743 - DNA, 20 bp, Artificial Sequence
  sgRNA
acctgaatcttgatagggcc

SEQ ID NO: 12744 - DNA, 20 bp, Artificial Sequence
  sgRNA
aaactaatctgctccagtcc

SEQ ID NO: 12745 - DNA, 20 bp, Artificial Sequence
  sgRNA
agatggatttatatcagtcc

SEQ ID NO: 12746 - DNA, 20 bp, Artificial Sequence
  sgRNA
cccgccacatcaccgtgcgc

SEQ ID NO: 12747 - DNA, 20 bp, Artificial Sequence
  sgRNA
ggaggcgggaggcgggcggg

SEQ ID NO: 12748 - DNA, 20 bp, Artificial Sequence
  sgRNA
ggcgccctgctctcccggcg

SEQ ID NO: 12749 - DNA, 20 bp, Artificial Sequence
  sgRNA
cgccgcagaggaccactgcc

SEQ ID NO: 12750 - DNA, 20 bp, Artificial Sequence
  sgRNA
cccgggcgctgagttgggcg

SEQ ID NO: 12751 - DNA, 20 bp, Artificial Sequence
  sgRNA
actctgtccgcccaggatcg

SEQ ID NO: 12752 - DNA, 20 bp, Artificial Sequence
  sgRNA
ggtgtcagccgactgggtgg

SEQ ID NO: 12753 - DNA, 20 bp, Artificial Sequence
  sgRNA
gaggaaaccagccagccgcg

SEQ ID NO: 12754 - DNA, 20 bp, Artificial Sequence
  sgRNA
ctccttcagggattggaggt

SEQ ID NO: 12755 - DNA, 20 bp, Artificial Sequence
  sgRNA
gctgcacatgggcatgcaca

SEQ ID NO: 12756 - DNA, 20 bp, Artificial Sequence
  sgRNA
gctctttctgatgacgtcac

SEQ ID NO: 12757 - DNA, 20 bp, Artificial Sequence
  sgRNA
ctctcagtggactgtaatcc

SEQ ID NO: 12758 - DNA, 20 bp, Artificial Sequence
  sgRNA
tccagtcattctccggtccc

SEQ ID NO: 12759 - DNA, 20 bp, Artificial Sequence
  sgRNA
cccgcttgtttggccctcaa

SEQ ID NO: 12760 - DNA, 20 bp, Artificial Sequence
  sgRNA
gcagtgttggaggcgggttc

SEQ ID NO: 12761 - DNA, 20 bp, Artificial Sequence
  sgRNA
aaacttctcacgggaggact

SEQ ID NO: 12762 - DNA, 20 bp, Artificial Sequence
  sgRNA
gcacgtgtactctggtcctg

SEQ ID NO: 12763 - DNA, 20 bp, Artificial Sequence
  sgRNA
gtgcctgcgcactagtacga

SEQ ID NO: 12764 - DNA, 20 bp, Artificial Sequence
  sgRNA
actgccagaggtaagataaa

SEQ ID NO: 12765 - DNA, 20 bp, Artificial Sequence
  sgRNA
caggatctgacaatcctcgg

SEQ ID NO: 12766 - DNA, 20 bp, Artificial Sequence
  sgRNA
ttctgggcttgagcactagg

SEQ ID NO: 12767 - DNA, 20 bp, Artificial Sequence
  sgRNA
ggaaacactatcgcgactgc

SEQ ID NO: 12768 - DNA, 20 bp, Artificial Sequence
  sgRNA
acaagagcctctagctgtcc

SEQ ID NO: 12769 - DNA, 20 bp, Artificial Sequence
  sgRNA
ctgttaggtgtgcctagcgc

SEQ ID NO: 12770 - DNA, 20 bp, Artificial Sequence
  sgRNA
acgaaacttcaagtaccaaa

SEQ ID NO: 12771 - DNA, 20 bp, Artificial Sequence
  sgRNA
acgtggtgctctcgcgagag

SEQ ID NO: 12772 - DNA, 20 bp, Artificial Sequence
  sgRNA
atgctggagtttggtcaatg

SEQ ID NO: 12773 - DNA, 20 bp, Artificial Sequence
  sgRNA
agtttagacagcgaaacaga

SEQ ID NO: 12774 - DNA, 20 bp, Artificial Sequence
  sgRNA
aagtcagatggaacttccag

SEQ ID NO: 12775 - DNA, 20 bp, Artificial Sequence
  sgRNA
taagacacaaagagcctgac

SEQ ID NO: 12776 - DNA, 20 bp, Artificial Sequence
  sgRNA
gatgtggtagaggaacaatt

SEQ ID NO: 12777 - DNA, 20 bp, Artificial Sequence
  sgRNA
aagtggaaaccaaataactt

SEQ ID NO: 12778 - DNA, 20 bp, Artificial Sequence
  sgRNA
gtgtataaggagaaagaagc

SEQ ID NO: 12779 - DNA, 20 bp, Artificial Sequence
  sgRNA
cacacaagcagggcctctcg

SEQ ID NO: 12780 - DNA, 20 bp, Artificial Sequence
  sgRNA
gggccagctaggaaagattt

SEQ ID NO: 12781 - DNA, 20 bp, Artificial Sequence
  sgRNA
gcaggtccgagcggctggcg

SEQ ID NO: 12782 - DNA, 20 bp, Artificial Sequence
  sgRNA
ggaaactcattccgggtctt

SEQ ID NO: 12783 - DNA, 20 bp, Artificial Sequence
  sgRNA
tcgatgtgcttggccgtgcc

SEQ ID NO: 12784 - DNA, 20 bp, Artificial Sequence
  sgRNA
cacggcacggcggaactacg

SEQ ID NO: 12785 - DNA, 20 bp, Artificial Sequence
  sgRNA
cgcaggcgtcagtcttgggc

SEQ ID NO: 12786 - DNA, 20 bp, Artificial Sequence
  sgRNA
gggagcccaggcgcttctag

SEQ ID NO: 12787 - DNA, 20 bp, Artificial Sequence
  sgRNA
ctccggctgcccgcccagcg

SEQ ID NO: 12788 - DNA, 20 bp, Artificial Sequence
  sgRNA
cccacgccacgccctataag

SEQ ID NO: 12789 - DNA, 20 bp, Artificial Sequence
  sgRNA
tgacgcggattggctaggct

SEQ ID NO: 12790 - DNA, 20 bp, Artificial Sequence
  sgRNA
aagcaactcggcgttccctg

SEQ ID NO: 12791 - DNA, 20 bp, Artificial Sequence
  sgRNA
gagatccaatggccttgtta

SEQ ID NO: 12792 - DNA, 20 bp, Artificial Sequence
  sgRNA
ggtctgcaggcccagcggat

SEQ ID NO: 12793 - DNA, 20 bp, Artificial Sequence
  sgRNA
actgacctttctatcctggg

SEQ ID NO: 12794 - DNA, 20 bp, Artificial Sequence
  sgRNA
catcagaggtttgagggaga

SEQ ID NO: 12795 - DNA, 20 bp, Artificial Sequence
  sgRNA
gacttcatcatcctatcagg

SEQ ID NO: 12796 - DNA, 20 bp, Artificial Sequence
  sgRNA
cagctttgatctgagaggtg

SEQ ID NO: 12797 - DNA, 20 bp, Artificial Sequence
  sgRNA
tttcaggagtcctttctccc

SEQ ID NO: 12798 - DNA, 20 bp, Artificial Sequence
  sgRNA
cattcagcattctgaatccc

SEQ ID NO: 12799 - DNA, 20 bp, Artificial Sequence
  sgRNA
aattcagtaaggtttattcg

SEQ ID NO: 12800 - DNA, 20 bp, Artificial Sequence
  sgRNA
aatctgacccacccaatcca

SEQ ID NO: 12801 - DNA, 20 bp, Artificial Sequence
  sgRNA
aggagactcctgtgcaaatg

SEQ ID NO: 12802 - DNA, 20 bp, Artificial Sequence
  sgRNA
aaagaaacaggctcatgagc

SEQ ID NO: 12803 - DNA, 20 bp, Artificial Sequence
  sgRNA
aacacttggaagggaccctt

SEQ ID NO: 12804 - DNA, 20 bp, Artificial Sequence
  sgRNA
gtggttgacactctttggtg

SEQ ID NO: 12805 - DNA, 20 bp, Artificial Sequence
  sgRNA
acccttgcagagcaagtggg

SEQ ID NO: 12806 - DNA, 20 bp, Artificial Sequence
  sgRNA
aactctctctttaaaggaac

SEQ ID NO: 12807 - DNA, 20 bp, Artificial Sequence
  sgRNA
taaacagtatgtgcaactga

SEQ ID NO: 12808 - DNA, 20 bp, Artificial Sequence
  sgRNA
ccctggcttcaaatactggc

SEQ ID NO: 12809 - DNA, 20 bp, Artificial Sequence
  sgRNA
aggctgcagcagaggatacc

SEQ ID NO: 12810 - DNA, 20 bp, Artificial Sequence
  sgRNA
caagggtgaggctaaggtcc

SEQ ID NO: 12811 - DNA, 20 bp, Artificial Sequence
  sgRNA
agggctcttgcgcaggctct

SEQ ID NO: 12812 - DNA, 20 bp, Artificial Sequence
  sgRNA
gcgctgtgtgcgggttgtgc

SEQ ID NO: 12813 - DNA, 20 bp, Artificial Sequence
  sgRNA
cagcgccacggttcggacta

SEQ ID NO: 12814 - DNA, 20 bp, Artificial Sequence
  sgRNA
cctccctgggaccagagttc

SEQ ID NO: 12815 - DNA, 20 bp, Artificial Sequence
  sgRNA
aagtgttgatcatctccagc

SEQ ID NO: 12816 - DNA, 20 bp, Artificial Sequence
  sgRNA
gcggcgcgcgcgggttaaag

SEQ ID NO: 12817 - DNA, 20 bp, Artificial Sequence
  sgRNA
gtggctcacactctagtaag

SEQ ID NO: 12818 - DNA, 20 bp, Artificial Sequence
  sgRNA
ggaacgatgattggaggagg

SEQ ID NO: 12819 - DNA, 20 bp, Artificial Sequence
  sgRNA
tgtgggtcaggaaactgtaa

SEQ ID NO: 12820 - DNA, 20 bp, Artificial Sequence
  sgRNA
gagaaatttgcagacatagg

SEQ ID NO: 12821 - DNA, 20 bp, Artificial Sequence
  sgRNA
ggtgataggaaagttgacta

SEQ ID NO: 12822 - DNA, 20 bp, Artificial Sequence
  sgRNA
taactgtgcgcagtgttcaa

SEQ ID NO: 12823 - DNA, 20 bp, Artificial Sequence
  sgRNA
tcgtcctatgcctgagcggc

SEQ ID NO: 12824 - DNA, 20 bp, Artificial Sequence
  sgRNA
gttactagtgtgacaaaggc

SEQ ID NO: 12825 - DNA, 20 bp, Artificial Sequence
  sgRNA
cgataaggcacccaagtcca

SEQ ID NO: 12826 - DNA, 20 bp, Artificial Sequence
  sgRNA
tgctgtatcatttggttggg

SEQ ID NO: 12827 - DNA, 20 bp, Artificial Sequence
  sgRNA
cggatcacctccagaaggcc

SEQ ID NO: 12828 - DNA, 20 bp, Artificial Sequence
  sgRNA
gcgcactaagctgactgcgc

SEQ ID NO: 12829 - DNA, 20 bp, Artificial Sequence
  sgRNA
ctgggaggccctccgcgtcg

SEQ ID NO: 12830 - DNA, 20 bp, Artificial Sequence
  sgRNA
aggaatgcggagccgggaag

SEQ ID NO: 12831 - DNA, 20 bp, Artificial Sequence
  sgRNA
aatcacgctcatcgacctat

SEQ ID NO: 12832 - DNA, 20 bp, Artificial Sequence
  sgRNA
gacaaagatctgaacgttat

SEQ ID NO: 12833 - DNA, 20 bp, Artificial Sequence
  sgRNA
ctaagttgtgtggttcataa

SEQ ID NO: 12834 - DNA, 20 bp, Artificial Sequence
  sgRNA
gaagccagtaaatatcctaa

SEQ ID NO: 12835 - DNA, 20 bp, Artificial Sequence
  sgRNA
aagatcgcggtagcttaacc

SEQ ID NO: 12836 - DNA, 20 bp, Artificial Sequence
  sgRNA
tcgcaaagcgcctgttacct

SEQ ID NO: 12837 - DNA, 20 bp, Artificial Sequence
  sgRNA
ctgaaagagagataaagctg

SEQ ID NO: 12838 - DNA, 20 bp, Artificial Sequence
  sgRNA
ggaggaaataggagggaggg

SEQ ID NO: 12839 - DNA, 20 bp, Artificial Sequence
  sgRNA
tcacttacctccttctcact

SEQ ID NO: 12840 - DNA, 20 bp, Artificial Sequence
  sgRNA
actaagaggagggagaaggg

SEQ ID NO: 12841 - DNA, 20 bp, Artificial Sequence
  sgRNA
ttacgaggcaaccaagagga

SEQ ID NO: 12842 - DNA, 20 bp, Artificial Sequence
  sgRNA
aaactggaggaagtaaaggg

SEQ ID NO: 12843 - DNA, 20 bp, Artificial Sequence
  sgRNA
tgagagacggcttcagccaa

SEQ ID NO: 12844 - DNA, 20 bp, Artificial Sequence
  sgRNA
tgcgcccgcccaatagcgca

SEQ ID NO: 12845 - DNA, 20 bp, Artificial Sequence
  sgRNA
tgagcgggtgagtctcaaga

SEQ ID NO: 12846 - DNA, 20 bp, Artificial Sequence
  sgRNA
cccagggagagcagcgcgag

SEQ ID NO: 12847 - DNA, 20 bp, Artificial Sequence
  sgRNA
gtgtgacgtcactgccggcc

SEQ ID NO: 12848 - DNA, 20 bp, Artificial Sequence
  sgRNA
caatccagcaagatggcgcc

SEQ ID NO: 12849 - DNA, 20 bp, Artificial Sequence
  sgRNA
gcactctgctggagttcagt

SEQ ID NO: 12850 - DNA, 20 bp, Artificial Sequence
  sgRNA
ctgcctgcccgtcaacactc

SEQ ID NO: 12851 - DNA, 20 bp, Artificial Sequence
  sgRNA
ctcacttctgctggtcctcg

SEQ ID NO: 12852 - DNA, 20 bp, Artificial Sequence
  sgRNA
cacagcccgcgtctgaaagc

SEQ ID NO: 12853 - DNA, 20 bp, Artificial Sequence
  sgRNA
ctcagtaccaaggagcgaag

SEQ ID NO: 12854 - DNA, 20 bp, Artificial Sequence
  sgRNA
acggaaattctgtaggcagc

SEQ ID NO: 12855 - DNA, 20 bp, Artificial Sequence
  sgRNA
gtgtcttctccattcatccc

SEQ ID NO: 12856 - DNA, 20 bp, Artificial Sequence
  sgRNA
agaatccctcgcggcagtcc

SEQ ID NO: 12857 - DNA, 20 bp, Artificial Sequence
  sgRNA
ctcttggaacctcgcaaccc

SEQ ID NO: 12858 - DNA, 20 bp, Artificial Sequence
  sgRNA
ctctagaagctagataagcg

SEQ ID NO: 12859 - DNA, 20 bp, Artificial Sequence
  sgRNA
aaacagctacaaggcttgct

SEQ ID NO: 12860 - DNA, 20 bp, Artificial Sequence
  sgRNA
ggcaataacagcttcagcag

SEQ ID NO: 12861 - DNA, 20 bp, Artificial Sequence
  sgRNA
gtgtggagtatgtttctatc

SEQ ID NO: 12862 - DNA, 20 bp, Artificial Sequence
  sgRNA
gcgttgtttgctgctccaaa

SEQ ID NO: 12863 - DNA, 20 bp, Artificial Sequence
  sgRNA
acacatctcatccagagaca

SEQ ID NO: 12864 - DNA, 20 bp, Artificial Sequence
  sgRNA
agccgggaactcacgtgcgg

SEQ ID NO: 12865 - DNA, 20 bp, Artificial Sequence
  sgRNA
tcgcgcctcacacaagccct

SEQ ID NO: 12866 - DNA, 20 bp, Artificial Sequence
  sgRNA
ggaaagggagcatcacccgc

SEQ ID NO: 12867 - DNA, 20 bp, Artificial Sequence
  sgRNA
aaacagctgtgcgtagtttg

SEQ ID NO: 12868 - DNA, 20 bp, Artificial Sequence
  sgRNA
gatcaggattggatgcccat

SEQ ID NO: 12869 - DNA, 20 bp, Artificial Sequence
  sgRNA
aagggtcctttgattggatg

SEQ ID NO: 12870 - DNA, 20 bp, Artificial Sequence
  sgRNA
gctgggcaaggattatatgc

SEQ ID NO: 12871 - DNA, 20 bp, Artificial Sequence
  sgRNA
gcaccgcgcaaacaaacgct

SEQ ID NO: 12872 - DNA, 20 bp, Artificial Sequence
  sgRNA
cgggatagggacggccttgg

SEQ ID NO: 12873 - DNA, 20 bp, Artificial Sequence
  sgRNA
tgccgcccggcacagttccg

SEQ ID NO: 12874 - DNA, 20 bp, Artificial Sequence
  sgRNA
caaacctggtatccagtggg

SEQ ID NO: 12875 - DNA, 20 bp, Artificial Sequence
  sgRNA
gccggctacacactagcgaa

SEQ ID NO: 12876 - DNA, 20 bp, Artificial Sequence
  sgRNA
agggaatctttgacagcgcc

SEQ ID NO: 12877 - DNA, 20 bp, Artificial Sequence
  sgRNA
aacttatgagaaggcccacc

SEQ ID NO: 12878 - DNA, 20 bp, Artificial Sequence
  sgRNA
gtcgctacaaacttcgccga

SEQ ID NO: 12879 - DNA, 20 bp, Artificial Sequence
  sgRNA
tttacaattaccaagactgg

SEQ ID NO: 12880 - DNA, 20 bp, Artificial Sequence
  sgRNA
ggttaacaactgtcttagtc

SEQ ID NO: 12881 - DNA, 20 bp, Artificial Sequence
  sgRNA
gattgctagaatggaaacct

SEQ ID NO: 12882 - DNA, 20 bp, Artificial Sequence
  sgRNA
gttactagaggtggagcgcc

SEQ ID NO: 12883 - DNA, 20 bp, Artificial Sequence
  sgRNA
cctaggcaacacagtagagc

SEQ ID NO: 12884 - DNA, 20 bp, Artificial Sequence
  sgRNA
taagccagccaaggcagtgc

SEQ ID NO: 12885 - DNA, 20 bp, Artificial Sequence
  sgRNA
gcggcccgcagacggcgagg

SEQ ID NO: 12886 - DNA, 20 bp, Artificial Sequence
  sgRNA
cgcgcagcgagcgcgaggcg

SEQ ID NO: 12887 - DNA, 20 bp, Artificial Sequence
  sgRNA
ggcacctcggtgtttacacg

SEQ ID NO: 12888 - DNA, 20 bp, Artificial Sequence
  sgRNA
ctcctttctggccgttacca

SEQ ID NO: 12889 - DNA, 20 bp, Artificial Sequence
  sgRNA
cgagagtctgcgattctggc

SEQ ID NO: 12890 - DNA, 20 bp, Artificial Sequence
  sgRNA
cagaagccagaacccgtgtc

SEQ ID NO: 12891 - DNA, 20 bp, Artificial Sequence
  sgRNA
gttggcgacccgcaggttcc

SEQ ID NO: 12892 - DNA, 20 bp, Artificial Sequence
  sgRNA
gctggttgagggtagggtgt

SEQ ID NO: 12893 - DNA, 20 bp, Artificial Sequence
  sgRNA
ctgtcctgattgctcaggct

SEQ ID NO: 12894 - DNA, 20 bp, Artificial Sequence
  sgRNA
gagaccagcctagaaatttg

SEQ ID NO: 12895 - DNA, 20 bp, Artificial Sequence
  sgRNA
gcgctgctgagagaatattt

SEQ ID NO: 12896 - DNA, 20 bp, Artificial Sequence
  sgRNA
aaccctaggatttaaactct

SEQ ID NO: 12897 - DNA, 20 bp, Artificial Sequence
  sgRNA
aatcatgggtgactttgtgc

SEQ ID NO: 12898 - DNA, 20 bp, Artificial Sequence
  sgRNA
gaaccagcccgcgcgttgct

SEQ ID NO: 12899 - DNA, 20 bp, Artificial Sequence
  sgRNA
agcatacggtactgtgagcg

SEQ ID NO: 12900 - DNA, 20 bp, Artificial Sequence
  sgRNA
agcatcagtgtttccattag

SEQ ID NO: 12901 - DNA, 20 bp, Artificial Sequence
  sgRNA
acaggatctgagcgtgggct

SEQ ID NO: 12902 - DNA, 20 bp, Artificial Sequence
  sgRNA
caccaggatgcattgtgaag

SEQ ID NO: 12903 - DNA, 20 bp, Artificial Sequence
  sgRNA
aagctgcatttggctctgca

SEQ ID NO: 12904 - DNA, 20 bp, Artificial Sequence
  sgRNA
tgggcggatcgccctgacca

SEQ ID NO: 12905 - DNA, 20 bp, Artificial Sequence
  sgRNA
ggatgctatggaaaccaagt

SEQ ID NO: 12906 - DNA, 20 bp, Artificial Sequence
  sgRNA
tttaaggctcgcgagacttg

SEQ ID NO: 12907 - DNA, 20 bp, Artificial Sequence
  sgRNA
acgcgcacgaggaaaggagg

SEQ ID NO: 12908 - DNA, 20 bp, Artificial Sequence
  sgRNA
ggttctagtgagcgcttcga

SEQ ID NO: 12909 - DNA, 20 bp, Artificial Sequence
  sgRNA
agacatgctgaataacaaag

SEQ ID NO: 12910 - DNA, 20 bp, Artificial Sequence
  sgRNA
ttagcaggagtctgattggc

SEQ ID NO: 12911 - DNA, 20 bp, Artificial Sequence
  sgRNA
gaatggaatctctctagagc

SEQ ID NO: 12912 - DNA, 20 bp, Artificial Sequence
  sgRNA
atggctgctgttcctcccgc

SEQ ID NO: 12913 - DNA, 20 bp, Artificial Sequence
  sgRNA
ggtggccctccaggcgggag

SEQ ID NO: 12914 - DNA, 20 bp, Artificial Sequence
  sgRNA
gggaaggtcaaggccggtag

SEQ ID NO: 12915 - DNA, 20 bp, Artificial Sequence
  sgRNA
ggaaccagtactgagggcag

SEQ ID NO: 12916 - DNA, 20 bp, Artificial Sequence
  sgRNA
gaaggaaggaggagcaaggg

SEQ ID NO: 12917 - DNA, 20 bp, Artificial Sequence
  sgRNA
cgcgcgtgagaggagggagg

SEQ ID NO: 12918 - DNA, 20 bp, Artificial Sequence
  sgRNA
gagagggcgactgcgaggct

SEQ ID NO: 12919 - DNA, 20 bp, Artificial Sequence
  sgRNA
gggacctactttgcggattg

SEQ ID NO: 12920 - DNA, 20 bp, Artificial Sequence
  sgRNA
aataggagggagatgttcaa

SEQ ID NO: 12921 - DNA, 20 bp, Artificial Sequence
  sgRNA
ggtctgacgtcagccatgtg

SEQ ID NO: 12922 - DNA, 20 bp, Artificial Sequence
  sgRNA
gatattaatgaacctccaag

SEQ ID NO: 12923 - DNA, 20 bp, Artificial Sequence
  sgRNA
atctccagtagcgctctgac

SEQ ID NO: 12924 - DNA, 20 bp, Artificial Sequence
  sgRNA
ggcttaaggagaattgccaa

SEQ ID NO: 12925 - DNA, 20 bp, Artificial Sequence
  sgRNA
ttccatacaagcgcatttct

SEQ ID NO: 12926 - DNA, 20 bp, Artificial Sequence
  sgRNA
gctccatttataggaggagc

SEQ ID NO: 12927 - DNA, 20 bp, Artificial Sequence
  sgRNA
agcaagctgaagccagagcc

SEQ ID NO: 12928 - DNA, 20 bp, Artificial Sequence
  sgRNA
agtcactacgtagactaaga

SEQ ID NO: 12929 - DNA, 20 bp, Artificial Sequence
  sgRNA
gacagctctatatataaacc

SEQ ID NO: 12930 - DNA, 20 bp, Artificial Sequence
  sgRNA
aggatctgactctcatctgt

SEQ ID NO: 12931 - DNA, 20 bp, Artificial Sequence
  sgRNA
ggtaagaaagtgacaggctg

SEQ ID NO: 12932 - DNA, 20 bp, Artificial Sequence
  sgRNA
ggaggaatgtgcacgaggga

SEQ ID NO: 12933 - DNA, 20 bp, Artificial Sequence
  sgRNA
gggtcaaactgcgattccgt

SEQ ID NO: 12934 - DNA, 20 bp, Artificial Sequence
  sgRNA
caaattcctgcgcctccagg

SEQ ID NO: 12935 - DNA, 20 bp, Artificial Sequence
  sgRNA
cccggcgccaactgtggagg

SEQ ID NO: 12936 - DNA, 20 bp, Artificial Sequence
  sgRNA
agcgaagtttgcaaacaata

SEQ ID NO: 12937 - DNA, 20 bp, Artificial Sequence
  sgRNA
tcgcccgcgcccggaagaag

SEQ ID NO: 12938 - DNA, 20 bp, Artificial Sequence
  sgRNA
gccgctcagcgcgcaaactt

SEQ ID NO: 12939 - DNA, 20 bp, Artificial Sequence
  sgRNA
ttgcatagattcttgtgtat

SEQ ID NO: 12940 - DNA, 20 bp, Artificial Sequence
  sgRNA
tttggaacggttatgtgcag

SEQ ID NO: 12941 - DNA, 20 bp, Artificial Sequence
  sgRNA
aagcagcttcccaaggtagg

SEQ ID NO: 12942 - DNA, 20 bp, Artificial Sequence
  sgRNA
ggagagagagtgcaaatggc

SEQ ID NO: 12943 - DNA, 20 bp, Artificial Sequence
  sgRNA
tagcaagaatgtctattatc

SEQ ID NO: 12944 - DNA, 20 bp, Artificial Sequence
  sgRNA
gggagttagtaacatgaaga

SEQ ID NO: 12945 - DNA, 20 bp, Artificial Sequence
  sgRNA
tggctgcagaatgggtaggc

SEQ ID NO: 12946 - DNA, 20 bp, Artificial Sequence
  sgRNA
tggacaaacttaagaaggag

SEQ ID NO: 12947 - DNA, 20 bp, Artificial Sequence
  sgRNA
gtacacacttgcaccatcac

SEQ ID NO: 12948 - DNA, 20 bp, Artificial Sequence
  sgRNA
ggtatgtgaatattctatgc

SEQ ID NO: 12949 - DNA, 20 bp, Artificial Sequence
  sgRNA
ggagttccacctaaacgctc

SEQ ID NO: 12950 - DNA, 20 bp, Artificial Sequence
  sgRNA
cacgtggaacctgggttccg

SEQ ID NO: 12951 - DNA, 20 bp, Artificial Sequence
  sgRNA
ctttcctattggccataact

SEQ ID NO: 12952 - DNA, 20 bp, Artificial Sequence
  sgRNA
gacaagtcgcttccgtagtg

SEQ ID NO: 12953 - DNA, 20 bp, Artificial Sequence
  sgRNA
cacgtgacgctgcgagagac

SEQ ID NO: 12954 - DNA, 20 bp, Artificial Sequence
  sgRNA
agtctcacttattcatgaaa

SEQ ID NO: 12955 - DNA, 20 bp, Artificial Sequence
  sgRNA
cggcgattcttgggtgagta

SEQ ID NO: 12956 - DNA, 20 bp, Artificial Sequence
  sgRNA
tcacagcggaactttgctgc

SEQ ID NO: 12957 - DNA, 20 bp, Artificial Sequence
  sgRNA
cggtgagtgcgcgtctatcg

SEQ ID NO: 12958 - DNA, 20 bp, Artificial Sequence
  sgRNA
tcttggcggccatgactgtg

SEQ ID NO: 12959 - DNA, 20 bp, Artificial Sequence
  sgRNA
attagaagacggaaactctt

SEQ ID NO: 12960 - DNA, 20 bp, Artificial Sequence
  sgRNA
cctcagtataaagtccagcc

SEQ ID NO: 12961 - DNA, 20 bp, Artificial Sequence
  sgRNA
tcaggatgaccaatgtcaac

SEQ ID NO: 12962 - DNA, 20 bp, Artificial Sequence
  sgRNA
atgtcataggacagacacta

SEQ ID NO: 12963 - DNA, 20 bp, Artificial Sequence
  sgRNA
atgcaattactaaggcgtgg

SEQ ID NO: 12964 - DNA, 20 bp, Artificial Sequence
  sgRNA
ggcaaaggtaatggactcta

SEQ ID NO: 12965 - DNA, 20 bp, Artificial Sequence
  sgRNA
aatcggtgtcatgaacctcc

SEQ ID NO: 12966 - DNA, 20 bp, Artificial Sequence
  sgRNA
tgtgcatcccagaatcgatt

SEQ ID NO: 12967 - DNA, 20 bp, Artificial Sequence
  sgRNA
ggaccgcgccttcccttgac

SEQ ID NO: 12968 - DNA, 20 bp, Artificial Sequence
  sgRNA
gcgatcttatcacccggtcc

SEQ ID NO: 12969 - DNA, 20 bp, Artificial Sequence
  sgRNA
cggtgggccacggcctcgtg

SEQ ID NO: 12970 - DNA, 20 bp, Artificial Sequence
  sgRNA
ccgtcgagaggcgggaggcc

SEQ ID NO: 12971 - DNA, 20 bp, Artificial Sequence
  sgRNA
cggcccacaaacatggtggg

SEQ ID NO: 12972 - DNA, 20 bp, Artificial Sequence
  sgRNA
tgttattctctgagggcatg

SEQ ID NO: 12973 - DNA, 20 bp, Artificial Sequence
  sgRNA
tcttggaggtagaacataaa

SEQ ID NO: 12974 - DNA, 20 bp, Artificial Sequence
  sgRNA
catcctacctaggtgtcctt

SEQ ID NO: 12975 - DNA, 20 bp, Artificial Sequence
  sgRNA
gtcctagcccgcgccagcct

SEQ ID NO: 12976 - DNA, 20 bp, Artificial Sequence
  sgRNA
tcaacttatttgctaagaga

SEQ ID NO: 12977 - DNA, 20 bp, Artificial Sequence
  sgRNA
tgatcagacaaattattggt

SEQ ID NO: 12978 - DNA, 20 bp, Artificial Sequence
  sgRNA
acagtgctagagaatcgatt

SEQ ID NO: 12979 - DNA, 20 bp, Artificial Sequence
  sgRNA
tactcaagaatgcagcatct

SEQ ID NO: 12980 - DNA, 20 bp, Artificial Sequence
  sgRNA
tatctagtcctcatttgcag

SEQ ID NO: 12981 - DNA, 20 bp, Artificial Sequence
  sgRNA
agacagggtcacgtggagct

SEQ ID NO: 12982 - DNA, 20 bp, Artificial Sequence
  sgRNA
ggcttctgacgagaaggtct

SEQ ID NO: 12983 - DNA, 20 bp, Artificial Sequence
  sgRNA
cccagcctgactgtaaaggg

SEQ ID NO: 12984 - DNA, 20 bp, Artificial Sequence
  sgRNA
gcatccaagtcctcacctcg

SEQ ID NO: 12985 - DNA, 20 bp, Artificial Sequence
  sgRNA
cggacactcggcccggagct

SEQ ID NO: 12986 - DNA, 20 bp, Artificial Sequence
  sgRNA
tcaagttgattcgttccagg

SEQ ID NO: 12987 - DNA, 20 bp, Artificial Sequence
  sgRNA
gaggcgggaattaggctgaa

SEQ ID NO: 12988 - DNA, 20 bp, Artificial Sequence
  sgRNA
acaacttcagggctgagact

SEQ ID NO: 12989 - DNA, 20 bp, Artificial Sequence
  sgRNA
tgttcaccagagaaagcaag

SEQ ID NO: 12990 - DNA, 20 bp, Artificial Sequence
  sgRNA
tttcggaggaatgtggcttc

SEQ ID NO: 12991 - DNA, 20 bp, Artificial Sequence
  sgRNA
ctgcgcggttccggcacatg

SEQ ID NO: 12992 - DNA, 20 bp, Artificial Sequence
  sgRNA
gtgtcgcaaccaaaccgccc

SEQ ID NO: 12993 - DNA, 20 bp, Artificial Sequence
  sgRNA
cccttcccattgttaggctg

SEQ ID NO: 12994 - DNA, 20 bp, Artificial Sequence
  sgRNA
atgtatttaacagggacgtg

SEQ ID NO: 12995 - DNA, 20 bp, Artificial Sequence
  sgRNA
ggttagacaacaaagcacct

SEQ ID NO: 12996 - DNA, 20 bp, Artificial Sequence
  sgRNA
ggtaattcagtctacagcag

SEQ ID NO: 12997 - DNA, 20 bp, Artificial Sequence
  sgRNA
tgaatgtcacattcacaagc

SEQ ID NO: 12998 - DNA, 20 bp, Artificial Sequence
  sgRNA
gttactgccctctacaaata

SEQ ID NO: 12999 - DNA, 20 bp, Artificial Sequence
  sgRNA
tctctgaaagcagtgtgtaa

SEQ ID NO: 13000 - DNA, 20 bp, Artificial Sequence
  sgRNA
gggccttccaggatttgaga

SEQ ID NO: 13001 - DNA, 20 bp, Artificial Sequence
  sgRNA
ctcgggagcaagcggcgcgc

SEQ ID NO: 13002 - DNA, 20 bp, Artificial Sequence
  sgRNA
gcgtgtgctccgcagataga

SEQ ID NO: 13003 - DNA, 20 bp, Artificial Sequence
  sgRNA
cagcagtccaacagctgcgg

SEQ ID NO: 13004 - DNA, 20 bp, Artificial Sequence
  sgRNA
gaaggcaatcttctagccct

SEQ ID NO: 13005 - DNA, 20 bp, Artificial Sequence
  sgRNA
ccaccctcatttgtctcttc

SEQ ID NO: 13006 - DNA, 20 bp, Artificial Sequence
  sgRNA
gccttgtagccactttcctc

SEQ ID NO: 13007 - DNA, 20 bp, Artificial Sequence
  sgRNA
gggcgtgtctctgggtggtg

SEQ ID NO: 13008 - DNA, 20 bp, Artificial Sequence
  sgRNA
agccggtcttcgggtgagaa

SEQ ID NO: 13009 - DNA, 20 bp, Artificial Sequence
  sgRNA
cgtggagaaggtagaacacc

SEQ ID NO: 13010 - DNA, 20 bp, Artificial Sequence
  sgRNA
gctctgctttgaaacatgaa

SEQ ID NO: 13011 - DNA, 20 bp, Artificial Sequence
  sgRNA
gcgtggtagatgcgcgtttc

SEQ ID NO: 13012 - DNA, 20 bp, Artificial Sequence
  sgRNA
atccaaaggaaggcggactc

SEQ ID NO: 13013 - DNA, 20 bp, Artificial Sequence
  sgRNA
agtgtgctcggaggcagtcg

SEQ ID NO: 13014 - DNA, 20 bp, Artificial Sequence
  sgRNA
agagatttcggagaacacta

SEQ ID NO: 13015 - DNA, 20 bp, Artificial Sequence
  sgRNA
gaagcttctgacctccagaa

SEQ ID NO: 13016 - DNA, 20 bp, Artificial Sequence
  sgRNA
tcactaaggatttacagcac

SEQ ID NO: 13017 - DNA, 20 bp, Artificial Sequence
  sgRNA
gtataaatttcagcacccag

SEQ ID NO: 13018 - DNA, 20 bp, Artificial Sequence
  sgRNA
actcttggatggatggctgt

SEQ ID NO: 13019 - DNA, 20 bp, Artificial Sequence
  sgRNA
gttgttgattcatatgcaaa

SEQ ID NO: 13020 - DNA, 20 bp, Artificial Sequence
  sgRNA
gttctgctcagacaataaga

SEQ ID NO: 13021 - DNA, 20 bp, Artificial Sequence
  sgRNA
taatgcaggctgcaatcact

SEQ ID NO: 13022 - DNA, 20 bp, Artificial Sequence
  sgRNA
ggctttcaaactacccaata

SEQ ID NO: 13023 - DNA, 20 bp, Artificial Sequence
  sgRNA
cggaagtgacatacttaagt

SEQ ID NO: 13024 - DNA, 20 bp, Artificial Sequence
  sgRNA
actttgtaggcgctttagtt

SEQ ID NO: 13025 - DNA, 20 bp, Artificial Sequence
  sgRNA
tttgttctgagagggagaga

SEQ ID NO: 13026 - DNA, 20 bp, Artificial Sequence
  sgRNA
ccgaccggaagtgcagctgc

SEQ ID NO: 13027 - DNA, 20 bp, Artificial Sequence
  sgRNA
gagtcggtaccgacggaggg

SEQ ID NO: 13028 - DNA, 20 bp, Artificial Sequence
  sgRNA
ggctgcccatctgagcaagc

SEQ ID NO: 13029 - DNA, 20 bp, Artificial Sequence
  sgRNA
gctgccattgacccatcaca

SEQ ID NO: 13030 - DNA, 20 bp, Artificial Sequence
  sgRNA
ggtgggagaggccgtccttg

SEQ ID NO: 13031 - DNA, 20 bp, Artificial Sequence
  sgRNA
acgcacggtcctggccggcg

SEQ ID NO: 13032 - DNA, 20 bp, Artificial Sequence
  sgRNA
gaccgtgggcgggcccatcg

SEQ ID NO: 13033 - DNA, 20 bp, Artificial Sequence
  sgRNA
aaagcaagccggaactctac

SEQ ID NO: 13034 - DNA, 20 bp, Artificial Sequence
  sgRNA
cgcgcgcggaacatggctga

SEQ ID NO: 13035 - DNA, 20 bp, Artificial Sequence
  sgRNA
ggttctgcggtaggactccc

SEQ ID NO: 13036 - DNA, 20 bp, Artificial Sequence
  sgRNA
gccggcgaggaacccgcgct

SEQ ID NO: 13037 - DNA, 20 bp, Artificial Sequence
  sgRNA
caaacctcctctcaggccga

SEQ ID NO: 13038 - DNA, 20 bp, Artificial Sequence
  sgRNA
tccaagagagctggattata

SEQ ID NO: 13039 - DNA, 20 bp, Artificial Sequence
  sgRNA
gcagttgcacaaatggcttc

SEQ ID NO: 13040 - DNA, 20 bp, Artificial Sequence
  sgRNA
aaatgacaccagggcaacgt

SEQ ID NO: 13041 - DNA, 20 bp, Artificial Sequence
  sgRNA
ctgagctcgtgggacagcct

SEQ ID NO: 13042 - DNA, 20 bp, Artificial Sequence
  sgRNA
tctgtttgctttctcctaac

SEQ ID NO: 13043 - DNA, 20 bp, Artificial Sequence
  sgRNA
gtcgcgtctctagcgctaga

SEQ ID NO: 13044 - DNA, 20 bp, Artificial Sequence
  sgRNA
aacttgggtaagcagctgca

SEQ ID NO: 13045 - DNA, 20 bp, Artificial Sequence
  sgRNA
gggcagagcctgcttgtgat

SEQ ID NO: 13046 - DNA, 20 bp, Artificial Sequence
  sgRNA
cttgggctccggctcggctc

SEQ ID NO: 13047 - DNA, 20 bp, Artificial Sequence
  sgRNA
accgtggccgccgctgggcg

SEQ ID NO: 13048 - DNA, 20 bp, Artificial Sequence
  sgRNA
tctggcggcggcaggtgctg

SEQ ID NO: 13049 - DNA, 20 bp, Artificial Sequence
  sgRNA
cagtgccaagagacagtcac

SEQ ID NO: 13050 - DNA, 20 bp, Artificial Sequence
  sgRNA
ctttgcaggagtctcagatg

SEQ ID NO: 13051 - DNA, 20 bp, Artificial Sequence
  sgRNA
aaacactgtagggttatgat

SEQ ID NO: 13052 - DNA, 20 bp, Artificial Sequence
  sgRNA
gttgagcttcttcttcagct

SEQ ID NO: 13053 - DNA, 20 bp, Artificial Sequence
  sgRNA
agtctttcagctagactcag

SEQ ID NO: 13054 - DNA, 20 bp, Artificial Sequence
  sgRNA
attccttatatagaccaggc

SEQ ID NO: 13055 - DNA, 20 bp, Artificial Sequence
  sgRNA
cacagaactagggacagatc

SEQ ID NO: 13056 - DNA, 20 bp, Artificial Sequence
  sgRNA
aggtttggaaaggttactgg

SEQ ID NO: 13057 - DNA, 20 bp, Artificial Sequence
  sgRNA
actgaagaattacttccaag

SEQ ID NO: 13058 - DNA, 20 bp, Artificial Sequence
  sgRNA
tctggtgacaacggcggctg

SEQ ID NO: 13059 - DNA, 20 bp, Artificial Sequence
  sgRNA
tgaatggttccggcgaggcg

SEQ ID NO: 13060 - DNA, 20 bp, Artificial Sequence
  sgRNA
gggatggaggcggtcgctcg

SEQ ID NO: 13061 - DNA, 20 bp, Artificial Sequence
  sgRNA
tctcaaattcaagaccagcc

SEQ ID NO: 13062 - DNA, 20 bp, Artificial Sequence
  sgRNA
attatattaggtcggcgcag

SEQ ID NO: 13063 - DNA, 20 bp, Artificial Sequence
  sgRNA
caccaccactgctgttaccc

SEQ ID NO: 13064 - DNA, 20 bp, Artificial Sequence
  sgRNA
ggcggagtcagggcgtttct

SEQ ID NO: 13065 - DNA, 20 bp, Artificial Sequence
  sgRNA
tcagtggagtaatggaacag

SEQ ID NO: 13066 - DNA, 20 bp, Artificial Sequence
  sgRNA
gcttcagggatttcctaagc

SEQ ID NO: 13067 - DNA, 20 bp, Artificial Sequence
  sgRNA
tttgcacgagaagtggaaac

SEQ ID NO: 13068 - DNA, 20 bp, Artificial Sequence
  sgRNA
tcgaccctgatacttgattg

SEQ ID NO: 13069 - DNA, 20 bp, Artificial Sequence
  sgRNA
cacatccaatcgatgagtgc

SEQ ID NO: 13070 - DNA, 20 bp, Artificial Sequence
  sgRNA
ctagaatctcagctgcccat

SEQ ID NO: 13071 - DNA, 20 bp, Artificial Sequence
  sgRNA
tagggcatctgttagatcac

SEQ ID NO: 13072 - DNA, 20 bp, Artificial Sequence
  sgRNA
cctcactgaaatcttccctg

SEQ ID NO: 13073 - DNA, 20 bp, Artificial Sequence
  sgRNA
gagccgcgcctcagcagttg

SEQ ID NO: 13074 - DNA, 20 bp, Artificial Sequence
  sgRNA
gaactggaggcccgacgcgc

SEQ ID NO: 13075 - DNA, 20 bp, Artificial Sequence
  sgRNA
aacccggaagtctcctagcc

SEQ ID NO: 13076 - DNA, 20 bp, Artificial Sequence
  sgRNA
gggctgcagcgagcgtgaaa

SEQ ID NO: 13077 - DNA, 20 bp, Artificial Sequence
  sgRNA
acgtactggagagggtcgag

SEQ ID NO: 13078 - DNA, 20 bp, Artificial Sequence
  sgRNA
gggccattcaccacggataa

SEQ ID NO: 13079 - DNA, 20 bp, Artificial Sequence
  sgRNA
ctagctatctaggagggaaa

SEQ ID NO: 13080 - DNA, 20 bp, Artificial Sequence
  sgRNA
ttcgtcatcctaaattatct

SEQ ID NO: 13081 - DNA, 20 bp, Artificial Sequence
  sgRNA
cgttgtaattggaaggccag

SEQ ID NO: 13082 - DNA, 20 bp, Artificial Sequence
  sgRNA
ctccgactacaagtcccaaa

SEQ ID NO: 13083 - DNA, 20 bp, Artificial Sequence
  sgRNA
gttacgcatgcgactggagg

SEQ ID NO: 13084 - DNA, 20 bp, Artificial Sequence
  sgRNA
atgaagacagacgcggttcc

SEQ ID NO: 13085 - DNA, 20 bp, Artificial Sequence
  sgRNA
ccttggaggaatcttctcag

SEQ ID NO: 13086 - DNA, 20 bp, Artificial Sequence
  sgRNA
cagatgcggacttcgctccg

SEQ ID NO: 13087 - DNA, 20 bp, Artificial Sequence
  sgRNA
gatcgcccagctgtctcctg

SEQ ID NO: 13088 - DNA, 20 bp, Artificial Sequence
  sgRNA
taggagccatttaatagaag

SEQ ID NO: 13089 - DNA, 20 bp, Artificial Sequence
  sgRNA
catttcttcaaagtttaacc

SEQ ID NO: 13090 - DNA, 20 bp, Artificial Sequence
  sgRNA
catctgcagtggtgttgtcc

SEQ ID NO: 13091 - DNA, 20 bp, Artificial Sequence
  sgRNA
gagcagcagtcatgagcgaa

SEQ ID NO: 13092 - DNA, 20 bp, Artificial Sequence
  sgRNA
cctttccagtcatttaaatg

SEQ ID NO: 13093 - DNA, 20 bp, Artificial Sequence
  sgRNA
gggcagtgacgtcgacggaa

SEQ ID NO: 13094 - DNA, 20 bp, Artificial Sequence
  sgRNA
cctatccaggaggcagcacc

SEQ ID NO: 13095 - DNA, 20 bp, Artificial Sequence
  sgRNA
tcagtgccttatatagtgcc

SEQ ID NO: 13096 - DNA, 20 bp, Artificial Sequence
  sgRNA
gacactgagtgtgctctcca

SEQ ID NO: 13097 - DNA, 20 bp, Artificial Sequence
  sgRNA
gtgtgagcgtcgggcactga

SEQ ID NO: 13098 - DNA, 20 bp, Artificial Sequence
  sgRNA
aggtgcggacttagctgtgc

SEQ ID NO: 13099 - DNA, 20 bp, Artificial Sequence
  sgRNA
gaacgtcacggctgcgccac

SEQ ID NO: 13100 - DNA, 20 bp, Artificial Sequence
  sgRNA
gacttggaattgactaacgg

SEQ ID NO: 13101 - DNA, 20 bp, Artificial Sequence
  sgRNA
ttcttgggtaatgaatgagg

SEQ ID NO: 13102 - DNA, 20 bp, Artificial Sequence
  sgRNA
attctgctgtagaggctaga

SEQ ID NO: 13103 - DNA, 20 bp, Artificial Sequence
  sgRNA
tctggtcccgctctcggccg

SEQ ID NO: 13104 - DNA, 20 bp, Artificial Sequence
  sgRNA
cgacgagaacacgagcgcgg

SEQ ID NO: 13105 - DNA, 20 bp, Artificial Sequence
  sgRNA
agaacagggagccgcctcag

SEQ ID NO: 13106 - DNA, 20 bp, Artificial Sequence
  sgRNA
gctgccgcctggctgctctg

SEQ ID NO: 13107 - DNA, 20 bp, Artificial Sequence
  sgRNA
gccgcgagaaggaggcgcgc

SEQ ID NO: 13108 - DNA, 20 bp, Artificial Sequence
  sgRNA
gggtcagcccggcgtggcgt

SEQ ID NO: 13109 - DNA, 20 bp, Artificial Sequence
  sgRNA
agggcaggtccggagccgag

SEQ ID NO: 13110 - DNA, 20 bp, Artificial Sequence
  sgRNA
cgtctcgcggcgcccacgtg

SEQ ID NO: 13111 - DNA, 20 bp, Artificial Sequence
  sgRNA
ctaagttggagcagccgttc

SEQ ID NO: 13112 - DNA, 20 bp, Artificial Sequence
  sgRNA
ccctgaaccaaagaagtcag

SEQ ID NO: 13113 - DNA, 20 bp, Artificial Sequence
  sgRNA
actctgctctctgtgcttcc

SEQ ID NO: 13114 - DNA, 20 bp, Artificial Sequence
  sgRNA
ggtcatggattgtatttaac

SEQ ID NO: 13115 - DNA, 20 bp, Artificial Sequence
  sgRNA
gcccttgccctgagattgta

SEQ ID NO: 13116 - DNA, 20 bp, Artificial Sequence
  sgRNA
ttggagttgccagaaagtca

SEQ ID NO: 13117 - DNA, 20 bp, Artificial Sequence
  sgRNA
gccagcggacgtgaagcttt

SEQ ID NO: 13118 - DNA, 20 bp, Artificial Sequence
  sgRNA
gtcggcccacgaccgggacg

SEQ ID NO: 13119 - DNA, 20 bp, Artificial Sequence
  sgRNA
ggagcccgtacccgtgcggc

SEQ ID NO: 13120 - DNA, 20 bp, Artificial Sequence
  sgRNA
tgggttcctgttgtaccgag

SEQ ID NO: 13121 - DNA, 20 bp, Artificial Sequence
  sgRNA
gggctgtctaattagaggta

SEQ ID NO: 13122 - DNA, 20 bp, Artificial Sequence
  sgRNA
tttagctgagagccctgcaa

SEQ ID NO: 13123 - DNA, 20 bp, Artificial Sequence
  sgRNA
ccactctttcctgttagcac

SEQ ID NO: 13124 - DNA, 20 bp, Artificial Sequence
  sgRNA
cccattcacaaaccactccg

SEQ ID NO: 13125 - DNA, 20 bp, Artificial Sequence
  sgRNA
ctctgtggacctgttccgat

SEQ ID NO: 13126 - DNA, 20 bp, Artificial Sequence
  sgRNA
ttggatgtccagagggctcg

SEQ ID NO: 13127 - DNA, 20 bp, Artificial Sequence
  sgRNA
tctgggctaagcatactctg

SEQ ID NO: 13128 - DNA, 20 bp, Artificial Sequence
  sgRNA
cttagggatgcctgacgtca

SEQ ID NO: 13129 - DNA, 20 bp, Artificial Sequence
  sgRNA
tggacatgtcgtgatgctat

SEQ ID NO: 13130 - DNA, 20 bp, Artificial Sequence
  sgRNA
gcgccgctgttgaccaatcg

SEQ ID NO: 13131 - DNA, 20 bp, Artificial Sequence
  sgRNA
caataataagattgggctct

SEQ ID NO: 13132 - DNA, 20 bp, Artificial Sequence
  sgRNA
aatgttaggatccacggaaa

SEQ ID NO: 13133 - DNA, 20 bp, Artificial Sequence
  sgRNA
ccctacatccaaccacatcc

SEQ ID NO: 13134 - DNA, 20 bp, Artificial Sequence
  sgRNA
tcccgggcccaatgacaccc

SEQ ID NO: 13135 - DNA, 20 bp, Artificial Sequence
  sgRNA
gaagcttgtgcaagtcacct

SEQ ID NO: 13136 - DNA, 20 bp, Artificial Sequence
  sgRNA
taaatgcgaggatccactcg

SEQ ID NO: 13137 - DNA, 20 bp, Artificial Sequence
  sgRNA
gactcagagactacgagctt

SEQ ID NO: 13138 - DNA, 20 bp, Artificial Sequence
  sgRNA
aaagattccagagagtcacg

SEQ ID NO: 13139 - DNA, 20 bp, Artificial Sequence
  sgRNA
ctcggcgctcgctggagcct

SEQ ID NO: 13140 - DNA, 20 bp, Artificial Sequence
  sgRNA
ccctgtcccgggagggaggg

SEQ ID NO: 13141 - DNA, 20 bp, Artificial Sequence
  sgRNA
cgccgcctcccgcccgcgct

SEQ ID NO: 13142 - DNA, 20 bp, Artificial Sequence
  sgRNA
agatctattacgatgcattc

SEQ ID NO: 13143 - DNA, 20 bp, Artificial Sequence
  sgRNA
tgtgcttggctcggacgaaa

SEQ ID NO: 13144 - DNA, 20 bp, Artificial Sequence
  sgRNA
gaataaagctagctaaatac

SEQ ID NO: 13145 - DNA, 20 bp, Artificial Sequence
  sgRNA
gacgaggtcggaaacctaca

SEQ ID NO: 13146 - DNA, 20 bp, Artificial Sequence
  sgRNA
gggaagtgagcagttctgtt

SEQ ID NO: 13147 - DNA, 20 bp, Artificial Sequence
  sgRNA
agctgtcttgtgctgcacgg

SEQ ID NO: 13148 - DNA, 20 bp, Artificial Sequence
  sgRNA
acttgtgctaagaactttcc

SEQ ID NO: 13149 - DNA, 20 bp, Artificial Sequence
  sgRNA
gtcagttggatcagggtgga

SEQ ID NO: 13150 - DNA, 20 bp, Artificial Sequence
  sgRNA
actgcttgtctccactaatt

SEQ ID NO: 13151 - DNA, 20 bp, Artificial Sequence
  sgRNA
ttgggctgtcagcagatctg

SEQ ID NO: 13152 - DNA, 20 bp, Artificial Sequence
  sgRNA
gctctgttaggaaggcatga

SEQ ID NO: 13153 - DNA, 20 bp, Artificial Sequence
  sgRNA
ttacagcccggctctgtgat

SEQ ID NO: 13154 - DNA, 20 bp, Artificial Sequence
  sgRNA
gaagtaacttgttgcctgtg

SEQ ID NO: 13155 - DNA, 20 bp, Artificial Sequence
  sgRNA
caattacctgagagtcatct

SEQ ID NO: 13156 - DNA, 20 bp, Artificial Sequence
  sgRNA
acacctcaaagataatcctc

SEQ ID NO: 13157 - DNA, 20 bp, Artificial Sequence
  sgRNA
aattctagactaggcaggtc

SEQ ID NO: 13158 - DNA, 20 bp, Artificial Sequence
  sgRNA
ggtgtggcacgccataatgc

SEQ ID NO: 13159 - DNA, 20 bp, Artificial Sequence
  sgRNA
aaagttaacagagcacagct

SEQ ID NO: 13160 - DNA, 20 bp, Artificial Sequence
  sgRNA
tgatatatgggcggtttgga

SEQ ID NO: 13161 - DNA, 20 bp, Artificial Sequence
  sgRNA
cagtggtccagtgatggcta

SEQ ID NO: 13162 - DNA, 20 bp, Artificial Sequence
  sgRNA
cactgagtggcacagccttc

SEQ ID NO: 13163 - DNA, 20 bp, Artificial Sequence
  sgRNA
gggcgctggcctattgtgtt

SEQ ID NO: 13164 - DNA, 20 bp, Artificial Sequence
  sgRNA
ccgcagctggattggcaacc

SEQ ID NO: 13165 - DNA, 20 bp, Artificial Sequence
  sgRNA
gctgctgcattgttaggctc

SEQ ID NO: 13166 - DNA, 20 bp, Artificial Sequence
  sgRNA
caagatcagtctcaacttct

SEQ ID NO: 13167 - DNA, 20 bp, Artificial Sequence
  sgRNA
aagcaaagctatgaaatcgg

SEQ ID NO: 13168 - DNA, 20 bp, Artificial Sequence
  sgRNA
attgacaaggaggaatttgt

SEQ ID NO: 13169 - DNA, 20 bp, Artificial Sequence
  sgRNA
atagttgtggccggaatctc

SEQ ID NO: 13170 - DNA, 20 bp, Artificial Sequence
  sgRNA
ctccaccgccgagagagcga

SEQ ID NO: 13171 - DNA, 20 bp, Artificial Sequence
  sgRNA
ctgaggcagaagtcacttct

SEQ ID NO: 13172 - DNA, 20 bp, Artificial Sequence
  sgRNA
tctagcttcctatgctgtta

SEQ ID NO: 13173 - DNA, 20 bp, Artificial Sequence
  sgRNA
accattaagtggctaaggca

SEQ ID NO: 13174 - DNA, 20 bp, Artificial Sequence
  sgRNA
gaaatttattctagattcgc

SEQ ID NO: 13175 - DNA, 20 bp, Artificial Sequence
  sgRNA
cgtgctaaggaagcgtggga

SEQ ID NO: 13176 - DNA, 20 bp, Artificial Sequence
  sgRNA
gcgttgtactccgcacgcgc

SEQ ID NO: 13177 - DNA, 20 bp, Artificial Sequence
  sgRNA
ctaagtgtgcgtctgcgact

SEQ ID NO: 13178 - DNA, 20 bp, Artificial Sequence
  sgRNA
aggatgggttgttccctcat

SEQ ID NO: 13179 - DNA, 20 bp, Artificial Sequence
  sgRNA
gggaatgtgggctgtaagtg

SEQ ID NO: 13180 - DNA, 20 bp, Artificial Sequence
  sgRNA
ctgacaatttgcttctgttt

SEQ ID NO: 13181 - DNA, 20 bp, Artificial Sequence
  sgRNA
atcaaggatagatgatcttg

SEQ ID NO: 13182 - DNA, 20 bp, Artificial Sequence
  sgRNA
tgcagatagacagtaagagt

SEQ ID NO: 13183 - DNA, 20 bp, Artificial Sequence
  sgRNA
accaaatgtcctgtgaagga

SEQ ID NO: 13184 - DNA, 20 bp, Artificial Sequence
  sgRNA
ctcaggtgtctgcgcagatc

SEQ ID NO: 13185 - DNA, 20 bp, Artificial Sequence
  sgRNA
ctttccgccgcagagcacgc

SEQ ID NO: 13186 - DNA, 20 bp, Artificial Sequence
  sgRNA
ataccttccagggtcaggga

SEQ ID NO: 13187 - DNA, 20 bp, Artificial Sequence
  sgRNA
aggcggctgtgggtgggcag

SEQ ID NO: 13188 - DNA, 20 bp, Artificial Sequence
  sgRNA
cgggcgcagccctccgtaca

SEQ ID NO: 13189 - DNA, 20 bp, Artificial Sequence
  sgRNA
ggagggccgggcgtcagagc

SEQ ID NO: 13190 - DNA, 20 bp, Artificial Sequence
  sgRNA
cttggcttagcgttgctgtc

SEQ ID NO: 13191 - DNA, 20 bp, Artificial Sequence
  sgRNA
ggcttgggcgggatgcactg

SEQ ID NO: 13192 - DNA, 20 bp, Artificial Sequence
  sgRNA
cccgccggaggcgtggtctc

SEQ ID NO: 13193 - DNA, 20 bp, Artificial Sequence
  sgRNA
tgtagtatccttcgccaatc

SEQ ID NO: 13194 - DNA, 20 bp, Artificial Sequence
  sgRNA
cctcgcctccaacgttgctt

SEQ ID NO: 13195 - DNA, 20 bp, Artificial Sequence
  sgRNA
tagaggtaggtccaacccgg

SEQ ID NO: 13196 - DNA, 20 bp, Artificial Sequence
  sgRNA
acgtgccttcagcagtgaca

SEQ ID NO: 13197 - DNA, 20 bp, Artificial Sequence
  sgRNA
gaccctagacacccgcatag

SEQ ID NO: 13198 - DNA, 20 bp, Artificial Sequence
  sgRNA
cctccagagaaagtactttc

SEQ ID NO: 13199 - DNA, 20 bp, Artificial Sequence
  sgRNA
gccattggctggttcgcgga

SEQ ID NO: 13200 - DNA, 20 bp, Artificial Sequence
  sgRNA
ctcgctctacgttccgcgca

SEQ ID NO: 13201 - DNA, 20 bp, Artificial Sequence
  sgRNA
ggctggctcctggcggagcg

SEQ ID NO: 13202 - DNA, 20 bp, Artificial Sequence
  sgRNA
gcaggaggcagcgtcggccc

SEQ ID NO: 13203 - DNA, 20 bp, Artificial Sequence
  sgRNA
agtggcggcccggctggcag

SEQ ID NO: 13204 - DNA, 20 bp, Artificial Sequence
  sgRNA
gaatgacccaggttaacttt

SEQ ID NO: 13205 - DNA, 20 bp, Artificial Sequence
  sgRNA
gtctgctttatatccaaggt

SEQ ID NO: 13206 - DNA, 20 bp, Artificial Sequence
  sgRNA
ggcacgagaccataggtgat

SEQ ID NO: 13207 - DNA, 20 bp, Artificial Sequence
  sgRNA
cgccgtgcggagtccttcct

SEQ ID NO: 13208 - DNA, 20 bp, Artificial Sequence
  sgRNA
ggaggtcctgggtaggacag

SEQ ID NO: 13209 - DNA, 20 bp, Artificial Sequence
  sgRNA
ggcctggtgcgcaggccctt

SEQ ID NO: 13210 - DNA, 20 bp, Artificial Sequence
  sgRNA
ggccttgcctgcaggtttga

SEQ ID NO: 13211 - DNA, 20 bp, Artificial Sequence
  sgRNA
gtgcctgggcgcttctcggg

SEQ ID NO: 13212 - DNA, 20 bp, Artificial Sequence
  sgRNA
tcaatcgttcctggatggtg

SEQ ID NO: 13213 - DNA, 20 bp, Artificial Sequence
  sgRNA
cagtttcaaggcacgtgcac

SEQ ID NO: 13214 - DNA, 20 bp, Artificial Sequence
  sgRNA
tgaggaggtgaactgtacga

SEQ ID NO: 13215 - DNA, 20 bp, Artificial Sequence
  sgRNA
cgcaccaatggttgtccagc

SEQ ID NO: 13216 - DNA, 20 bp, Artificial Sequence
  sgRNA
gagatgtgtctgagtccggg

SEQ ID NO: 13217 - DNA, 20 bp, Artificial Sequence
  sgRNA
gacagggagaggagggaagg

SEQ ID NO: 13218 - DNA, 20 bp, Artificial Sequence
  sgRNA
atcagcgcatgcgcactgtc

SEQ ID NO: 13219 - DNA, 20 bp, Artificial Sequence
  sgRNA
ctgatttggcgcgctgccct

SEQ ID NO: 13220 - DNA, 20 bp, Artificial Sequence
  sgRNA
tggagctagttggagcgcgg

SEQ ID NO: 13221 - DNA, 20 bp, Artificial Sequence
  sgRNA
gttggaagccagaggagaga

SEQ ID NO: 13222 - DNA, 20 bp, Artificial Sequence
  sgRNA
tggagaggacctgcgactgc

SEQ ID NO: 13223 - DNA, 20 bp, Artificial Sequence
  sgRNA
gctcactattgtgtctgcac

SEQ ID NO: 13224 - DNA, 20 bp, Artificial Sequence
  sgRNA
gaattaagtcctcttgctgc

SEQ ID NO: 13225 - DNA, 20 bp, Artificial Sequence
  sgRNA
gtaaggcaagcatcagcgtc

SEQ ID NO: 13226 - DNA, 20 bp, Artificial Sequence
  sgRNA
ggtttcaggtgggcaccgcc

SEQ ID NO: 13227 - DNA, 20 bp, Artificial Sequence
  sgRNA
gcgccacacccttcaggcag

SEQ ID NO: 13228 - DNA, 20 bp, Artificial Sequence
  sgRNA
ctatgttggctctgcgagcc

SEQ ID NO: 13229 - DNA, 20 bp, Artificial Sequence
  sgRNA
aggacttccggcgtgtgccg

SEQ ID NO: 13230 - DNA, 20 bp, Artificial Sequence
  sgRNA
tctgactcagccacgtcatc

SEQ ID NO: 13231 - DNA, 20 bp, Artificial Sequence
  sgRNA
gcagcacagcagcggcgact

SEQ ID NO: 13232 - DNA, 20 bp, Artificial Sequence
  sgRNA
tggtgatcgaatacgccacc

SEQ ID NO: 13233 - DNA, 20 bp, Artificial Sequence
  sgRNA
gcgtcggccctcccggtatt

SEQ ID NO: 13234 - DNA, 20 bp, Artificial Sequence
  sgRNA
actctaccttgaccgcgcga

SEQ ID NO: 13235 - DNA, 20 bp, Artificial Sequence
  sgRNA
ctggccatgtggctgtataa

SEQ ID NO: 13236 - DNA, 20 bp, Artificial Sequence
  sgRNA
taactggcaccgccctgcgg

SEQ ID NO: 13237 - DNA, 20 bp, Artificial Sequence
  sgRNA
taaatgttgctctccagctt

SEQ ID NO: 13238 - DNA, 20 bp, Artificial Sequence
  sgRNA
gcctagggctgtctggtcag

SEQ ID NO: 13239 - DNA, 20 bp, Artificial Sequence
  sgRNA
gcttcttcctccacgtgtcc

SEQ ID NO: 13240 - DNA, 20 bp, Artificial Sequence
  sgRNA
gcgaattcgcacggcccgat

SEQ ID NO: 13241 - DNA, 20 bp, Artificial Sequence
  sgRNA
gagggtagggctgagcttgc

SEQ ID NO: 13242 - DNA, 20 bp, Artificial Sequence
  sgRNA
aatctgaatccacagctccc

SEQ ID NO: 13243 - DNA, 20 bp, Artificial Sequence
  sgRNA
ctacccagggagaaagacac

SEQ ID NO: 13244 - DNA, 20 bp, Artificial Sequence
  sgRNA
tagacacacctacttgtggg

SEQ ID NO: 13245 - DNA, 20 bp, Artificial Sequence
  sgRNA
ttaatctgcaacatcagctt

SEQ ID NO: 13246 - DNA, 20 bp, Artificial Sequence
  sgRNA
aaatctctagtatctagtct

SEQ ID NO: 13247 - DNA, 20 bp, Artificial Sequence
  sgRNA
tgccagcgcattcgctcctc

SEQ ID NO: 13248 - DNA, 20 bp, Artificial Sequence
  sgRNA
taaagaggctcatttgctct

SEQ ID NO: 13249 - DNA, 20 bp, Artificial Sequence
  sgRNA
gcatgtgggtgtacaccgct

SEQ ID NO: 13250 - DNA, 20 bp, Artificial Sequence
  sgRNA
gtacttaaggccctatcaag

SEQ ID NO: 13251 - DNA, 20 bp, Artificial Sequence
  sgRNA
ccgtggaagatcgtccgtgg

SEQ ID NO: 13252 - DNA, 20 bp, Artificial Sequence
  sgRNA
gggtgcagagacctggtgcg

SEQ ID NO: 13253 - DNA, 20 bp, Artificial Sequence
  sgRNA
ggtaccgcgctgaaccaccg

SEQ ID NO: 13254 - DNA, 20 bp, Artificial Sequence
  sgRNA
gaccggacacagactgcggc

SEQ ID NO: 13255 - DNA, 20 bp, Artificial Sequence
  sgRNA
gggctttccagccgggcggc

SEQ ID NO: 13256 - DNA, 20 bp, Artificial Sequence
  sgRNA
ccaaggcaaggctgtcctca

SEQ ID NO: 13257 - DNA, 20 bp, Artificial Sequence
  sgRNA
atcttcaagatcctggttgg

SEQ ID NO: 13258 - DNA, 20 bp, Artificial Sequence
  sgRNA
cgcttcctccctgtgatgaa

SEQ ID NO: 13259 - DNA, 20 bp, Artificial Sequence
  sgRNA
gctgggtgaatgacgtaaga

SEQ ID NO: 13260 - DNA, 20 bp, Artificial Sequence
  sgRNA
ctggcctgccgaaagagaag

SEQ ID NO: 13261 - DNA, 20 bp, Artificial Sequence
  sgRNA
cacgtcagtggaaggcccgg

SEQ ID NO: 13262 - DNA, 20 bp, Artificial Sequence
  sgRNA
ggcgattcgccacgctaggc

SEQ ID NO: 13263 - DNA, 20 bp, Artificial Sequence
  sgRNA
agtgactgatcctgggaacg

SEQ ID NO: 13264 - DNA, 20 bp, Artificial Sequence
  sgRNA
atgggcgagaccatctgcgg

SEQ ID NO: 13265 - DNA, 20 bp, Artificial Sequence
  sgRNA
tgtagaaagctcccgtgtgg

SEQ ID NO: 13266 - DNA, 20 bp, Artificial Sequence
  sgRNA
tgcgccgagtaggaagtgac

SEQ ID NO: 13267 - DNA, 20 bp, Artificial Sequence
  sgRNA
ggcttctgctccaaatagtg

SEQ ID NO: 13268 - DNA, 20 bp, Artificial Sequence
  sgRNA
cttcgctcagctactcttta

SEQ ID NO: 13269 - DNA, 20 bp, Artificial Sequence
  sgRNA
tccttacctaaactccaaga

SEQ ID NO: 13270 - DNA, 20 bp, Artificial Sequence
  sgRNA
gagtaaatgttcccaccagg

SEQ ID NO: 13271 - DNA, 20 bp, Artificial Sequence
  sgRNA
acccagtggtcttcagcaga

SEQ ID NO: 13272 - DNA, 20 bp, Artificial Sequence
  sgRNA
tcctccttgactcggaggcc

SEQ ID NO: 13273 - DNA, 20 bp, Artificial Sequence
  sgRNA
tgcccggtggcccagcatcc

SEQ ID NO: 13274 - DNA, 20 bp, Artificial Sequence
  sgRNA
gggatgttcgtaggctgggc

SEQ ID NO: 13275 - DNA, 20 bp, Artificial Sequence
  sgRNA
gaacatggataccgcgtccg

SEQ ID NO: 13276 - DNA, 20 bp, Artificial Sequence
  sgRNA
cgggaaacatgagaaggctt

SEQ ID NO: 13277 - DNA, 20 bp, Artificial Sequence
  sgRNA
atgaaccgggagtaataaag

SEQ ID NO: 13278 - DNA, 20 bp, Artificial Sequence
  sgRNA
tgaaagacggccaagcaaag

SEQ ID NO: 13279 - DNA, 20 bp, Artificial Sequence
  sgRNA
gaggtaatgggcgcgttgag

SEQ ID NO: 13280 - DNA, 20 bp, Artificial Sequence
  sgRNA
ggcgcaggtgtattgcacca

SEQ ID NO: 13281 - DNA, 20 bp, Artificial Sequence
  sgRNA
tcccggagtctggctgcgtt

SEQ ID NO: 13282 - DNA, 20 bp, Artificial Sequence
  sgRNA
gggtggcagagaaggcagta

SEQ ID NO: 13283 - DNA, 20 bp, Artificial Sequence
  sgRNA
gcctcctccgggacggcggg

SEQ ID NO: 13284 - DNA, 20 bp, Artificial Sequence
  sgRNA
ggctccgcccggccgtcggg

SEQ ID NO: 13285 - DNA, 20 bp, Artificial Sequence
  sgRNA
agcgggctggtgtgggctcg

SEQ ID NO: 13286 - DNA, 20 bp, Artificial Sequence
  sgRNA
caaggctaatctctgtgcag

SEQ ID NO: 13287 - DNA, 20 bp, Artificial Sequence
  sgRNA
gtgggtccagtcattagaag

SEQ ID NO: 13288 - DNA, 20 bp, Artificial Sequence
  sgRNA
cggagttctttagggcgcat

SEQ ID NO: 13289 - DNA, 20 bp, Artificial Sequence
  sgRNA
gggatgcagacttgttcctc

SEQ ID NO: 13290 - DNA, 20 bp, Artificial Sequence
  sgRNA
ttatagcttgttgcccgcgg

SEQ ID NO: 13291 - DNA, 20 bp, Artificial Sequence
  sgRNA
agcgcgcgtggtgcgcactg

SEQ ID NO: 13292 - DNA, 20 bp, Artificial Sequence
  sgRNA
agggtcacacattcatatgc

SEQ ID NO: 13293 - DNA, 20 bp, Artificial Sequence
  sgRNA
agatttcctccaggtgcttg

SEQ ID NO: 13294 - DNA, 20 bp, Artificial Sequence
  sgRNA
ccaaatccttccatcaaagt

SEQ ID NO: 13295 - DNA, 20 bp, Artificial Sequence
  sgRNA
cattggccaataagacacgc

SEQ ID NO: 13296 - DNA, 20 bp, Artificial Sequence
  sgRNA
agtaaagctccgggctgctc

SEQ ID NO: 13297 - DNA, 20 bp, Artificial Sequence
  sgRNA
caacgcttgcgcgggtacgc

SEQ ID NO: 13298 - DNA, 20 bp, Artificial Sequence
  sgRNA
tgagggccacgagacaatcg

SEQ ID NO: 13299 - DNA, 20 bp, Artificial Sequence
  sgRNA
cccgcgcgtcgtggcctcgg

SEQ ID NO: 13300 - DNA, 20 bp, Artificial Sequence
  sgRNA
gtcttgaccctgggcctctc

SEQ ID NO: 13301 - DNA, 20 bp, Artificial Sequence
  sgRNA
tattatgaacacgtgagtat

SEQ ID NO: 13302 - DNA, 20 bp, Artificial Sequence
  sgRNA
cacgacaccttgcagctttc

SEQ ID NO: 13303 - DNA, 20 bp, Artificial Sequence
  sgRNA
tgcacgcagaaatcaaggaa

SEQ ID NO: 13304 - DNA, 20 bp, Artificial Sequence
  sgRNA
acaattcccatggtcaaata

SEQ ID NO: 13305 - DNA, 20 bp, Artificial Sequence
  sgRNA
gttagaagtgtttgcataag

SEQ ID NO: 13306 - DNA, 20 bp, Artificial Sequence
  sgRNA
ccctctccaaagagctccca

SEQ ID NO: 13307 - DNA, 20 bp, Artificial Sequence
  sgRNA
ttggcttgatatcagagagt

SEQ ID NO: 13308 - DNA, 20 bp, Artificial Sequence
  sgRNA
gccagggcatcccaagagct

SEQ ID NO: 13309 - DNA, 20 bp, Artificial Sequence
  sgRNA
gtgccaggtcctggttctcc

SEQ ID NO: 13310 - DNA, 20 bp, Artificial Sequence
  sgRNA
gggcctctgtgacttagtgc

SEQ ID NO: 13311 - DNA, 20 bp, Artificial Sequence
  sgRNA
cagtggtgacgctcttctaa

SEQ ID NO: 13312 - DNA, 20 bp, Artificial Sequence
  sgRNA
ttcgcctatgtccagccctc

SEQ ID NO: 13313 - DNA, 20 bp, Artificial Sequence
  sgRNA
tgcattcctaacgtccagct

SEQ ID NO: 13314 - DNA, 20 bp, Artificial Sequence
  sgRNA
acccagcggtgcagaaggcg

SEQ ID NO: 13315 - DNA, 20 bp, Artificial Sequence
  sgRNA
ctgcagaccaggcttgaagg

SEQ ID NO: 13316 - DNA, 20 bp, Artificial Sequence
  sgRNA
ttgcagatcctgcagtaggc

SEQ ID NO: 13317 - DNA, 20 bp, Artificial Sequence
  sgRNA
gtggtagctgggatacatac

SEQ ID NO: 13318 - DNA, 20 bp, Artificial Sequence
  sgRNA
aggaagttggccagtttatg

SEQ ID NO: 13319 - DNA, 20 bp, Artificial Sequence
  sgRNA
gctcagtagtaggtaagagg

SEQ ID NO: 13320 - DNA, 20 bp, Artificial Sequence
  sgRNA
actcatagtcagtgtgggtg

SEQ ID NO: 13321 - DNA, 20 bp, Artificial Sequence
  sgRNA
ttcttctattacaggtggcc

SEQ ID NO: 13322 - DNA, 20 bp, Artificial Sequence
  sgRNA
aaagagtgtcacttgctgga

SEQ ID NO: 13323 - DNA, 20 bp, Artificial Sequence
  sgRNA
gtggagtagcaagcagttgc

SEQ ID NO: 13324 - DNA, 20 bp, Artificial Sequence
  sgRNA
tttccaaacccttctgcaga

SEQ ID NO: 13325 - DNA, 20 bp, Artificial Sequence
  sgRNA
cacggagggcacgtgactag

SEQ ID NO: 13326 - DNA, 20 bp, Artificial Sequence
  sgRNA
agtaagttatccgggaccct

SEQ ID NO: 13327 - DNA, 20 bp, Artificial Sequence
  sgRNA
aggagtatatgtttaagcag

SEQ ID NO: 13328 - DNA, 20 bp, Artificial Sequence
  sgRNA
ccaaattaacccattattgt

SEQ ID NO: 13329 - DNA, 20 bp, Artificial Sequence
  sgRNA
tgactttgaggccctcaagg

SEQ ID NO: 13330 - DNA, 20 bp, Artificial Sequence
  sgRNA
tgaagacagttaggcttctc

SEQ ID NO: 13331 - DNA, 20 bp, Artificial Sequence
  sgRNA
cctcactaaggttggagtgg

SEQ ID NO: 13332 - DNA, 20 bp, Artificial Sequence
  sgRNA
gtttccgtccgctcactagg

SEQ ID NO: 13333 - DNA, 20 bp, Artificial Sequence
  sgRNA
ctgctcatttctaggtttat

SEQ ID NO: 13334 - DNA, 20 bp, Artificial Sequence
  sgRNA
ctaagcaagagagaagtgca

SEQ ID NO: 13335 - DNA, 20 bp, Artificial Sequence
  sgRNA
tggtagacagcgacaccctg

SEQ ID NO: 13336 - DNA, 20 bp, Artificial Sequence
  sgRNA
ccaagagagagatcactctc

SEQ ID NO: 13337 - DNA, 20 bp, Artificial Sequence
  sgRNA
attctaaccagtttagccac

SEQ ID NO: 13338 - DNA, 20 bp, Artificial Sequence
  sgRNA
ccacattggacggctgggag

SEQ ID NO: 13339 - DNA, 20 bp, Artificial Sequence
  sgRNA
gtgcaaggcacgcagagtgg

SEQ ID NO: 13340 - DNA, 20 bp, Artificial Sequence
  sgRNA
gggcccaaagggcagatctg

SEQ ID NO: 13341 - DNA, 20 bp, Artificial Sequence
  sgRNA
tgacctcataatgttaacat

SEQ ID NO: 13342 - DNA, 20 bp, Artificial Sequence
  sgRNA
tacacacaccctgcaggagg

SEQ ID NO: 13343 - DNA, 20 bp, Artificial Sequence
  sgRNA
ctgtaagtcccacagcagat

SEQ ID NO: 13344 - DNA, 20 bp, Artificial Sequence
  sgRNA
gctggagatgtagggatggg

SEQ ID NO: 13345 - DNA, 20 bp, Artificial Sequence
  sgRNA
gggagtctcatgctcagatc

SEQ ID NO: 13346 - DNA, 20 bp, Artificial Sequence
  sgRNA
catcaagatccttagggatg

SEQ ID NO: 13347 - DNA, 20 bp, Artificial Sequence
  sgRNA
ggagctgcggctaagcgcgc

SEQ ID NO: 13348 - DNA, 20 bp, Artificial Sequence
  sgRNA
gggtcccacgggcgggcgcg

SEQ ID NO: 13349 - DNA, 20 bp, Artificial Sequence
  sgRNA
caccggcgcttcacccgctg

SEQ ID NO: 13350 - DNA, 20 bp, Artificial Sequence
  sgRNA
aaatttgggcagtgtgcaag

SEQ ID NO: 13351 - DNA, 20 bp, Artificial Sequence
  sgRNA
ttggcactttgacaaatgcc

SEQ ID NO: 13352 - DNA, 20 bp, Artificial Sequence
  sgRNA
acagggatacagccagtaca

SEQ ID NO: 13353 - DNA, 20 bp, Artificial Sequence
  sgRNA
tggctgtcccgtcttaatga

SEQ ID NO: 13354 - DNA, 20 bp, Artificial Sequence
  sgRNA
gctgaatgagaatcagccct

SEQ ID NO: 13355 - DNA, 20 bp, Artificial Sequence
  sgRNA
aattgtgggatgccagagcg

SEQ ID NO: 13356 - DNA, 20 bp, Artificial Sequence
  sgRNA
cgcagggctgcagaattaga

SEQ ID NO: 13357 - DNA, 20 bp, Artificial Sequence
  sgRNA
ccctgcgtttctccttgtat

SEQ ID NO: 13358 - DNA, 20 bp, Artificial Sequence
  sgRNA
aaggaagaggcgccggcgca

SEQ ID NO: 13359 - DNA, 20 bp, Artificial Sequence
  sgRNA
ccgggcggctcgtcgtgccg

SEQ ID NO: 13360 - DNA, 20 bp, Artificial Sequence
  sgRNA
gtgcatggctcgagccgccg

SEQ ID NO: 13361 - DNA, 20 bp, Artificial Sequence
  sgRNA
catgacatccaaccagcagg

SEQ ID NO: 13362 - DNA, 20 bp, Artificial Sequence
  sgRNA
tccgttctcttggcctagag

SEQ ID NO: 13363 - DNA, 20 bp, Artificial Sequence
  sgRNA
tcggtgataggaagtcgagg

SEQ ID NO: 13364 - DNA, 20 bp, Artificial Sequence
  sgRNA
aggtgtgtttgacaatgaat

SEQ ID NO: 13365 - DNA, 20 bp, Artificial Sequence
  sgRNA
aaagctactgcgaaccacct

SEQ ID NO: 13366 - DNA, 20 bp, Artificial Sequence
  sgRNA
tagtcgcgtgctgccacacc

SEQ ID NO: 13367 - DNA, 20 bp, Artificial Sequence
  sgRNA
aggagccgaccgagcgcccg

SEQ ID NO: 13368 - DNA, 20 bp, Artificial Sequence
  sgRNA
cgagtcggcacctgccggcc

SEQ ID NO: 13369 - DNA, 20 bp, Artificial Sequence
  sgRNA
ttactcagacctggcgaaac

SEQ ID NO: 13370 - DNA, 20 bp, Artificial Sequence
  sgRNA
agagagtatactatccttgt

SEQ ID NO: 13371 - DNA, 20 bp, Artificial Sequence
  sgRNA
catgccaagactaatttatg

SEQ ID NO: 13372 - DNA, 20 bp, Artificial Sequence
  sgRNA
ctcatatatgagagacagag

SEQ ID NO: 13373 - DNA, 20 bp, Artificial Sequence
  sgRNA
gtgttgaaagcatactcagc

SEQ ID NO: 13374 - DNA, 20 bp, Artificial Sequence
  sgRNA
gctagtatgtcagtttcgag

SEQ ID NO: 13375 - DNA, 20 bp, Artificial Sequence
  sgRNA
ttaaaccctttctcaacatg

SEQ ID NO: 13376 - DNA, 20 bp, Artificial Sequence
  sgRNA
ctacgtgcaccgcctcacgc

SEQ ID NO: 13377 - DNA, 20 bp, Artificial Sequence
  sgRNA
gtaggcgactcggagggtgg

SEQ ID NO: 13378 - DNA, 20 bp, Artificial Sequence
  sgRNA
cgaggaagcttctggaaccc

SEQ ID NO: 13379 - DNA, 20 bp, Artificial Sequence
  sgRNA
gcgcgcgcgggtgtgtggcg

SEQ ID NO: 13380 - DNA, 20 bp, Artificial Sequence
  sgRNA
gggaacctctgtacatgatc

SEQ ID NO: 13381 - DNA, 20 bp, Artificial Sequence
  sgRNA
gcagggctccgcagcgagag

SEQ ID NO: 13382 - DNA, 20 bp, Artificial Sequence
  sgRNA
ggcaagagcctgtcttacgg

SEQ ID NO: 13383 - DNA, 20 bp, Artificial Sequence
  sgRNA
taagggtcatttcccgtcaa

SEQ ID NO: 13384 - DNA, 20 bp, Artificial Sequence
  sgRNA
ccaccaatgagacgcgaagt

SEQ ID NO: 13385 - DNA, 20 bp, Artificial Sequence
  sgRNA
agtctcgtgctctacagctc

SEQ ID NO: 13386 - DNA, 20 bp, Artificial Sequence
  sgRNA
atataaatgtatccggcgtg

SEQ ID NO: 13387 - DNA, 20 bp, Artificial Sequence
  sgRNA
tgcgcgggaaatcacgtcga

SEQ ID NO: 13388 - DNA, 20 bp, Artificial Sequence
  sgRNA
ctcgccggtcgagtgtgagc

SEQ ID NO: 13389 - DNA, 20 bp, Artificial Sequence
  sgRNA
gagcactttggtagagtgga

SEQ ID NO: 13390 - DNA, 20 bp, Artificial Sequence
  sgRNA
cttgcgttcagctgtcaccc

SEQ ID NO: 13391 - DNA, 20 bp, Artificial Sequence
  sgRNA
agatgattgggttctccttt

SEQ ID NO: 13392 - DNA, 20 bp, Artificial Sequence
  sgRNA
tttaaaggtcaacataagtc

SEQ ID NO: 13393 - DNA, 20 bp, Artificial Sequence
  sgRNA
gttgctgagggcggacgcta

SEQ ID NO: 13394 - DNA, 20 bp, Artificial Sequence
  sgRNA
ccttgtccatcccgaaacgt

SEQ ID NO: 13395 - DNA, 20 bp, Artificial Sequence
  sgRNA
aaggatggacccgagaaggg

SEQ ID NO: 13396 - DNA, 20 bp, Artificial Sequence
  sgRNA
ggtgaaagaccatctttctg

SEQ ID NO: 13397 - DNA, 20 bp, Artificial Sequence
  sgRNA
agtttagagggtctgggtgc

SEQ ID NO: 13398 - DNA, 20 bp, Artificial Sequence
  sgRNA
aagggagtgtgcggagtcta

SEQ ID NO: 13399 - DNA, 20 bp, Artificial Sequence
  sgRNA
gctgacgctgctattagtct

SEQ ID NO: 13400 - DNA, 20 bp, Artificial Sequence
  sgRNA
gcgctgagctcgccctccgg

SEQ ID NO: 13401 - DNA, 20 bp, Artificial Sequence
  sgRNA
tgtattaaaggagctgcggc

SEQ ID NO: 13402 - DNA, 20 bp, Artificial Sequence
  sgRNA
cgctagctgccttgtactgc

SEQ ID NO: 13403 - DNA, 20 bp, Artificial Sequence
  sgRNA
ttaacttgctagctctgggc

SEQ ID NO: 13404 - DNA, 20 bp, Artificial Sequence
  sgRNA
catgccagggcattccagct

SEQ ID NO: 13405 - DNA, 20 bp, Artificial Sequence
  sgRNA
tttcctctagagagatctaa

SEQ ID NO: 13406 - DNA, 20 bp, Artificial Sequence
  sgRNA
aagtcactcaagcccaagcc

SEQ ID NO: 13407 - DNA, 20 bp, Artificial Sequence
  sgRNA
atattctctgatgacacagc

SEQ ID NO: 13408 - DNA, 20 bp, Artificial Sequence
  sgRNA
ggcctccaggtctccaactg

SEQ ID NO: 13409 - DNA, 20 bp, Artificial Sequence
  sgRNA
gggttaagcgatgttagcct

SEQ ID NO: 13410 - DNA, 20 bp, Artificial Sequence
  sgRNA
tgtgtgactgtaggagtgca

SEQ ID NO: 13411 - DNA, 20 bp, Artificial Sequence
  sgRNA
cggctgggctccacccttga

SEQ ID NO: 13412 - DNA, 20 bp, Artificial Sequence
  sgRNA
gtggctggctgactaggttt

SEQ ID NO: 13413 - DNA, 20 bp, Artificial Sequence
  sgRNA
cacctgcgtcagatgctagc

SEQ ID NO: 13414 - DNA, 20 bp, Artificial Sequence
  sgRNA
gaaaggtgcccgaactccct

SEQ ID NO: 13415 - DNA, 20 bp, Artificial Sequence
  sgRNA
acggtggcgtggaggattct

SEQ ID NO: 13416 - DNA, 20 bp, Artificial Sequence
  sgRNA
gccgaaccacaggacttgac

SEQ ID NO: 13417 - DNA, 20 bp, Artificial Sequence
  sgRNA
gtccgtcgcccgttcactag

SEQ ID NO: 13418 - DNA, 20 bp, Artificial Sequence
  sgRNA
gaagcgggtaggcaagaaag

SEQ ID NO: 13419 - DNA, 20 bp, Artificial Sequence
  sgRNA
ggctggcgtgattgttgccg

SEQ ID NO: 13420 - DNA, 20 bp, Artificial Sequence
  sgRNA
gactcaactcgacgcgctat

SEQ ID NO: 13421 - DNA, 20 bp, Artificial Sequence
  sgRNA
gggaactgagtgggttcttg

SEQ ID NO: 13422 - DNA, 20 bp, Artificial Sequence
  sgRNA
gggcttctcctgagtggctt

SEQ ID NO: 13423 - DNA, 20 bp, Artificial Sequence
  sgRNA
cccattctcctctggtgcat

SEQ ID NO: 13424 - DNA, 20 bp, Artificial Sequence
  sgRNA
gggcgtgcgggaggatcgca

SEQ ID NO: 13425 - DNA, 20 bp, Artificial Sequence
  sgRNA
gacgacagtaccgcgggccg

SEQ ID NO: 13426 - DNA, 20 bp, Artificial Sequence
  sgRNA
gcaaagtttactcggaagcc

SEQ ID NO: 13427 - DNA, 20 bp, Artificial Sequence
  sgRNA
gtggcagacacactgtgtgc

SEQ ID NO: 13428 - DNA, 20 bp, Artificial Sequence
  sgRNA
gtggttgccacagtactgct

SEQ ID NO: 13429 - DNA, 20 bp, Artificial Sequence
  sgRNA
agagtcgtgcgggcatagag

SEQ ID NO: 13430 - DNA, 20 bp, Artificial Sequence
  sgRNA
agaggacattgtgccttagg

SEQ ID NO: 13431 - DNA, 20 bp, Artificial Sequence
  sgRNA
aagactggctgagtcaatcc

SEQ ID NO: 13432 - DNA, 20 bp, Artificial Sequence
  sgRNA
tagcggatgggcgggctcta

SEQ ID NO: 13433 - DNA, 20 bp, Artificial Sequence
  sgRNA
aactggatttcgggaagccc

SEQ ID NO: 13434 - DNA, 20 bp, Artificial Sequence
  sgRNA
gggtcttgccaaacggccag

SEQ ID NO: 13435 - DNA, 20 bp, Artificial Sequence
  sgRNA
ggcagcggccgatgtagccg

SEQ ID NO: 13436 - DNA, 20 bp, Artificial Sequence
  sgRNA
ataagagttagggctgcctg

SEQ ID NO: 13437 - DNA, 20 bp, Artificial Sequence
  sgRNA
cccatcagggccctctgagg

SEQ ID NO: 13438 - DNA, 20 bp, Artificial Sequence
  sgRNA
ccctgagagcgaagaagagt

SEQ ID NO: 13439 - DNA, 20 bp, Artificial Sequence
  sgRNA
acttgaaacttcaagtgacc

SEQ ID NO: 13440 - DNA, 20 bp, Artificial Sequence
  sgRNA
taatgctggctacctcagtt

SEQ ID NO: 13441 - DNA, 20 bp, Artificial Sequence
  sgRNA
cagtagtggcgctggatccc

SEQ ID NO: 13442 - DNA, 20 bp, Artificial Sequence
  sgRNA
cgggagttgcaagtaagcgc

SEQ ID NO: 13443 - DNA, 20 bp, Artificial Sequence
  sgRNA
cagggcgaagtccacgtcgc

SEQ ID NO: 13444 - DNA, 20 bp, Artificial Sequence
  sgRNA
aggaccgcatctggtgcgcc

SEQ ID NO: 13445 - DNA, 20 bp, Artificial Sequence
  sgRNA
ccatgacacttgtgtcccgc

SEQ ID NO: 13446 - DNA, 20 bp, Artificial Sequence
  sgRNA
ggagcatgcgcaaatcagcc

SEQ ID NO: 13447 - DNA, 20 bp, Artificial Sequence
  sgRNA
acctctccggtctaccgtcg

SEQ ID NO: 13448 - DNA, 20 bp, Artificial Sequence
  sgRNA
tgcaaatgtggccactggac

SEQ ID NO: 13449 - DNA, 20 bp, Artificial Sequence
  sgRNA
cctttgggtgtcgtttgtga

SEQ ID NO: 13450 - DNA, 20 bp, Artificial Sequence
  sgRNA
aaagacaggtctcctcacac

SEQ ID NO: 13451 - DNA, 20 bp, Artificial Sequence
  sgRNA
caggtacatcccatgggcgt

SEQ ID NO: 13452 - DNA, 20 bp, Artificial Sequence
  sgRNA
gggtgtctggatgacgcgag

SEQ ID NO: 13453 - DNA, 20 bp, Artificial Sequence
  sgRNA
aacaaggcggagcgagatga

SEQ ID NO: 13454 - DNA, 20 bp, Artificial Sequence
  sgRNA
ctgagcctttgttaataggt

SEQ ID NO: 13455 - DNA, 20 bp, Artificial Sequence
  sgRNA
ggcttccttgccctttggat

SEQ ID NO: 13456 - DNA, 20 bp, Artificial Sequence
  sgRNA
ggatgcctgcaactgtttgc

SEQ ID NO: 13457 - DNA, 20 bp, Artificial Sequence
  sgRNA
ctcttaaagtacaaatgcga

SEQ ID NO: 13458 - DNA, 20 bp, Artificial Sequence
  sgRNA
aatgacaccttgcgtgcgtg

SEQ ID NO: 13459 - DNA, 20 bp, Artificial Sequence
  sgRNA
tgagaatcaaagtgagtatc

SEQ ID NO: 13460 - DNA, 20 bp, Artificial Sequence
  sgRNA
cccataggatggcagctctc

SEQ ID NO: 13461 - DNA, 20 bp, Artificial Sequence
  sgRNA
tttagcagtgggtttagaac

SEQ ID NO: 13462 - DNA, 20 bp, Artificial Sequence
  sgRNA
atcaatgtctgagaatcagc

SEQ ID NO: 13463 - DNA, 20 bp, Artificial Sequence
  sgRNA
gccgtcccgcaagcgctgat

SEQ ID NO: 13464 - DNA, 20 bp, Artificial Sequence
  sgRNA
gttatggaacattcggcgcc

SEQ ID NO: 13465 - DNA, 20 bp, Artificial Sequence
  sgRNA
tatgcattgttattcaccct

SEQ ID NO: 13466 - DNA, 20 bp, Artificial Sequence
  sgRNA
cggttgagccggcgccgcca

SEQ ID NO: 13467 - DNA, 20 bp, Artificial Sequence
  sgRNA
gacaaactggcgagcacgga

SEQ ID NO: 13468 - DNA, 20 bp, Artificial Sequence
  sgRNA
aggcaaagacccaggcagtg

SEQ ID NO: 13469 - DNA, 20 bp, Artificial Sequence
  sgRNA
tctcgagcgctcgctctcgt

SEQ ID NO: 13470 - DNA, 20 bp, Artificial Sequence
  sgRNA
gacctgtcctgaaggagcct

SEQ ID NO: 13471 - DNA, 20 bp, Artificial Sequence
  sgRNA
tgaggcgtcactaaatggag

SEQ ID NO: 13472 - DNA, 20 bp, Artificial Sequence
  sgRNA
tatagttgcagcagactctg

SEQ ID NO: 13473 - DNA, 20 bp, Artificial Sequence
  sgRNA
aacctaatccgctgttcctg

SEQ ID NO: 13474 - DNA, 20 bp, Artificial Sequence
  sgRNA
tggcagcacagctgggattt

SEQ ID NO: 13475 - DNA, 20 bp, Artificial Sequence
  sgRNA
ctgttagttgctgcagctcc

SEQ ID NO: 13476 - DNA, 20 bp, Artificial Sequence
  sgRNA
gcttggatcccgccagatcc

SEQ ID NO: 13477 - DNA, 20 bp, Artificial Sequence
  sgRNA
cgctatgtgtcggtgtgctg

SEQ ID NO: 13478 - DNA, 20 bp, Artificial Sequence
  sgRNA
cgtcaggcagtatcaggcca

SEQ ID NO: 13479 - DNA, 20 bp, Artificial Sequence
  sgRNA
cttgtttgactgcttcacct

SEQ ID NO: 13480 - DNA, 20 bp, Artificial Sequence
  sgRNA
gtggtggcggctgtaggtac

SEQ ID NO: 13481 - DNA, 20 bp, Artificial Sequence
  sgRNA
tcatctcatgattaggccac

SEQ ID NO: 13482 - DNA, 20 bp, Artificial Sequence
  sgRNA
gcttgaactaaggctatgta

SEQ ID NO: 13483 - DNA, 20 bp, Artificial Sequence
  sgRNA
tgtaatctgatagttgagtc

SEQ ID NO: 13484 - DNA, 20 bp, Artificial Sequence
  sgRNA
aattgactgctgcgatggct

SEQ ID NO: 13485 - DNA, 20 bp, Artificial Sequence
  sgRNA
cagaagtgctctgcagcgcc

SEQ ID NO: 13486 - DNA, 20 bp, Artificial Sequence
  sgRNA
cgcccaactctcgcgatacc

SEQ ID NO: 13487 - DNA, 20 bp, Artificial Sequence
  sgRNA
aagacgcgagcgacagctga

SEQ ID NO: 13488 - DNA, 20 bp, Artificial Sequence
  sgRNA
tccgcagagtggcagccgga

SEQ ID NO: 13489 - DNA, 20 bp, Artificial Sequence
  sgRNA
agagactacggaacgccgcg

SEQ ID NO: 13490 - DNA, 20 bp, Artificial Sequence
  sgRNA
gggcaggtaggctgatcttc

SEQ ID NO: 13491 - DNA, 20 bp, Artificial Sequence
  sgRNA
tcgcactcggtcagttattt

SEQ ID NO: 13492 - DNA, 20 bp, Artificial Sequence
  sgRNA
gctgcacaccttactacaca

SEQ ID NO: 13493 - DNA, 20 bp, Artificial Sequence
  sgRNA
tactgccagaacaatcttgc

SEQ ID NO: 13494 - DNA, 20 bp, Artificial Sequence
  sgRNA
actgggcctcaaggaagatg

SEQ ID NO: 13495 - DNA, 20 bp, Artificial Sequence
  sgRNA
aggtctgatttggcaggagc

SEQ ID NO: 13496 - DNA, 20 bp, Artificial Sequence
  sgRNA
tttcacgttattccgcccag

SEQ ID NO: 13497 - DNA, 20 bp, Artificial Sequence
  sgRNA
actcaccagctaccaagccc

SEQ ID NO: 13498 - DNA, 20 bp, Artificial Sequence
  sgRNA
cggattccgtgacgccagcc

SEQ ID NO: 13499 - DNA, 20 bp, Artificial Sequence
  sgRNA
gtggcacagactgcaccatg

SEQ ID NO: 13500 - DNA, 20 bp, Artificial Sequence
  sgRNA
ggcaagtggagatgtgggcg

SEQ ID NO: 13501 - DNA, 20 bp, Artificial Sequence
  sgRNA
aaagccttaactcaggaatg

SEQ ID NO: 13502 - DNA, 20 bp, Artificial Sequence
  sgRNA
actgggacttctggtcacta

SEQ ID NO: 13503 - DNA, 20 bp, Artificial Sequence
  sgRNA
ggctctaacaacgggaattt

SEQ ID NO: 13504 - DNA, 20 bp, Artificial Sequence
  sgRNA
tgctaagaaacagggcattc

SEQ ID NO: 13505 - DNA, 20 bp, Artificial Sequence
  sgRNA
gggcccggcagaaacctggg

SEQ ID NO: 13506 - DNA, 20 bp, Artificial Sequence
  sgRNA
gttgttgttgtggtgcgcgc

SEQ ID NO: 13507 - DNA, 20 bp, Artificial Sequence
  sgRNA
attatattgtatgggattgg

SEQ ID NO: 13508 - DNA, 20 bp, Artificial Sequence
  sgRNA
caattcaagtccaaagtcga

SEQ ID NO: 13509 - DNA, 20 bp, Artificial Sequence
  sgRNA
ccagacccgcgcttagattt

SEQ ID NO: 13510 - DNA, 20 bp, Artificial Sequence
  sgRNA
ggctgtccagtacttaactc

SEQ ID NO: 13511 - DNA, 20 bp, Artificial Sequence
  sgRNA
acttccagtatggtcagctc

SEQ ID NO: 13512 - DNA, 20 bp, Artificial Sequence
  sgRNA
tgagaagtgagtaatgacac

SEQ ID NO: 13513 - DNA, 20 bp, Artificial Sequence
  sgRNA
ctatttctgctgagaagtac

SEQ ID NO: 13514 - DNA, 20 bp, Artificial Sequence
  sgRNA
ggcttgtgcactgagaccca

SEQ ID NO: 13515 - DNA, 20 bp, Artificial Sequence
  sgRNA
cctccgggaggatcctgtcc

SEQ ID NO: 13516 - DNA, 20 bp, Artificial Sequence
  sgRNA
tggtgtttgtgaggagcggt

SEQ ID NO: 13517 - DNA, 20 bp, Artificial Sequence
  sgRNA
cctggcctcctttatagggc

SEQ ID NO: 13518 - DNA, 20 bp, Artificial Sequence
  sgRNA
atacaccctatgctcatcct

SEQ ID NO: 13519 - DNA, 20 bp, Artificial Sequence
  sgRNA
actagacacatccggaggcg

SEQ ID NO: 13520 - DNA, 20 bp, Artificial Sequence
  sgRNA
ctagataaccgtccaaccag

SEQ ID NO: 13521 - DNA, 20 bp, Artificial Sequence
  sgRNA
ctcttcccaggatcagcgcg

SEQ ID NO: 13522 - DNA, 20 bp, Artificial Sequence
  sgRNA
tatggcagcggcgagccgtc

SEQ ID NO: 13523 - DNA, 20 bp, Artificial Sequence
  sgRNA
cgggtctgcgcaccgcacgg

SEQ ID NO: 13524 - DNA, 20 bp, Artificial Sequence
  sgRNA
agtcgccgcggcgccgacga

SEQ ID NO: 13525 - DNA, 20 bp, Artificial Sequence
  sgRNA
tcgctcggaacgcgttccgg

SEQ ID NO: 13526 - DNA, 20 bp, Artificial Sequence
  sgRNA
tgtcagttgggagggtgaac

SEQ ID NO: 13527 - DNA, 20 bp, Artificial Sequence
  sgRNA
aatcgatatctgcaccaagc

SEQ ID NO: 13528 - DNA, 20 bp, Artificial Sequence
  sgRNA
ggagcaaatgggatatttgt

SEQ ID NO: 13529 - DNA, 20 bp, Artificial Sequence
  sgRNA
ggtgacctctcgcagccagc

SEQ ID NO: 13530 - DNA, 20 bp, Artificial Sequence
  sgRNA
cctccaagagcacttaattg

SEQ ID NO: 13531 - DNA, 20 bp, Artificial Sequence
  sgRNA
acccactcgagggctttagc

SEQ ID NO: 13532 - DNA, 20 bp, Artificial Sequence
  sgRNA
tgcactgcgcacaacttggg

SEQ ID NO: 13533 - DNA, 20 bp, Artificial Sequence
  sgRNA
ggcgtcggcttatgtgtctc

SEQ ID NO: 13534 - DNA, 20 bp, Artificial Sequence
  sgRNA
tctgtgtacgctgatgcctg

SEQ ID NO: 13535 - DNA, 20 bp, Artificial Sequence
  sgRNA
gcgggaaccggacagcttcc

SEQ ID NO: 13536 - DNA, 20 bp, Artificial Sequence
  sgRNA
tgtcaaccagcttgtggaaa

SEQ ID NO: 13537 - DNA, 20 bp, Artificial Sequence
  sgRNA
ggtaggcagaccactctgcc

SEQ ID NO: 13538 - DNA, 20 bp, Artificial Sequence
  sgRNA
ggaggaagtgctggtgcccg

SEQ ID NO: 13539 - DNA, 20 bp, Artificial Sequence
  sgRNA
tggaagttcatttagactgc

SEQ ID NO: 13540 - DNA, 20 bp, Artificial Sequence
  sgRNA
gttacgtcataccaccaccg

SEQ ID NO: 13541 - DNA, 20 bp, Artificial Sequence
  sgRNA
aaatattcagggtagagaag

SEQ ID NO: 13542 - DNA, 20 bp, Artificial Sequence
  sgRNA
ctctcatggtgtttgcaaag

SEQ ID NO: 13543 - DNA, 20 bp, Artificial Sequence
  sgRNA
ttccaccagagcaagcagga

SEQ ID NO: 13544 - DNA, 20 bp, Artificial Sequence
  sgRNA
ggtggcaattccgctccgtc

SEQ ID NO: 13545 - DNA, 20 bp, Artificial Sequence
  sgRNA
cactgctagagactcgattc

SEQ ID NO: 13546 - DNA, 20 bp, Artificial Sequence
  sgRNA
actagttctcttgcgcgcct

SEQ ID NO: 13547 - DNA, 20 bp, Artificial Sequence
  sgRNA
caggcggatatctgagtttg

SEQ ID NO: 13548 - DNA, 20 bp, Artificial Sequence
  sgRNA
ctgtgtagccctagctgtcc

SEQ ID NO: 13549 - DNA, 20 bp, Artificial Sequence
  sgRNA
ctcccaaatgctgggattaa

SEQ ID NO: 13550 - DNA, 20 bp, Artificial Sequence
  sgRNA
tgagattgccaagtttgaaa

SEQ ID NO: 13551 - DNA, 20 bp, Artificial Sequence
  sgRNA
gaggtaatgcagacccatac

SEQ ID NO: 13552 - DNA, 20 bp, Artificial Sequence
  sgRNA
cacttattgatgataggcca

SEQ ID NO: 13553 - DNA, 20 bp, Artificial Sequence
  sgRNA
actgcgcgggaggtagtgct

SEQ ID NO: 13554 - DNA, 20 bp, Artificial Sequence
  sgRNA
agcgtcaacgcctgagctag

SEQ ID NO: 13555 - DNA, 20 bp, Artificial Sequence
  sgRNA
ttggagaaagttcggcatgg

SEQ ID NO: 13556 - DNA, 20 bp, Artificial Sequence
  sgRNA
gggtgtggttcagagaataa

SEQ ID NO: 13557 - DNA, 20 bp, Artificial Sequence
  sgRNA
gcagataggagggaagactt

SEQ ID NO: 13558 - DNA, 20 bp, Artificial Sequence
  sgRNA
ctctttaatgtctgactgct

SEQ ID NO: 13559 - DNA, 20 bp, Artificial Sequence
  sgRNA
gaagcattctcatagaccag

SEQ ID NO: 13560 - DNA, 20 bp, Artificial Sequence
  sgRNA
agttgctctcagcggctaca

SEQ ID NO: 13561 - DNA, 20 bp, Artificial Sequence
  sgRNA
gcagacacaccttatgagtc

SEQ ID NO: 13562 - DNA, 20 bp, Artificial Sequence
  sgRNA
gctttctcagtgtctgaagg

SEQ ID NO: 13563 - DNA, 20 bp, Artificial Sequence
  sgRNA
gtcctcaccttggtgctctg

SEQ ID NO: 13564 - DNA, 20 bp, Artificial Sequence
  sgRNA
ctgaggttgagaaacagtga

SEQ ID NO: 13565 - DNA, 20 bp, Artificial Sequence
  sgRNA
agatgtcttggattagcttc

SEQ ID NO: 13566 - DNA, 20 bp, Artificial Sequence
  sgRNA
ctgctgtgaagggaggctac

SEQ ID NO: 13567 - DNA, 20 bp, Artificial Sequence
  sgRNA
gagggaggcacaagatgtct

SEQ ID NO: 13568 - DNA, 20 bp, Artificial Sequence
  sgRNA
gcacgtgggattccaaccgt

SEQ ID NO: 13569 - DNA, 20 bp, Artificial Sequence
  sgRNA
tgccttacaattggatctca

SEQ ID NO: 13570 - DNA, 20 bp, Artificial Sequence
  sgRNA
ttgtgtcaaatttacacagc

SEQ ID NO: 13571 - DNA, 20 bp, Artificial Sequence
  sgRNA
ggtagagggcaactttcttt

SEQ ID NO: 13572 - DNA, 20 bp, Artificial Sequence
  sgRNA
aagggagctgaagacagggc

SEQ ID NO: 13573 - DNA, 20 bp, Artificial Sequence
  sgRNA
gccagaactgactacttccc

SEQ ID NO: 13574 - DNA, 20 bp, Artificial Sequence
  sgRNA
gtgccggcgccctaggagcc

SEQ ID NO: 13575 - DNA, 20 bp, Artificial Sequence
  sgRNA
gggctattggtcacagaata

SEQ ID NO: 13576 - DNA, 20 bp, Artificial Sequence
  sgRNA
cccagcatgccgtgcggcag

SEQ ID NO: 13577 - DNA, 20 bp, Artificial Sequence
  sgRNA
gtgaccggtgccctggcttc

SEQ ID NO: 13578 - DNA, 20 bp, Artificial Sequence
  sgRNA
gggctcagcagcgtcgggct

SEQ ID NO: 13579 - DNA, 20 bp, Artificial Sequence
  sgRNA
tttctgtaacaccacttgct

SEQ ID NO: 13580 - DNA, 20 bp, Artificial Sequence
  sgRNA
aaggacgtattagaatcaag

SEQ ID NO: 13581 - DNA, 20 bp, Artificial Sequence
  sgRNA
taagaacagacccatctcag

SEQ ID NO: 13582 - DNA, 20 bp, Artificial Sequence
  sgRNA
caggagctagctgccagcga

SEQ ID NO: 13583 - DNA, 20 bp, Artificial Sequence
  sgRNA
ccctagagggaaatcaggag

SEQ ID NO: 13584 - DNA, 20 bp, Artificial Sequence
  sgRNA
tgagacaggtatccgggaac

SEQ ID NO: 13585 - DNA, 20 bp, Artificial Sequence
  sgRNA
gggaccggtttcaatcacaa

SEQ ID NO: 13586 - DNA, 20 bp, Artificial Sequence
  sgRNA
gcctcccgttgctgaggccc

SEQ ID NO: 13587 - DNA, 20 bp, Artificial Sequence
  sgRNA
tttagatgctccacgcccgc

SEQ ID NO: 13588 - DNA, 20 bp, Artificial Sequence
  sgRNA
agggcgaggagcttgtgtcg

SEQ ID NO: 13589 - DNA, 20 bp, Artificial Sequence
  sgRNA
cgagacgaactccctttccc

SEQ ID NO: 13590 - DNA, 20 bp, Artificial Sequence
  sgRNA
tcgtttgcgaaacggtcacg

SEQ ID NO: 13591 - DNA, 20 bp, Artificial Sequence
  sgRNA
aaatctataaagcctttccc

SEQ ID NO: 13592 - DNA, 20 bp, Artificial Sequence
  sgRNA
gtactgtgctgagccacctg

SEQ ID NO: 13593 - DNA, 20 bp, Artificial Sequence
  sgRNA
agcagggttagggccatctg

SEQ ID NO: 13594 - DNA, 20 bp, Artificial Sequence
  sgRNA
gacactcggaagcagggaaa

SEQ ID NO: 13595 - DNA, 20 bp, Artificial Sequence
  sgRNA
cttcgagagtggtgggagcc

SEQ ID NO: 13596 - DNA, 20 bp, Artificial Sequence
  sgRNA
cgcatcgtgggctaagagcg

SEQ ID NO: 13597 - DNA, 20 bp, Artificial Sequence
  sgRNA
agccgccgcggctgttgacc

SEQ ID NO: 13598 - DNA, 20 bp, Artificial Sequence
  sgRNA
tttggcatcgatgggagaga

SEQ ID NO: 13599 - DNA, 20 bp, Artificial Sequence
  sgRNA
gggagacaagctgaaatctt

SEQ ID NO: 13600 - DNA, 20 bp, Artificial Sequence
  sgRNA
caatgctgcagaggtcctaa

SEQ ID NO: 13601 - DNA, 20 bp, Artificial Sequence
  sgRNA
taaagaaccagacctcttgg

SEQ ID NO: 13602 - DNA, 20 bp, Artificial Sequence
  sgRNA
cgcccacctacagaccggac

SEQ ID NO: 13603 - DNA, 20 bp, Artificial Sequence
  sgRNA
ggcgggaccattcggcaccg

SEQ ID NO: 13604 - DNA, 20 bp, Artificial Sequence
  sgRNA
gtccattagacagcttatcc

SEQ ID NO: 13605 - DNA, 20 bp, Artificial Sequence
  sgRNA
gaatcccaaattctaattac

SEQ ID NO: 13606 - DNA, 20 bp, Artificial Sequence
  sgRNA
ttccaacacccataactaag

SEQ ID NO: 13607 - DNA, 20 bp, Artificial Sequence
  sgRNA
cgcggcgggcgggtgtttac

SEQ ID NO: 13608 - DNA, 20 bp, Artificial Sequence
  sgRNA
tgcagtgtcgcctggcaccc

SEQ ID NO: 13609 - DNA, 20 bp, Artificial Sequence
  sgRNA
caacgaagcacgcgggcacc

SEQ ID NO: 13610 - DNA, 20 bp, Artificial Sequence
  sgRNA
agctgtacgggtcggcgcgc

SEQ ID NO: 13611 - DNA, 20 bp, Artificial Sequence
  sgRNA
acactaagtggctccgcgtc

SEQ ID NO: 13612 - DNA, 20 bp, Artificial Sequence
  sgRNA
ctcacttggcgtccgggcta

SEQ ID NO: 13613 - DNA, 20 bp, Artificial Sequence
  sgRNA
tcctcccggaagatctactt

SEQ ID NO: 13614 - DNA, 20 bp, Artificial Sequence
  sgRNA
tattgcagactgaccaattc

SEQ ID NO: 13615 - DNA, 20 bp, Artificial Sequence
  sgRNA
ccagcttgcgcaggcgcttt

SEQ ID NO: 13616 - DNA, 20 bp, Artificial Sequence
  sgRNA
gggaccatgctccgaactcc

SEQ ID NO: 13617 - DNA, 20 bp, Artificial Sequence
  sgRNA
acgccagtggccgcaacact

SEQ ID NO: 13618 - DNA, 20 bp, Artificial Sequence
  sgRNA
ctggagcgtggaggccgaaa

SEQ ID NO: 13619 - DNA, 20 bp, Artificial Sequence
  sgRNA
tctgggaagcagtgtagtag

SEQ ID NO: 13620 - DNA, 20 bp, Artificial Sequence
  sgRNA
ccctagttcccagtgctttc

SEQ ID NO: 13621 - DNA, 20 bp, Artificial Sequence
  sgRNA
tatgaagtgctcttcagaca

SEQ ID NO: 13622 - DNA, 20 bp, Artificial Sequence
  sgRNA
gggaggagcctgaaagacca

SEQ ID NO: 13623 - DNA, 20 bp, Artificial Sequence
  sgRNA
ggtgggcggagcttgggatc

SEQ ID NO: 13624 - DNA, 20 bp, Artificial Sequence
  sgRNA
gagtaaggccaaagaaagtg

SEQ ID NO: 13625 - DNA, 20 bp, Artificial Sequence
  sgRNA
gagcgccggccctactagcc

SEQ ID NO: 13626 - DNA, 20 bp, Artificial Sequence
  sgRNA
gcttataaaggcccgcaggc

SEQ ID NO: 13627 - DNA, 20 bp, Artificial Sequence
  sgRNA
ccgggtcaccggcaccagcc

SEQ ID NO: 13628 - DNA, 20 bp, Artificial Sequence
  sgRNA
taggcttgtaatgtaatgcc

SEQ ID NO: 13629 - DNA, 20 bp, Artificial Sequence
  sgRNA
accctctccacgtgtacacc

SEQ ID NO: 13630 - DNA, 20 bp, Artificial Sequence
  sgRNA
gaggttaggtgagtgtaatt

SEQ ID NO: 13631 - DNA, 20 bp, Artificial Sequence
  sgRNA
tctgaatatgagcaagtggg

SEQ ID NO: 13632 - DNA, 20 bp, Artificial Sequence
  sgRNA
attatataaagggtcatagc

SEQ ID NO: 13633 - DNA, 20 bp, Artificial Sequence
  sgRNA
agaggcctactttggcttgg

SEQ ID NO: 13634 - DNA, 20 bp, Artificial Sequence
  sgRNA
gagaacaggctttcgagccc

SEQ ID NO: 13635 - DNA, 20 bp, Artificial Sequence
  sgRNA
caaaggcgcagaagacccag

SEQ ID NO: 13636 - DNA, 20 bp, Artificial Sequence
  sgRNA
aaaggactgccctgctaatg

SEQ ID NO: 13637 - DNA, 20 bp, Artificial Sequence
  sgRNA
cacaatagtggatagtctgg

SEQ ID NO: 13638 - DNA, 20 bp, Artificial Sequence
  sgRNA
ctccctgttaatctgtcatg

SEQ ID NO: 13639 - DNA, 20 bp, Artificial Sequence
  sgRNA
tgttggcaatgtcccaaact

SEQ ID NO: 13640 - DNA, 20 bp, Artificial Sequence
  sgRNA
gggctttgaaatccgagctc

SEQ ID NO: 13641 - DNA, 20 bp, Artificial Sequence
  sgRNA
cccattcacggccagaaacc

SEQ ID NO: 13642 - DNA, 20 bp, Artificial Sequence
  sgRNA
tgccagactggtccggcaag

SEQ ID NO: 13643 - DNA, 20 bp, Artificial Sequence
  sgRNA
gtgaaggccttgtcggcaga

SEQ ID NO: 13644 - DNA, 20 bp, Artificial Sequence
  sgRNA
cggctacgtgcaccgacctc

SEQ ID NO: 13645 - DNA, 20 bp, Artificial Sequence
  sgRNA
gcgggatgtgtctccagaga

SEQ ID NO: 13646 - DNA, 20 bp, Artificial Sequence
  sgRNA
ggagggtgtgtctcctggag

SEQ ID NO: 13647 - DNA, 20 bp, Artificial Sequence
  sgRNA
ttgcaggctctgggtcctgc

SEQ ID NO: 13648 - DNA, 20 bp, Artificial Sequence
  sgRNA
ccgacctgagtggcctaaga

SEQ ID NO: 13649 - DNA, 20 bp, Artificial Sequence
  sgRNA
ggctccgtgacgctatgtta

SEQ ID NO: 13650 - DNA, 20 bp, Artificial Sequence
  sgRNA
gcgccggaagcggaactacg

SEQ ID NO: 13651 - DNA, 20 bp, Artificial Sequence
  sgRNA
ggcggtgtctggaagcaggc

SEQ ID NO: 13652 - DNA, 20 bp, Artificial Sequence
  sgRNA
cctgagcctagctcgccggc

SEQ ID NO: 13653 - DNA, 20 bp, Artificial Sequence
  sgRNA
cgtgcccgcctggctctcga

SEQ ID NO: 13654 - DNA, 20 bp, Artificial Sequence
  sgRNA
gtcattgtgttacctgcagc

SEQ ID NO: 13655 - DNA, 20 bp, Artificial Sequence
  sgRNA
gatagagggaaccttggcgc

SEQ ID NO: 13656 - DNA, 20 bp, Artificial Sequence
  sgRNA
catagagtctcacagccgaa

SEQ ID NO: 13657 - DNA, 20 bp, Artificial Sequence
  sgRNA
taccatcgagcggagaacaa

SEQ ID NO: 13658 - DNA, 20 bp, Artificial Sequence
  sgRNA
acttgatctccctgtataaa

SEQ ID NO: 13659 - DNA, 20 bp, Artificial Sequence
  sgRNA
taacttctgaaatgtgaatc

SEQ ID NO: 13660 - DNA, 20 bp, Artificial Sequence
  sgRNA
ctgatgcccactcaagcttc

SEQ ID NO: 13661 - DNA, 20 bp, Artificial Sequence
  sgRNA
gaccagccacctattggcca

SEQ ID NO: 13662 - DNA, 20 bp, Artificial Sequence
  sgRNA
gcgcaaagggttccttgaag

SEQ ID NO: 13663 - DNA, 20 bp, Artificial Sequence
  sgRNA
ggtttgcggagcgtcagagt

SEQ ID NO: 13664 - DNA, 20 bp, Artificial Sequence
  sgRNA
atccagagaagataacgtta

SEQ ID NO: 13665 - DNA, 20 bp, Artificial Sequence
  sgRNA
cagatcttcagcggcctttg

SEQ ID NO: 13666 - DNA, 20 bp, Artificial Sequence
  sgRNA
cgggtgcttcgtgccaaatg

SEQ ID NO: 13667 - DNA, 20 bp, Artificial Sequence
  sgRNA
tagcgttcacacagtgctcc

SEQ ID NO: 13668 - DNA, 20 bp, Artificial Sequence
  sgRNA
aggaccaggtcaggaacata

SEQ ID NO: 13669 - DNA, 20 bp, Artificial Sequence
  sgRNA
aatttagaaagtgattaggc

SEQ ID NO: 13670 - DNA, 20 bp, Artificial Sequence
  sgRNA
gagaggctatcccaagacag

SEQ ID NO: 13671 - DNA, 20 bp, Artificial Sequence
  sgRNA
attgtgtcatagtaacctct

SEQ ID NO: 13672 - DNA, 20 bp, Artificial Sequence
  sgRNA
tctcatagtgaaggagaacg

SEQ ID NO: 13673 - DNA, 20 bp, Artificial Sequence
  sgRNA
aagcttccattggagttgca

SEQ ID NO: 13674 - DNA, 20 bp, Artificial Sequence
  sgRNA
ttaaattaagtggtcacatc

SEQ ID NO: 13675 - DNA, 20 bp, Artificial Sequence
  sgRNA
tttgtgctaaactctcaggc

SEQ ID NO: 13676 - DNA, 20 bp, Artificial Sequence
  sgRNA
aaagggttccgcgcggaagc

SEQ ID NO: 13677 - DNA, 20 bp, Artificial Sequence
  sgRNA
gtctcagacagggaaccgac

SEQ ID NO: 13678 - DNA, 20 bp, Artificial Sequence
  sgRNA
ctttcgtggctcgggttcaa

SEQ ID NO: 13679 - DNA, 20 bp, Artificial Sequence
  sgRNA
cattgtgggagccgcgcgag

SEQ ID NO: 13680 - DNA, 20 bp, Artificial Sequence
  sgRNA
gcggcggtcgggccattgtg

SEQ ID NO: 13681 - DNA, 20 bp, Artificial Sequence
  sgRNA
gcgggaccatagagagcccg

SEQ ID NO: 13682 - DNA, 20 bp, Artificial Sequence
  sgRNA
ggcaaacaccgcgagatctg

SEQ ID NO: 13683 - DNA, 20 bp, Artificial Sequence
  sgRNA
agggcaggcgagcggcaggg

SEQ ID NO: 13684 - DNA, 20 bp, Artificial Sequence
  sgRNA
aatacggccacacaatatgg

SEQ ID NO: 13685 - DNA, 20 bp, Artificial Sequence
  sgRNA
cgagtgtgaggccaattcac

SEQ ID NO: 13686 - DNA, 20 bp, Artificial Sequence
  sgRNA
ggcgagacacagacaaggtc

SEQ ID NO: 13687 - DNA, 20 bp, Artificial Sequence
  sgRNA
gtggcaaggccactaagtag

SEQ ID NO: 13688 - DNA, 20 bp, Artificial Sequence
  sgRNA
atttataactcgctctgagg

SEQ ID NO: 13689 - DNA, 20 bp, Artificial Sequence
  sgRNA
ctccggtaggcagcctgaaa

SEQ ID NO: 13690 - DNA, 20 bp, Artificial Sequence
  sgRNA
tgcaagcagacctccctcaa

SEQ ID NO: 13691 - DNA, 20 bp, Artificial Sequence
  sgRNA
ggcggatacggcgagccaat

SEQ ID NO: 13692 - DNA, 20 bp, Artificial Sequence
  sgRNA
gcgggaggctctcatgcggc

SEQ ID NO: 13693 - DNA, 20 bp, Artificial Sequence
  sgRNA
tgcctgttacggaagccgtc

SEQ ID NO: 13694 - DNA, 20 bp, Artificial Sequence
  sgRNA
tacatatgttgttgtgcagc

SEQ ID NO: 13695 - DNA, 20 bp, Artificial Sequence
  sgRNA
tagggctatttctgccaggc

SEQ ID NO: 13696 - DNA, 20 bp, Artificial Sequence
  sgRNA
gccaggctgcccgtcaaccc

SEQ ID NO: 13697 - DNA, 20 bp, Artificial Sequence
  sgRNA
gatatgcaagattctacttt

SEQ ID NO: 13698 - DNA, 20 bp, Artificial Sequence
  sgRNA
attgctcaggttatgacacc

SEQ ID NO: 13699 - DNA, 20 bp, Artificial Sequence
  sgRNA
agagcagggcgcgctgtgat

SEQ ID NO: 13700 - DNA, 20 bp, Artificial Sequence
  sgRNA
tagcaaagaaccagacagaa

SEQ ID NO: 13701 - DNA, 20 bp, Artificial Sequence
  sgRNA
gcctttcttgctaagaattg

SEQ ID NO: 13702 - DNA, 20 bp, Artificial Sequence
  sgRNA
aaatttcgagcagagaccca

SEQ ID NO: 13703 - DNA, 20 bp, Artificial Sequence
  sgRNA
tgactggagaggctgggagg

SEQ ID NO: 13704 - DNA, 20 bp, Artificial Sequence
  sgRNA
cctccggaacttcagttccc

SEQ ID NO: 13705 - DNA, 20 bp, Artificial Sequence
  sgRNA
agcccgaagagctcgagacg

SEQ ID NO: 13706 - DNA, 20 bp, Artificial Sequence
  sgRNA
agacatgctgaataacaaag

SEQ ID NO: 13707 - DNA, 20 bp, Artificial Sequence
  sgRNA
ttagcaggagtctgattggc

SEQ ID NO: 13708 - DNA, 20 bp, Artificial Sequence
  sgRNA
gaatggaatctctctagagc

SEQ ID NO: 13709 - DNA, 20 bp, Artificial Sequence
  sgRNA
aataaactactaggctcttc

SEQ ID NO: 13710 - DNA, 20 bp, Artificial Sequence
  sgRNA
gggaggctccgccgtaggcg

SEQ ID NO: 13711 - DNA, 20 bp, Artificial Sequence
  sgRNA
gggacctttctgccggcgcc

SEQ ID NO: 13712 - DNA, 20 bp, Artificial Sequence
  sgRNA
aattacaatgttcagttggg

SEQ ID NO: 13713 - DNA, 20 bp, Artificial Sequence
  sgRNA
cgggttagggtctgcaaggt

SEQ ID NO: 13714 - DNA, 20 bp, Artificial Sequence
  sgRNA
agatgtgccttctagagcca

SEQ ID NO: 13715 - DNA, 20 bp, Artificial Sequence
  sgRNA
tactttgcgcccactcctag

SEQ ID NO: 13716 - DNA, 20 bp, Artificial Sequence
  sgRNA
gcctccaactgcgatggccg

SEQ ID NO: 13717 - DNA, 20 bp, Artificial Sequence
  sgRNA
ggcaccagctctgagctgga

SEQ ID NO: 13718 - DNA, 20 bp, Artificial Sequence
  sgRNA
ggtgggtagaagattgacag

SEQ ID NO: 13719 - DNA, 20 bp, Artificial Sequence
  sgRNA
atggttggaagctgggttga

SEQ ID NO: 13720 - DNA, 20 bp, Artificial Sequence
  sgRNA
agaaggacagattggtggat

SEQ ID NO: 13721 - DNA, 20 bp, Artificial Sequence
  sgRNA
cttccttacacacctgcctg

SEQ ID NO: 13722 - DNA, 20 bp, Artificial Sequence
  sgRNA
tctgtaggagttagttctgt

SEQ ID NO: 13723 - DNA, 20 bp, Artificial Sequence
  sgRNA
tttgagctgctcccaggata

SEQ ID NO: 13724 - DNA, 20 bp, Artificial Sequence
  sgRNA
ttctgattggtcatcaatga

SEQ ID NO: 13725 - DNA, 20 bp, Artificial Sequence
  sgRNA
cacaaccggcttagagacac

SEQ ID NO: 13726 - DNA, 20 bp, Artificial Sequence
  sgRNA
gcccatttgaatgaagccaa

SEQ ID NO: 13727 - DNA, 20 bp, Artificial Sequence
  sgRNA
ttgcatagattcttgtgtat

SEQ ID NO: 13728 - DNA, 20 bp, Artificial Sequence
  sgRNA
tttggaacggttatgtgcag

SEQ ID NO: 13729 - DNA, 20 bp, Artificial Sequence
  sgRNA
aagcagcttcccaaggtagg

SEQ ID NO: 13730 - DNA, 20 bp, Artificial Sequence
  sgRNA
tatgagggtggcaccaaagt

SEQ ID NO: 13731 - DNA, 20 bp, Artificial Sequence
  sgRNA
agcaccctgccattctatag

SEQ ID NO: 13732 - DNA, 20 bp, Artificial Sequence
  sgRNA
gtccttggccacccaggttc

SEQ ID NO: 13733 - DNA, 20 bp, Artificial Sequence
  sgRNA
aaggaagaggcgccggcgca

SEQ ID NO: 13734 - DNA, 20 bp, Artificial Sequence
  sgRNA
ccgggcggctcgtcgtgccg

SEQ ID NO: 13735 - DNA, 20 bp, Artificial Sequence
  sgRNA
gtgcatggctcgagccgccg

SEQ ID NO: 13736 - DNA, 20 bp, Artificial Sequence
  sgRNA
ctcagacgtccggcgccatc

SEQ ID NO: 13737 - DNA, 20 bp, Artificial Sequence
  sgRNA
tacagtaggcagtgataact

SEQ ID NO: 13738 - DNA, 20 bp, Artificial Sequence
  sgRNA
aaggtgggcagaaccttaac

SEQ ID NO: 13739 - DNA, 20 bp, Artificial Sequence
  sgRNA
ggtcgacgccatcttgaatg

SEQ ID NO: 13740 - DNA, 20 bp, Artificial Sequence
  sgRNA
gggtctttcctcgtagccag

SEQ ID NO: 13741 - DNA, 20 bp, Artificial Sequence
  sgRNA
ctggaagagccgctcacctg

SEQ ID NO: 13742 - DNA, 20 bp, Artificial Sequence
  sgRNA
ggtgtccatgcaggtgggcg

SEQ ID NO: 13743 - DNA, 20 bp, Artificial Sequence
  sgRNA
tctttaagcaagaggaggcg

SEQ ID NO: 13744 - DNA, 20 bp, Artificial Sequence
  sgRNA
taactgcactgtggttgatt

SEQ ID NO: 13745 - DNA, 20 bp, Artificial Sequence
  sgRNA
gccacgcctacagtcttccc

SEQ ID NO: 13746 - DNA, 20 bp, Artificial Sequence
  sgRNA
aaccacacccaacttgggag

SEQ ID NO: 13747 - DNA, 20 bp, Artificial Sequence
  sgRNA
ctacagcaagttatttgaag

SEQ ID NO: 13748 - DNA, 20 bp, Artificial Sequence
  sgRNA
tatgtcgagctcttggaggc

SEQ ID NO: 13749 - DNA, 20 bp, Artificial Sequence
  sgRNA
gattggtggtgggtgtggct

SEQ ID NO: 13750 - DNA, 20 bp, Artificial Sequence
  sgRNA
actcctgcctctatgcaact

SEQ ID NO: 13751 - DNA, 20 bp, Artificial Sequence
  sgRNA
ctagcgaaaggctgccgccc

SEQ ID NO: 13752 - DNA, 20 bp, Artificial Sequence
  sgRNA
gttctcgtggcgcactgagc

SEQ ID NO: 13753 - DNA, 20 bp, Artificial Sequence
  sgRNA
agctgggcgactggaaccaa

SEQ ID NO: 13754 - DNA, 20 bp, Artificial Sequence
  sgRNA
gccgttgccgtagctgtcgc

SEQ ID NO: 13755 - DNA, 20 bp, Artificial Sequence
  sgRNA
atccagctgtggtgtgcgcc

SEQ ID NO: 13756 - DNA, 20 bp, Artificial Sequence
  sgRNA
ctctccctccgcgtctcggc

SEQ ID NO: 13757 - DNA, 20 bp, Artificial Sequence
  sgRNA
agacgcgcgcccgcaatgtc

SEQ ID NO: 13758 - DNA, 20 bp, Artificial Sequence
  sgRNA
ggattggattggctaatccg

SEQ ID NO: 13759 - DNA, 20 bp, Artificial Sequence
  sgRNA
aagacatacgctccgcaggc

SEQ ID NO: 13760 - DNA, 20 bp, Artificial Sequence
  sgRNA
cacatttcccggcataccca

SEQ ID NO: 13761 - DNA, 20 bp, Artificial Sequence
  sgRNA
gggcgctcattacgcacttc

SEQ ID NO: 13762 - DNA, 20 bp, Artificial Sequence
  sgRNA
taaagtgcaccaaggcacgc

SEQ ID NO: 13763 - DNA, 20 bp, Artificial Sequence
  sgRNA
agagatgcgcggcctcgcgc

SEQ ID NO: 13764 - DNA, 20 bp, Artificial Sequence
  sgRNA
cgcacagggttaagcggcag

SEQ ID NO: 13765 - DNA, 20 bp, Artificial Sequence
  sgRNA
gtgctggttcttggtcccgt

SEQ ID NO: 13766 - DNA, 20 bp, Artificial Sequence
  sgRNA
ggaggctgagagatgaacag

SEQ ID NO: 13767 - DNA, 20 bp, Artificial Sequence
  sgRNA
tgtagtcagccagtcacatc

SEQ ID NO: 13768 - DNA, 20 bp, Artificial Sequence
  sgRNA
ctaagtgtcttgactgtctg

SEQ ID NO: 13769 - DNA, 20 bp, Artificial Sequence
  sgRNA
ggaatctggttctttcagcc

SEQ ID NO: 13770 - DNA, 20 bp, Artificial Sequence
  sgRNA
ttgatttgtaagtcgacacc

SEQ ID NO: 13771 - DNA, 20 bp, Artificial Sequence
  sgRNA
actgtctcacatgctgactt

SEQ ID NO: 13772 - DNA, 20 bp, Artificial Sequence
  sgRNA
ttccgcgcgtcgtgacgtct

SEQ ID NO: 13773 - DNA, 20 bp, Artificial Sequence
  sgRNA
ggaagcacctggctctttgg

SEQ ID NO: 13774 - DNA, 20 bp, Artificial Sequence
  sgRNA
gatctgggaggtcagcacct

SEQ ID NO: 13775 - DNA, 20 bp, Artificial Sequence
  sgRNA
cagcacagctgtcacacagc

SEQ ID NO: 13776 - DNA, 20 bp, Artificial Sequence
  sgRNA
caagggaatcgctggctctc

SEQ ID NO: 13777 - DNA, 20 bp, Artificial Sequence
  sgRNA
cgggcccagctgacacttat

SEQ ID NO: 13778 - DNA, 20 bp, Artificial Sequence
  sgRNA
cgcagagaactcgagccgga

SEQ ID NO: 13779 - DNA, 20 bp, Artificial Sequence
  sgRNA
tggttagaggtccagggccg

SEQ ID NO: 13780 - DNA, 20 bp, Artificial Sequence
  sgRNA
ggatccgcaggcaagactta

SEQ ID NO: 13781 - DNA, 20 bp, Artificial Sequence
  sgRNA
actctgttatactttcaacc

SEQ ID NO: 13782 - DNA, 20 bp, Artificial Sequence
  sgRNA
aacgcttacaggtgcctctc

SEQ ID NO: 13783 - DNA, 20 bp, Artificial Sequence
  sgRNA
acgtcgcctttccgccgctg

SEQ ID NO: 13784 - DNA, 20 bp, Artificial Sequence
  sgRNA
acgacgcaagtgcgtcctac

SEQ ID NO: 13785 - DNA, 20 bp, Artificial Sequence
  sgRNA
tttgcgagcgagccgcaagg

SEQ ID NO: 13786 - DNA, 20 bp, Artificial Sequence
  sgRNA
cggaagacggtcccgggccg

SEQ ID NO: 13787 - DNA, 20 bp, Artificial Sequence
  sgRNA
gggtgacaggagcccgacgt

SEQ ID NO: 13788 - DNA, 20 bp, Artificial Sequence
  sgRNA
cccaggctgaggaggcgaaa

SEQ ID NO: 13789 - DNA, 20 bp, Artificial Sequence
  sgRNA
agagcaaggcgtcgcacaaa

SEQ ID NO: 13790 - DNA, 20 bp, Artificial Sequence
  sgRNA
attcacctgctccagagcag

SEQ ID NO: 13791 - DNA, 20 bp, Artificial Sequence
  sgRNA
acaggcttccgggagcagtg

SEQ ID NO: 13792 - DNA, 20 bp, Artificial Sequence
  sgRNA
ctcagtcctccaagctaaac

SEQ ID NO: 13793 - DNA, 20 bp, Artificial Sequence
  sgRNA
tgaatcttggtgtaggattc

SEQ ID NO: 13794 - DNA, 20 bp, Artificial Sequence
  sgRNA
atctgctatctgtagatacc

SEQ ID NO: 13795 - DNA, 20 bp, Artificial Sequence
  sgRNA
tgccgtatccggagtgcatc

SEQ ID NO: 13796 - DNA, 20 bp, Artificial Sequence
  sgRNA
gtgatctatgtttgagtgag

SEQ ID NO: 13797 - DNA, 20 bp, Artificial Sequence
  sgRNA
gtaaccctttacctgcgcct

SEQ ID NO: 13798 - DNA, 20 bp, Artificial Sequence
  sgRNA
atctagcaactaatgcgggc

SEQ ID NO: 13799 - DNA, 20 bp, Artificial Sequence
  sgRNA
agtgctctagcatctttccc

SEQ ID NO: 13800 - DNA, 20 bp, Artificial Sequence
  sgRNA
gaacgacccgccttcctttg

SEQ ID NO: 13801 - DNA, 20 bp, Artificial Sequence
  sgRNA
tgagccaatccgagaagtac

SEQ ID NO: 13802 - DNA, 20 bp, Artificial Sequence
  sgRNA
aagtcttgcaactgttgtga

SEQ ID NO: 13803 - DNA, 20 bp, Artificial Sequence
  sgRNA
tcacgcggaggctgtgtcag

SEQ ID NO: 13804 - DNA, 20 bp, Artificial Sequence
  sgRNA
tcagccctctcacgctccgg

SEQ ID NO: 13805 - DNA, 20 bp, Artificial Sequence
  sgRNA
cagaataaagttcctcatgt

SEQ ID NO: 13806 - DNA, 20 bp, Artificial Sequence
  sgRNA
gtgaagtgaaagaaatgctg

SEQ ID NO: 13807 - DNA, 20 bp, Artificial Sequence
  sgRNA
cgttggacagtaatagcatt

SEQ ID NO: 13808 - DNA, 20 bp, Artificial Sequence
  sgRNA
cattggtggaaaggttatgg

SEQ ID NO: 13809 - DNA, 20 bp, Artificial Sequence
  sgRNA
ggctcacatatttaaaccta

SEQ ID NO: 13810 - DNA, 20 bp, Artificial Sequence
  sgRNA
ctcttcttgatcattcctgc

SEQ ID NO: 13811 - DNA, 20 bp, Artificial Sequence
  sgRNA
gggtgtggttcagagaataa

SEQ ID NO: 13812 - DNA, 20 bp, Artificial Sequence
  sgRNA
gcagataggagggaagactt

SEQ ID NO: 13813 - DNA, 20 bp, Artificial Sequence
  sgRNA
ctctttaatgtctgactgct

SEQ ID NO: 13814 - DNA, 20 bp, Artificial Sequence
  sgRNA
gacccggtcaggtggtgaga

SEQ ID NO: 13815 - DNA, 20 bp, Artificial Sequence
  sgRNA
aaagataccaatgagagcgc

SEQ ID NO: 13816 - DNA, 20 bp, Artificial Sequence
  sgRNA
gcctattggctcacgctccg

SEQ ID NO: 13817 - DNA, 20 bp, Artificial Sequence
  sgRNA
tgcgcctgcgcgcagcttgg

SEQ ID NO: 13818 - DNA, 20 bp, Artificial Sequence
  sgRNA
tggccgctaccgcaggcagg

SEQ ID NO: 13819 - DNA, 20 bp, Artificial Sequence
  sgRNA
ccgcgcacctgctcacctgt

SEQ ID NO: 13820 - DNA, 20 bp, Artificial Sequence
  sgRNA
ttgcgttgtgaaatacatac

SEQ ID NO: 13821 - DNA, 20 bp, Artificial Sequence
  sgRNA
aactgacttgtcaatcgctg

SEQ ID NO: 13822 - DNA, 20 bp, Artificial Sequence
  sgRNA
gatcactttgacacgatgat

SEQ ID NO: 13823 - DNA, 20 bp, Artificial Sequence
  sgRNA
gggagctatggaagtaactc

SEQ ID NO: 13824 - DNA, 20 bp, Artificial Sequence
  sgRNA
atgagccatgcccgcatgcc

SEQ ID NO: 13825 - DNA, 20 bp, Artificial Sequence
  sgRNA
tctttctcttaactttggaa

SEQ ID NO: 13826 - DNA, 20 bp, Artificial Sequence
  sgRNA
tcaccacactgtgtctgaga

SEQ ID NO: 13827 - DNA, 20 bp, Artificial Sequence
  sgRNA
actgaaggccatatgtggga

SEQ ID NO: 13828 - DNA, 20 bp, Artificial Sequence
  sgRNA
tggtgacctggaggacaatg

SEQ ID NO: 13829 - DNA, 20 bp, Artificial Sequence
  sgRNA
actcacttggttgcgcgacg

SEQ ID NO: 13830 - DNA, 20 bp, Artificial Sequence
  sgRNA
gggacacagcgcggcacgat

SEQ ID NO: 13831 - DNA, 20 bp, Artificial Sequence
  sgRNA
gctggcgcgggcaggaggag

SEQ ID NO: 13832 - DNA, 20 bp, Artificial Sequence
  sgRNA
agggctcttgcgcaggctct

SEQ ID NO: 13833 - DNA, 20 bp, Artificial Sequence
  sgRNA
gcgctgtgtgcgggttgtgc

SEQ ID NO: 13834 - DNA, 20 bp, Artificial Sequence
  sgRNA
cagcgccacggttcggacta

SEQ ID NO: 13835 - DNA, 20 bp, Artificial Sequence
  sgRNA
gtcaaagagtgacgttcgaa

SEQ ID NO: 13836 - DNA, 20 bp, Artificial Sequence
  sgRNA
tatgctgagccgctcgccag

SEQ ID NO: 13837 - DNA, 20 bp, Artificial Sequence
  sgRNA
acgcctagtgtttcctacag

SEQ ID NO: 13838 - DNA, 20 bp, Artificial Sequence
  sgRNA
gaggcagtctccagggaagt

SEQ ID NO: 13839 - DNA, 20 bp, Artificial Sequence
  sgRNA
ctgagaccaccacagagcta

SEQ ID NO: 13840 - DNA, 20 bp, Artificial Sequence
  sgRNA
gaatggagcggcacgtgacc

SEQ ID NO: 13841 - DNA, 20 bp, Artificial Sequence
  sgRNA
cgcaaggcaatgggtgcggc

SEQ ID NO: 13842 - DNA, 20 bp, Artificial Sequence
  sgRNA
actgcacgccttgggagcac

SEQ ID NO: 13843 - DNA, 20 bp, Artificial Sequence
  sgRNA
gccgcgggtctgggcatccc

SEQ ID NO: 13844 - DNA, 20 bp, Artificial Sequence
  sgRNA
tggattcagcatgcgttcct

SEQ ID NO: 13845 - DNA, 20 bp, Artificial Sequence
  sgRNA
gctgggctgacaacccagag

SEQ ID NO: 13846 - DNA, 20 bp, Artificial Sequence
  sgRNA
gcacagctctgatgagctga

SEQ ID NO: 13847 - DNA, 20 bp, Artificial Sequence
  sgRNA
gggtcaaactgcgattccgt

SEQ ID NO: 13848 - DNA, 20 bp, Artificial Sequence
  sgRNA
caaattcctgcgcctccagg

SEQ ID NO: 13849 - DNA, 20 bp, Artificial Sequence
  sgRNA
cccggcgccaactgtggagg

SEQ ID NO: 13850 - DNA, 20 bp, Artificial Sequence
  sgRNA
ttggtttagctgctcaactt

SEQ ID NO: 13851 - DNA, 20 bp, Artificial Sequence
  sgRNA
catgttgtgcgagtcctctt

SEQ ID NO: 13852 - DNA, 20 bp, Artificial Sequence
  sgRNA
ggtgagggtagcgattcagg

SEQ ID NO: 13853 - DNA, 20 bp, Artificial Sequence
  sgRNA
cgccgtgcggagtccttcct

SEQ ID NO: 13854 - DNA, 20 bp, Artificial Sequence
  sgRNA
ggaggtcctgggtaggacag

SEQ ID NO: 13855 - DNA, 20 bp, Artificial Sequence
  sgRNA
ggcctggtgcgcaggccctt

SEQ ID NO: 13856 - DNA, 20 bp, Artificial Sequence
  sgRNA
gatgttgcaggttagtggaa

SEQ ID NO: 13857 - DNA, 20 bp, Artificial Sequence
  sgRNA
acaagcaggtgtttgattcc

SEQ ID NO: 13858 - DNA, 20 bp, Artificial Sequence
  sgRNA
tgtctgatgcacagattact

SEQ ID NO: 13859 - DNA, 20 bp, Artificial Sequence
  sgRNA
agacagtaacacccatcttc

SEQ ID NO: 13860 - DNA, 20 bp, Artificial Sequence
  sgRNA
gacgtcatgctcagtgcccg

SEQ ID NO: 13861 - DNA, 20 bp, Artificial Sequence
  sgRNA
gatggtatcagcctgtcttc

SEQ ID NO: 13862 - DNA, 20 bp, Artificial Sequence
  sgRNA
gtgtctttgactcgcgcgcg

SEQ ID NO: 13863 - DNA, 20 bp, Artificial Sequence
  sgRNA
tgtcagccttatcagccaat

SEQ ID NO: 13864 - DNA, 20 bp, Artificial Sequence
  sgRNA
ccaacaaggaacgctctcat

SEQ ID NO: 13865 - DNA, 20 bp, Artificial Sequence
  sgRNA
gtcccttccatctgcattgc

SEQ ID NO: 13866 - DNA, 20 bp, Artificial Sequence
  sgRNA
gggcattagaggtgggaggc

SEQ ID NO: 13867 - DNA, 20 bp, Artificial Sequence
  sgRNA
gctggacacgggaggactac

SEQ ID NO: 13868 - DNA, 20 bp, Artificial Sequence
  sgRNA
ctctgaagccaggcagattg

SEQ ID NO: 13869 - DNA, 20 bp, Artificial Sequence
  sgRNA
catcagagatcattgggcta

SEQ ID NO: 13870 - DNA, 20 bp, Artificial Sequence
  sgRNA
tgttgggcccgcctctcctc

SEQ ID NO: 13871 - DNA, 20 bp, Artificial Sequence
  sgRNA
cgtgtggaatatttcacaac

SEQ ID NO: 13872 - DNA, 20 bp, Artificial Sequence
  sgRNA
cgctctatctccttaagaac

SEQ ID NO: 13873 - DNA, 20 bp, Artificial Sequence
  sgRNA
gaaagacaagaatgagccaa

SEQ ID NO: 13874 - DNA, 20 bp, Artificial Sequence
  sgRNA
ttatcaagtacccaggtgtg

SEQ ID NO: 13875 - DNA, 20 bp, Artificial Sequence
  sgRNA
acttctcagaccaaagtcct

SEQ ID NO: 13876 - DNA, 20 bp, Artificial Sequence
  sgRNA
gaagtcttgggcctgagact

SEQ ID NO: 13877 - DNA, 20 bp, Artificial Sequence
  sgRNA
cgagttagtttgcactatcc

SEQ ID NO: 13878 - DNA, 20 bp, Artificial Sequence
  sgRNA
ctatcccggactttaacatt

SEQ ID NO: 13879 - DNA, 20 bp, Artificial Sequence
  sgRNA
ttcccagcagccaacagcag

SEQ ID NO: 13880 - DNA, 20 bp, Artificial Sequence
  sgRNA
agctaaccatggaggagact

SEQ ID NO: 13881 - DNA, 20 bp, Artificial Sequence
  sgRNA
ggatgggcctcctgaataag

SEQ ID NO: 13882 - DNA, 20 bp, Artificial Sequence
  sgRNA
gcagtggcgatggaagcgcg

SEQ ID NO: 13883 - DNA, 20 bp, Artificial Sequence
  sgRNA
tcgtagcctccaccactccc

SEQ ID NO: 13884 - DNA, 20 bp, Artificial Sequence
  sgRNA
ccgcgccactgcgaggacct

SEQ ID NO: 13885 - DNA, 20 bp, Artificial Sequence
  sgRNA
aagaagatgtgctctatagc

SEQ ID NO: 13886 - DNA, 20 bp, Artificial Sequence
  sgRNA
ttcgcacaaactcatcagac

SEQ ID NO: 13887 - DNA, 20 bp, Artificial Sequence
  sgRNA
gaacagcccaaattctttct

SEQ ID NO: 13888 - DNA, 20 bp, Artificial Sequence
  sgRNA
atacacagcaatttgacaag

SEQ ID NO: 13889 - DNA, 20 bp, Artificial Sequence
  sgRNA
ggtgtgtttgttgtttagtg

SEQ ID NO: 13890 - DNA, 20 bp, Artificial Sequence
  sgRNA
cagcaatcctgactcagcag

SEQ ID NO: 13891 - DNA, 20 bp, Artificial Sequence
  sgRNA
gtttcttcccatcaatgtcc

SEQ ID NO: 13892 - DNA, 20 bp, Artificial Sequence
  sgRNA
tgacaagctagatccctttc

SEQ ID NO: 13893 - DNA, 20 bp, Artificial Sequence
  sgRNA
gtggccgaggcggagcgccc

SEQ ID NO: 13894 - DNA, 20 bp, Artificial Sequence
  sgRNA
tacgcgcttgagtgcgcgag

SEQ ID NO: 13895 - DNA, 20 bp, Artificial Sequence
  sgRNA
cacatcgctcttgcacacac

SEQ ID NO: 13896 - DNA, 20 bp, Artificial Sequence
  sgRNA
ttacatcatccttgggcgtg

SEQ ID NO: 13897 - DNA, 20 bp, Artificial Sequence
  sgRNA
ccaacatctcgtgaggtggg

SEQ ID NO: 13898 - DNA, 20 bp, Artificial Sequence
  sgRNA
ttcttcgaattcgttcttcg

SEQ ID NO: 13899 - DNA, 20 bp, Artificial Sequence
  sgRNA
tttgggcacatttgttggtg

SEQ ID NO: 13900 - DNA, 20 bp, Artificial Sequence
  sgRNA
acataatcacaaattgatgc

SEQ ID NO: 13901 - DNA, 20 bp, Artificial Sequence
  sgRNA
tccagcccagtcaactctca

SEQ ID NO: 13902 - DNA, 20 bp, Artificial Sequence
  sgRNA
gttgagacctccacaaatca

SEQ ID NO: 13903 - DNA, 20 bp, Artificial Sequence
  sgRNA
gggtagaatgaaccgaattt

SEQ ID NO: 13904 - DNA, 20 bp, Artificial Sequence
  sgRNA
atactgtgaatctagaacta

SEQ ID NO: 13905 - DNA, 20 bp, Artificial Sequence
  sgRNA
cgcgcctaccaggagctcac

SEQ ID NO: 13906 - DNA, 20 bp, Artificial Sequence
  sgRNA
gacggaagcaggaacctacc

SEQ ID NO: 13907 - DNA, 20 bp, Artificial Sequence
  sgRNA
cggccgtcgatttgtcaaat

SEQ ID NO: 13908 - DNA, 20 bp, Artificial Sequence
  sgRNA
atgtgtgagcacagacttcc

SEQ ID NO: 13909 - DNA, 20 bp, Artificial Sequence
  sgRNA
gaatgaatcacagtgagagt

SEQ ID NO: 13910 - DNA, 20 bp, Artificial Sequence
  sgRNA
tcagcctcacctcaatatgg

SEQ ID NO: 13911 - DNA, 20 bp, Artificial Sequence
  sgRNA
gcggatcgcgcgacctggac

SEQ ID NO: 13912 - DNA, 20 bp, Artificial Sequence
  sgRNA
gagtgctggacctggttcgg

SEQ ID NO: 13913 - DNA, 20 bp, Artificial Sequence
  sgRNA
atgaagcgcctggatagtcc

SEQ ID NO: 13914 - DNA, 20 bp, Artificial Sequence
  sgRNA
agtggctggttgccagtact

SEQ ID NO: 13915 - DNA, 20 bp, Artificial Sequence
  sgRNA
agcacgagcttaatgcccat

SEQ ID NO: 13916 - DNA, 20 bp, Artificial Sequence
  sgRNA
aagttctgagtagcccttcc

SEQ ID NO: 13917 - DNA, 20 bp, Artificial Sequence
  sgRNA
ggcaccttgaaacgcgaggg

SEQ ID NO: 13918 - DNA, 20 bp, Artificial Sequence
  sgRNA
tgcaaagagcaggagagacg

SEQ ID NO: 13919 - DNA, 20 bp, Artificial Sequence
  sgRNA
agggagggaagagagcaagg

SEQ ID NO: 13920 - DNA, 20 bp, Artificial Sequence
  sgRNA
aaaggagctctggaccacta

SEQ ID NO: 13921 - DNA, 20 bp, Artificial Sequence
  sgRNA
gtaatccatcctgagatttg

SEQ ID NO: 13922 - DNA, 20 bp, Artificial Sequence
  sgRNA
atcgcctaggactaagggat

SEQ ID NO: 13923 - DNA, 20 bp, Artificial Sequence
  sgRNA
caattcaagtccaaagtcga

SEQ ID NO: 13924 - DNA, 20 bp, Artificial Sequence
  sgRNA
ccagacccgcgcttagattt

SEQ ID NO: 13925 - DNA, 20 bp, Artificial Sequence
  sgRNA
ggctgtccagtacttaactc

SEQ ID NO: 13926 - DNA, 20 bp, Artificial Sequence
  sgRNA
gagtgacgaaggtagtggcg

SEQ ID NO: 13927 - DNA, 20 bp, Artificial Sequence
  sgRNA
aagctgccacgagattctgg

SEQ ID NO: 13928 - DNA, 20 bp, Artificial Sequence
  sgRNA
tgttgctggttgtatggagt

SEQ ID NO: 13929 - DNA, 20 bp, Artificial Sequence
  sgRNA
cgcccactgtatatttagat

SEQ ID NO: 13930 - DNA, 20 bp, Artificial Sequence
  sgRNA
acagtagtgtcagatagaag

SEQ ID NO: 13931 - DNA, 20 bp, Artificial Sequence
  sgRNA
tcggagagcaagcattctgc

SEQ ID NO: 13932 - DNA, 20 bp, Artificial Sequence
  sgRNA
ggctcttaattgagaagaga

SEQ ID NO: 13933 - DNA, 20 bp, Artificial Sequence
  sgRNA
ttaatctgtctttggtcatt

SEQ ID NO: 13934 - DNA, 20 bp, Artificial Sequence
  sgRNA
ccctgtgacctgccaatcta

SEQ ID NO: 13935 - DNA, 20 bp, Artificial Sequence
  sgRNA
ggccagccgagtgataaggc

SEQ ID NO: 13936 - DNA, 20 bp, Artificial Sequence
  sgRNA
gctacttcgatagcatgtgc

SEQ ID NO: 13937 - DNA, 20 bp, Artificial Sequence
  sgRNA
ggtagactttagacagactt

SEQ ID NO: 13938 - DNA, 20 bp, Artificial Sequence
  sgRNA
gggcggtgatggactcagcg

SEQ ID NO: 13939 - DNA, 20 bp, Artificial Sequence
  sgRNA
tcatgggccgtgaagtcctt

SEQ ID NO: 13940 - DNA, 20 bp, Artificial Sequence
  sgRNA
cctgtggaactacatgtccc

SEQ ID NO: 13941 - DNA, 20 bp, Artificial Sequence
  sgRNA
ttacctcggcctcgcttcct

SEQ ID NO: 13942 - DNA, 20 bp, Artificial Sequence
  sgRNA
ggagctttgcctggaaattg

SEQ ID NO: 13943 - DNA, 20 bp, Artificial Sequence
  sgRNA
gccgggcggccgcgctgagg

SEQ ID NO: 13944 - DNA, 20 bp, Artificial Sequence
  sgRNA
cgctgctcattagagacaga

SEQ ID NO: 13945 - DNA, 20 bp, Artificial Sequence
  sgRNA
ctgtctaggctcagataccc

SEQ ID NO: 13946 - DNA, 20 bp, Artificial Sequence
  sgRNA
aacatagaggctgctggccc

SEQ ID NO: 13947 - DNA, 20 bp, Artificial Sequence
  sgRNA
tttgcacgagaagtggaaac

SEQ ID NO: 13948 - DNA, 20 bp, Artificial Sequence
  sgRNA
tcgaccctgatacttgattg

SEQ ID NO: 13949 - DNA, 20 bp, Artificial Sequence
  sgRNA
cacatccaatcgatgagtgc

SEQ ID NO: 13950 - DNA, 20 bp, Artificial Sequence
  sgRNA
agactttcagaggcccaccc

SEQ ID NO: 13951 - DNA, 20 bp, Artificial Sequence
  sgRNA
gacttggacctggcactgcc

SEQ ID NO: 13952 - DNA, 20 bp, Artificial Sequence
  sgRNA
ggctcaaggtatctaggtag

SEQ ID NO: 13953 - DNA, 20 bp, Artificial Sequence
  sgRNA
ggagatgagtgcacgaggtc

SEQ ID NO: 13954 - DNA, 20 bp, Artificial Sequence
  sgRNA
ggacccggtgtcgagcacag

SEQ ID NO: 13955 - DNA, 20 bp, Artificial Sequence
  sgRNA
gggctcagccgaggaagcaa

SEQ ID NO: 13956 - DNA, 20 bp, Artificial Sequence
  sgRNA
tgtagtccacagtggaaacc

SEQ ID NO: 13957 - DNA, 20 bp, Artificial Sequence
  sgRNA
ggcttcattcataattacaa

SEQ ID NO: 13958 - DNA, 20 bp, Artificial Sequence
  sgRNA
ctgcaccatacagggtgggt

SEQ ID NO: 13959 - DNA, 20 bp, Artificial Sequence
  sgRNA
gggtgtagggcggagttgtc

SEQ ID NO: 13960 - DNA, 20 bp, Artificial Sequence
  sgRNA
tgaccgctcaggtagaattc

SEQ ID NO: 13961 - DNA, 20 bp, Artificial Sequence
  sgRNA
aggaaaggcgtctcaccctc

SEQ ID NO: 13962 - DNA, 20 bp, Artificial Sequence
  sgRNA
tttcagacaggttaggcgac

SEQ ID NO: 13963 - DNA, 20 bp, Artificial Sequence
  sgRNA
agatgagaataacagccgcc

SEQ ID NO: 13964 - DNA, 20 bp, Artificial Sequence
  sgRNA
ccactaggcagtattccttt

SEQ ID NO: 13965 - DNA, 20 bp, Artificial Sequence
  sgRNA
gggagtgcagtctgggatac

SEQ ID NO: 13966 - DNA, 20 bp, Artificial Sequence
  sgRNA
agcacaatctgggcgggtcc

SEQ ID NO: 13967 - DNA, 20 bp, Artificial Sequence
  sgRNA
cctgggagggacagactccc

SEQ ID NO: 13968 - DNA, 20 bp, Artificial Sequence
  sgRNA
ccttgtctctcgcggctgag

SEQ ID NO: 13969 - DNA, 20 bp, Artificial Sequence
  sgRNA
ctcagccctgtgtccgtgcc

SEQ ID NO: 13970 - DNA, 20 bp, Artificial Sequence
  sgRNA
ggcggaggaagaaaggtggc

SEQ ID NO: 13971 - DNA, 20 bp, Artificial Sequence
  sgRNA
caaatgtagggaatcaagag

SEQ ID NO: 13972 - DNA, 20 bp, Artificial Sequence
  sgRNA
ccagctagatgtgtgtcaca

SEQ ID NO: 13973 - DNA, 20 bp, Artificial Sequence
  sgRNA
tcattgtgatggcagttcca

SEQ ID NO: 13974 - DNA, 20 bp, Artificial Sequence
  sgRNA
aggctcagtctgcttaggct

SEQ ID NO: 13975 - DNA, 20 bp, Artificial Sequence
  sgRNA
caagagcctccctatcctcc

SEQ ID NO: 13976 - DNA, 20 bp, Artificial Sequence
  sgRNA
ctaggccaccttcagagccc

SEQ ID NO: 13977 - DNA, 20 bp, Artificial Sequence
  sgRNA
ctgttagttgctgcagctcc

SEQ ID NO: 13978 - DNA, 20 bp, Artificial Sequence
  sgRNA
gcttggatcccgccagatcc

SEQ ID NO: 13979 - DNA, 20 bp, Artificial Sequence
  sgRNA
cgctatgtgtcggtgtgctg

SEQ ID NO: 13980 - DNA, 20 bp, Artificial Sequence
  sgRNA
cctcgcgcgcatgcgtgaca

SEQ ID NO: 13981 - DNA, 20 bp, Artificial Sequence
  sgRNA
ctaactgcagtgagccgcca

SEQ ID NO: 13982 - DNA, 20 bp, Artificial Sequence
  sgRNA
gcgggactggttcttgaagt

SEQ ID NO: 13983 - DNA, 20 bp, Artificial Sequence
  sgRNA
caccggctcaggtggcagag

SEQ ID NO: 13984 - DNA, 20 bp, Artificial Sequence
  sgRNA
gttagatgggctgggagtgg

SEQ ID NO: 13985 - DNA, 20 bp, Artificial Sequence
  sgRNA
cgatactggcgagggcgtcg

SEQ ID NO: 13986 - DNA, 20 bp, Artificial Sequence
  sgRNA
aattattccacaaccatagc

SEQ ID NO: 13987 - DNA, 20 bp, Artificial Sequence
  sgRNA
agcacagtgcacacctgcta

SEQ ID NO: 13988 - DNA, 20 bp, Artificial Sequence
  sgRNA
ataagctgcttcatataaga

SEQ ID NO: 13989 - DNA, 20 bp, Artificial Sequence
  sgRNA
tggtaactggcatattcacg

SEQ ID NO: 13990 - DNA, 20 bp, Artificial Sequence
  sgRNA
gcacaatgataggatcttgt

SEQ ID NO: 13991 - DNA, 20 bp, Artificial Sequence
  sgRNA
gtgtttcctcttggtcaatc

SEQ ID NO: 13992 - DNA, 20 bp, Artificial Sequence
  sgRNA
ggcaagaccctgagctctcc

SEQ ID NO: 13993 - DNA, 20 bp, Artificial Sequence
  sgRNA
aggagggcgaggcgcacgct

SEQ ID NO: 13994 - DNA, 20 bp, Artificial Sequence
  sgRNA
gatggtggtgccgcggctcc

SEQ ID NO: 13995 - DNA, 20 bp, Artificial Sequence
  sgRNA
atgcgcggtaccgtgagcgt

SEQ ID NO: 13996 - DNA, 20 bp, Artificial Sequence
  sgRNA
taaagtacagctgcgcctcc

SEQ ID NO: 13997 - DNA, 20 bp, Artificial Sequence
  sgRNA
tccgatgacgtgcacggcgg

SEQ ID NO: 13998 - DNA, 20 bp, Artificial Sequence
  sgRNA
ccctccgtggctagtcggcc

SEQ ID NO: 13999 - DNA, 20 bp, Artificial Sequence
  sgRNA
ttaacatcgttgtctaggtt

SEQ ID NO: 14000 - DNA, 20 bp, Artificial Sequence
  sgRNA
gaaacggagacgcggaaact

SEQ ID NO: 14001 - DNA, 20 bp, Artificial Sequence
  sgRNA
ctgcccgcgaagcgaccgcc

SEQ ID NO: 14002 - DNA, 20 bp, Artificial Sequence
  sgRNA
gtgcgcggcacggcgcgctc

SEQ ID NO: 14003 - DNA, 20 bp, Artificial Sequence
  sgRNA
ggcgcgaagagggtgctcgt

SEQ ID NO: 14004 - DNA, 20 bp, Artificial Sequence
  sgRNA
gtgtagagaacaggagatag

SEQ ID NO: 14005 - DNA, 20 bp, Artificial Sequence
  sgRNA
attatgagagcaaaggagaa

SEQ ID NO: 14006 - DNA, 20 bp, Artificial Sequence
  sgRNA
attgtagtctcctcccaggt

SEQ ID NO: 14007 - DNA, 20 bp, Artificial Sequence
  sgRNA
gctggacggccatttataag

SEQ ID NO: 14008 - DNA, 20 bp, Artificial Sequence
  sgRNA
tggcaatgcttccgggtcct

SEQ ID NO: 14009 - DNA, 20 bp, Artificial Sequence
  sgRNA
gtgcgagcacgagcagtttg

SEQ ID NO: 14010 - DNA, 20 bp, Artificial Sequence
  sgRNA
ggaggaaatgtcagaggcaa

SEQ ID NO: 14011 - DNA, 20 bp, Artificial Sequence
  sgRNA
tctgcctcttagtcagtggg

SEQ ID NO: 14012 - DNA, 20 bp, Artificial Sequence
  sgRNA
tatgatggctgagatgggtg

SEQ ID NO: 14013 - DNA, 20 bp, Artificial Sequence
  sgRNA
gtctgcatcagctccggaaa

SEQ ID NO: 14014 - DNA, 20 bp, Artificial Sequence
  sgRNA
tactaggcaacgggatgctg

SEQ ID NO: 14015 - DNA, 20 bp, Artificial Sequence
  sgRNA
cactcaagctctgcttcccg

SEQ ID NO: 14016 - DNA, 20 bp, Artificial Sequence
  sgRNA
ggagttccactcacctgctc

SEQ ID NO: 14017 - DNA, 20 bp, Artificial Sequence
  sgRNA
tgtgtgtgtacacgcttggg

SEQ ID NO: 14018 - DNA, 20 bp, Artificial Sequence
  sgRNA
gttctcctggtcaagtcagg

SEQ ID NO: 14019 - DNA, 20 bp, Artificial Sequence
  sgRNA
ccaggtgaccggcagggctc

SEQ ID NO: 14020 - DNA, 20 bp, Artificial Sequence
  sgRNA
taacaatgtcctgcgtttcc

SEQ ID NO: 14021 - DNA, 20 bp, Artificial Sequence
  sgRNA
ttgccggagccgcctcgagg

SEQ ID NO: 14022 - DNA, 20 bp, Artificial Sequence
  sgRNA
cgagcgggcggtgttacggg

SEQ ID NO: 14023 - DNA, 20 bp, Artificial Sequence
  sgRNA
acccagagcatctgaagaag

SEQ ID NO: 14024 - DNA, 20 bp, Artificial Sequence
  sgRNA
cggactgggctaggttagag

SEQ ID NO: 14025 - DNA, 20 bp, Artificial Sequence
  sgRNA
actaattggagcccatgaga

SEQ ID NO: 14026 - DNA, 20 bp, Artificial Sequence
  sgRNA
gagtcttcaagagagctcct

SEQ ID NO: 14027 - DNA, 20 bp, Artificial Sequence
  sgRNA
cctagaaggaatgctaacag

SEQ ID NO: 14028 - DNA, 20 bp, Artificial Sequence
  sgRNA
ataaaccagtttacccggca

SEQ ID NO: 14029 - DNA, 20 bp, Artificial Sequence
  sgRNA
accgatccgtctctaggcag

SEQ ID NO: 14030 - DNA, 20 bp, Artificial Sequence
  sgRNA
cgtgaccacagcctatgccg

SEQ ID NO: 14031 - DNA, 20 bp, Artificial Sequence
  sgRNA
tggcatctcaggttgcagcc

SEQ ID NO: 14032 - DNA, 20 bp, Artificial Sequence
  sgRNA
ttggctgtgcatcttcaaac

SEQ ID NO: 14033 - DNA, 20 bp, Artificial Sequence
  sgRNA
ctcctgtatcaggagagcaa

SEQ ID NO: 14034 - DNA, 20 bp, Artificial Sequence
  sgRNA
tgcaggacagcatacacccg

SEQ ID NO: 14035 - DNA, 20 bp, Artificial Sequence
  sgRNA
gaagagagaattcaaccgca

SEQ ID NO: 14036 - DNA, 20 bp, Artificial Sequence
  sgRNA
aaaggatgtaaactttacag

SEQ ID NO: 14037 - DNA, 20 bp, Artificial Sequence
  sgRNA
tagtctgacctgtcctcctc

SEQ ID NO: 14038 - DNA, 20 bp, Artificial Sequence
  sgRNA
ttcctagacagccgtgctcc

SEQ ID NO: 14039 - DNA, 20 bp, Artificial Sequence
  sgRNA
cgggcagtccagagacgctg

SEQ ID NO: 14040 - DNA, 20 bp, Artificial Sequence
  sgRNA
tgatgtgtagtgttggcaag

SEQ ID NO: 14041 - DNA, 20 bp, Artificial Sequence
  sgRNA
cttcgcgcccaccaatcatc

SEQ ID NO: 14042 - DNA, 20 bp, Artificial Sequence
  sgRNA
gaacgctaccgccagctccg

SEQ ID NO: 14043 - DNA, 20 bp, Artificial Sequence
  sgRNA
gggattgctatcgctttaaa

SEQ ID NO: 14044 - DNA, 20 bp, Artificial Sequence
  sgRNA
cgtgatgatgcaaaccggtg

SEQ ID NO: 14045 - DNA, 20 bp, Artificial Sequence
  sgRNA
gagagatggatagcaagcaa

SEQ ID NO: 14046 - DNA, 20 bp, Artificial Sequence
  sgRNA
ccggtccgcttccggcctcg

SEQ ID NO: 14047 - DNA, 20 bp, Artificial Sequence
  sgRNA
acacgcttcacacttccctt

SEQ ID NO: 14048 - DNA, 20 bp, Artificial Sequence
  sgRNA
agagagcaggccggaagagg

SEQ ID NO: 14049 - DNA, 20 bp, Artificial Sequence
  sgRNA
gcctgggagggtctacctat

SEQ ID NO: 14050 - DNA, 20 bp, Artificial Sequence
  sgRNA
agaggcgtggtcttgcgtag

SEQ ID NO: 14051 - DNA, 20 bp, Artificial Sequence
  sgRNA
gggtacaaaggtgcctagtc

SEQ ID NO: 14052 - DNA, 20 bp, Artificial Sequence
  sgRNA
acctcccttggatctcgccc

SEQ ID NO: 14053 - DNA, 20 bp, Artificial Sequence
  sgRNA
taaacaagcccttccgctgc

SEQ ID NO: 14054 - DNA, 20 bp, Artificial Sequence
  sgRNA
tcctgcggagcgctcctaga

SEQ ID NO: 14055 - DNA, 20 bp, Artificial Sequence
  sgRNA
cacccgtcaccatagcaacg

SEQ ID NO: 14056 - DNA, 20 bp, Artificial Sequence
  sgRNA
gtgagggccagccggagcct

SEQ ID NO: 14057 - DNA, 20 bp, Artificial Sequence
  sgRNA
gggttcccacggtgcggcga

SEQ ID NO: 14058 - DNA, 20 bp, Artificial Sequence
  sgRNA
gctgcacgagctaggtccgc

SEQ ID NO: 14059 - DNA, 20 bp, Artificial Sequence
  sgRNA
gagccgcggcttcaggcgcg

SEQ ID NO: 14060 - DNA, 20 bp, Artificial Sequence
  sgRNA
cccagtggaagtcgtgacgt

SEQ ID NO: 14061 - DNA, 20 bp, Artificial Sequence
  sgRNA
cggaaccgtggtcccacttc

SEQ ID NO: 14062 - DNA, 20 bp, Artificial Sequence
  sgRNA
ggcaagtgcgccttgttcta

SEQ ID NO: 14063 - DNA, 20 bp, Artificial Sequence
  sgRNA
actctcgcgacgcttgcgtc

SEQ ID NO: 14064 - DNA, 20 bp, Artificial Sequence
  sgRNA
ccgcgagatttctgattgcg

SEQ ID NO: 14065 - DNA, 20 bp, Artificial Sequence
  sgRNA
cgtgtgcgagctgtcaacca

SEQ ID NO: 14066 - DNA, 20 bp, Artificial Sequence
  sgRNA
gcgataggtagcaccgcctc

SEQ ID NO: 14067 - DNA, 20 bp, Artificial Sequence
  sgRNA
cgatgtgtttctgcgaacac

SEQ ID NO: 14068 - DNA, 20 bp, Artificial Sequence
  sgRNA
aaacgactttggcaaagtgc

SEQ ID NO: 14069 - DNA, 20 bp, Artificial Sequence
  sgRNA
gctgggcaggagtagccacc

SEQ ID NO: 14070 - DNA, 20 bp, Artificial Sequence
  sgRNA
gagcatttcccagcaaggat

SEQ ID NO: 14071 - DNA, 20 bp, Artificial Sequence
  sgRNA
gaaagcagtagagccacagg

SEQ ID NO: 14072 - DNA, 20 bp, Artificial Sequence
  sgRNA
gggcgagcgctcagtgtggc

SEQ ID NO: 14073 - DNA, 20 bp, Artificial Sequence
  sgRNA
gacaccgggaagcagcctcg

SEQ ID NO: 14074 - DNA, 20 bp, Artificial Sequence
  sgRNA
aagtggtccgggagcggcgg

SEQ ID NO: 14075 - DNA, 20 bp, Artificial Sequence
  sgRNA
gaaagagctacaatgtgatg

SEQ ID NO: 14076 - DNA, 20 bp, Artificial Sequence
  sgRNA
gttggtttgacccttgacct

SEQ ID NO: 14077 - DNA, 20 bp, Artificial Sequence
  sgRNA
ctagggcattggaaccacta

SEQ ID NO: 14078 - DNA, 20 bp, Artificial Sequence
  sgRNA
ttatatctgctggtgtgctt

SEQ ID NO: 14079 - DNA, 20 bp, Artificial Sequence
  sgRNA
aatgcatcagtgattagcga

SEQ ID NO: 14080 - DNA, 20 bp, Artificial Sequence
  sgRNA
attatgtgtgtatattctgg

SEQ ID NO: 14081 - DNA, 20 bp, Artificial Sequence
  sgRNA
aaagagtttaccaggccctg

SEQ ID NO: 14082 - DNA, 20 bp, Artificial Sequence
  sgRNA
tttgtgcaatgctctgtaca

SEQ ID NO: 14083 - DNA, 20 bp, Artificial Sequence
  sgRNA
cgtatctatggactacagga

SEQ ID NO: 14084 - DNA, 20 bp, Artificial Sequence
  sgRNA
tgtcatggtttgaaatcctg

SEQ ID NO: 14085 - DNA, 20 bp, Artificial Sequence
  sgRNA
aggagcatgtcgggaataac

SEQ ID NO: 14086 - DNA, 20 bp, Artificial Sequence
  sgRNA
ggcggtggctggcgtctcat

SEQ ID NO: 14087 - DNA, 20 bp, Artificial Sequence
  sgRNA
ccggtgcggagccacgtggt

SEQ ID NO: 14088 - DNA, 20 bp, Artificial Sequence
  sgRNA
agggcttcgggtgtctctgg

SEQ ID NO: 14089 - DNA, 20 bp, Artificial Sequence
  sgRNA
agcggcccacgcgtgtctct

SEQ ID NO: 14090 - DNA, 20 bp, Artificial Sequence
  sgRNA
aggtctgcacttgtccgctc

SEQ ID NO: 14091 - DNA, 20 bp, Artificial Sequence
  sgRNA
gggacgacccaggagtgaag

SEQ ID NO: 14092 - DNA, 20 bp, Artificial Sequence
  sgRNA
accaaggagtaaaggacttc

SEQ ID NO: 14093 - DNA, 20 bp, Artificial Sequence
  sgRNA
aggtgtgtttgacaatgaat

SEQ ID NO: 14094 - DNA, 20 bp, Artificial Sequence
  sgRNA
aaagctactgcgaaccacct

SEQ ID NO: 14095 - DNA, 20 bp, Artificial Sequence
  sgRNA
tagtcgcgtgctgccacacc

SEQ ID NO: 14096 - DNA, 20 bp, Artificial Sequence
  sgRNA
ggtcactgtcctacacaaat

SEQ ID NO: 14097 - DNA, 20 bp, Artificial Sequence
  sgRNA
tgatgattaactatctcttc

SEQ ID NO: 14098 - DNA, 20 bp, Artificial Sequence
  sgRNA
taaagtgggactttcagatc

SEQ ID NO: 14099 - DNA, 20 bp, Artificial Sequence
  sgRNA
gagaacgagtacttggctta

SEQ ID NO: 14100 - DNA, 20 bp, Artificial Sequence
  sgRNA
ggtgattactcatttggctg

SEQ ID NO: 14101 - DNA, 20 bp, Artificial Sequence
  sgRNA
cctcggcatgggcggccggt

SEQ ID NO: 14102 - DNA, 20 bp, Artificial Sequence
  sgRNA
tacgcggaccgcgcttgtcc

SEQ ID NO: 14103 - DNA, 20 bp, Artificial Sequence
  sgRNA
agctgcaaggttcctgcagc

SEQ ID NO: 14104 - DNA, 20 bp, Artificial Sequence
  sgRNA
cgcaagcgcgaggccgcgca

SEQ ID NO: 14105 - DNA, 20 bp, Artificial Sequence
  sgRNA
aggcacgtatctagggaagg

SEQ ID NO: 14106 - DNA, 20 bp, Artificial Sequence
  sgRNA
gggacttccctggaaggagg

SEQ ID NO: 14107 - DNA, 20 bp, Artificial Sequence
  sgRNA
gaacactgcagctctcacct

SEQ ID NO: 14108 - DNA, 20 bp, Artificial Sequence
  sgRNA
ccacattggacggctgggag

SEQ ID NO: 14109 - DNA, 20 bp, Artificial Sequence
  sgRNA
gtgcaaggcacgcagagtgg

SEQ ID NO: 14110 - DNA, 20 bp, Artificial Sequence
  sgRNA
gggcccaaagggcagatctg

SEQ ID NO: 14111 - DNA, 20 bp, Artificial Sequence
  sgRNA
cactggagaggccgacgctc

SEQ ID NO: 14112 - DNA, 20 bp, Artificial Sequence
  sgRNA
caggagtagtgtgccgcacg

SEQ ID NO: 14113 - DNA, 20 bp, Artificial Sequence
  sgRNA
tccgacccgaaggagagctg

SEQ ID NO: 14114 - DNA, 20 bp, Artificial Sequence
  sgRNA
ctttgtggatgggagcaggg

SEQ ID NO: 14115 - DNA, 20 bp, Artificial Sequence
  sgRNA
gcctattaaataaacccttt

SEQ ID NO: 14116 - DNA, 20 bp, Artificial Sequence
  sgRNA
taatcggatcagagataatg

SEQ ID NO: 14117 - DNA, 20 bp, Artificial Sequence
  sgRNA
gggttcctcacgaagcccag

SEQ ID NO: 14118 - DNA, 20 bp, Artificial Sequence
  sgRNA
gggcgtaggagaggcgggtg

SEQ ID NO: 14119 - DNA, 20 bp, Artificial Sequence
  sgRNA
gtgtgcgaatgcctgtgtgg

SEQ ID NO: 14120 - DNA, 20 bp, Artificial Sequence
  sgRNA
ggagggtcacgtgaacggga

SEQ ID NO: 14121 - DNA, 20 bp, Artificial Sequence
  sgRNA
agcggcgcccgcgtgacaat

SEQ ID NO: 14122 - DNA, 20 bp, Artificial Sequence
  sgRNA
tctcagagatccgtaagcaa

SEQ ID NO: 14123 - DNA, 20 bp, Artificial Sequence
  sgRNA
atgttctctcatcagttaga

SEQ ID NO: 14124 - DNA, 20 bp, Artificial Sequence
  sgRNA
gaattaagaagagacaggtg

SEQ ID NO: 14125 - DNA, 20 bp, Artificial Sequence
  sgRNA
gagtggtacccacctccatg

SEQ ID NO: 14126 - DNA, 20 bp, Artificial Sequence
  sgRNA
gctagctaggaaaggaggcg

SEQ ID NO: 14127 - DNA, 20 bp, Artificial Sequence
  sgRNA
agagggcacctcccttggct

SEQ ID NO: 14128 - DNA, 20 bp, Artificial Sequence
  sgRNA
ctcgcggttggaggaggcac

SEQ ID NO: 14129 - DNA, 20 bp, Artificial Sequence
  sgRNA
ccctcccaaagactagcggg

SEQ ID NO: 14130 - DNA, 20 bp, Artificial Sequence
  sgRNA
tcccgactgcggcgtgactg

SEQ ID NO: 14131 - DNA, 20 bp, Artificial Sequence
  sgRNA
acagccagctgctattggag

SEQ ID NO: 14132 - DNA, 20 bp, Artificial Sequence
  sgRNA
gtagctacttattgggaccg

SEQ ID NO: 14133 - DNA, 20 bp, Artificial Sequence
  sgRNA
agcaggtctacaggcgacag

SEQ ID NO: 14134 - DNA, 20 bp, Artificial Sequence
  sgRNA
tggaggcgggttattgtgag

SEQ ID NO: 14135 - DNA, 20 bp, Artificial Sequence
  sgRNA
agtgcatgctaatgagcgcg

SEQ ID NO: 14136 - DNA, 20 bp, Artificial Sequence
  sgRNA
tcctacctgaggtttggtcc

SEQ ID NO: 14137 - DNA, 20 bp, Artificial Sequence
  sgRNA
tagcttcagcatccctgatc

SEQ ID NO: 14138 - DNA, 20 bp, Artificial Sequence
  sgRNA
gagcgctgggcaggtgatgg

SEQ ID NO: 14139 - DNA, 20 bp, Artificial Sequence
  sgRNA
gtcactagttgggagggatg

SEQ ID NO: 14140 - DNA, 20 bp, Artificial Sequence
  sgRNA
agccgtccagcgctcaccgc

SEQ ID NO: 14141 - DNA, 20 bp, Artificial Sequence
  sgRNA
aaactatatgccgccaaatt

SEQ ID NO: 14142 - DNA, 20 bp, Artificial Sequence
  sgRNA
cttagactaagcctttccgg

SEQ ID NO: 14143 - DNA, 20 bp, Artificial Sequence
  sgRNA
tgtagcagccaatcgaggcg

SEQ ID NO: 14144 - DNA, 20 bp, Artificial Sequence
  sgRNA
tctctaagcttaccctccat

SEQ ID NO: 14145 - DNA, 20 bp, Artificial Sequence
  sgRNA
ttacacgtgcctctctcctg

SEQ ID NO: 14146 - DNA, 20 bp, Artificial Sequence
  sgRNA
tgcctctctgccaagcctgc

SEQ ID NO: 14147 - DNA, 20 bp, Artificial Sequence
  sgRNA
acagggcccaaacaacaatg

SEQ ID NO: 14148 - DNA, 20 bp, Artificial Sequence
  sgRNA
cgccagtgagggagtataaa

SEQ ID NO: 14149 - DNA, 20 bp, Artificial Sequence
  sgRNA
acttctagatcaacacatgt

SEQ ID NO: 14150 - DNA, 20 bp, Artificial Sequence
  sgRNA
cgaccaatgagaagccgaga

SEQ ID NO: 14151 - DNA, 20 bp, Artificial Sequence
  sgRNA
gggactgaacgctgaccggc

SEQ ID NO: 14152 - DNA, 20 bp, Artificial Sequence
  sgRNA
tataaagggcgcacgctctc

SEQ ID NO: 14153 - DNA, 20 bp, Artificial Sequence
  sgRNA
ttacagctccgcctccttaa

SEQ ID NO: 14154 - DNA, 20 bp, Artificial Sequence
  sgRNA
gggaactgtgcgctggcgcg

SEQ ID NO: 14155 - DNA, 20 bp, Artificial Sequence
  sgRNA
gtgcctcgcttggcgcgcct

SEQ ID NO: 14156 - DNA, 20 bp, Artificial Sequence
  sgRNA
ctcagtccctcaggagttgc

SEQ ID NO: 14157 - DNA, 20 bp, Artificial Sequence
  sgRNA
tcagaggagggccagcgccc

SEQ ID NO: 14158 - DNA, 20 bp, Artificial Sequence
  sgRNA
cttggatcagcttctagcag

SEQ ID NO: 14159 - DNA, 20 bp, Artificial Sequence
  sgRNA
ccttgatgcaggcagggctg

SEQ ID NO: 14160 - DNA, 20 bp, Artificial Sequence
  sgRNA
tgagagacaccggcagggaa

SEQ ID NO: 14161 - DNA, 20 bp, Artificial Sequence
  sgRNA
tgcacacacgcatcccaaga

SEQ ID NO: 14162 - DNA, 20 bp, Artificial Sequence
  sgRNA
ccaccagatcctgttaagaa

SEQ ID NO: 14163 - DNA, 20 bp, Artificial Sequence
  sgRNA
ggcaagaggcagagcattgt

SEQ ID NO: 14164 - DNA, 20 bp, Artificial Sequence
  sgRNA
ctctccggcatctctagttt

SEQ ID NO: 14165 - DNA, 20 bp, Artificial Sequence
  sgRNA
cgagcacgacaagagcgcct

SEQ ID NO: 14166 - DNA, 20 bp, Artificial Sequence
  sgRNA
caattggtccctccgagagg

SEQ ID NO: 14167 - DNA, 20 bp, Artificial Sequence
  sgRNA
gggcgtcttgggcgagcttg

SEQ ID NO: 14168 - DNA, 20 bp, Artificial Sequence
  sgRNA
ggacgctgcccggcccaggc

SEQ ID NO: 14169 - DNA, 20 bp, Artificial Sequence
  sgRNA
cctgacctgtcgtcagggag

SEQ ID NO: 14170 - DNA, 20 bp, Artificial Sequence
  sgRNA
gggccgggccgcggaggagg

SEQ ID NO: 14171 - DNA, 20 bp, Artificial Sequence
  sgRNA
ggccagacctccgagcgagc

SEQ ID NO: 14172 - DNA, 20 bp, Artificial Sequence
  sgRNA
gctgaggagctggcggagca

SEQ ID NO: 14173 - DNA, 20 bp, Artificial Sequence
  sgRNA
tggaagatgagggttgggtt

SEQ ID NO: 14174 - DNA, 20 bp, Artificial Sequence
  sgRNA
ggtggctgccgaagtgggcg

SEQ ID NO: 14175 - DNA, 20 bp, Artificial Sequence
  sgRNA
gcgggtgggcggagcaccaa

SEQ ID NO: 14176 - DNA, 20 bp, Artificial Sequence
  sgRNA
gcggccggctcgcagctcac

SEQ ID NO: 14177 - DNA, 20 bp, Artificial Sequence
  sgRNA
agccactgaaatccaagctg

SEQ ID NO: 14178 - DNA, 20 bp, Artificial Sequence
  sgRNA
actctggacttggtgcatcc

SEQ ID NO: 14179 - DNA, 20 bp, Artificial Sequence
  sgRNA
gttggctactgcttctaagc

SEQ ID NO: 14180 - DNA, 20 bp, Artificial Sequence
  sgRNA
gactcagaacggacctatct

SEQ ID NO: 14181 - DNA, 20 bp, Artificial Sequence
  sgRNA
caactaactgtcaagccttg

SEQ ID NO: 14182 - DNA, 20 bp, Artificial Sequence
  sgRNA
cgccctttggattctccagt

SEQ ID NO: 14183 - DNA, 20 bp, Artificial Sequence
  sgRNA
ggcagagacggagcctcgag

SEQ ID NO: 14184 - DNA, 20 bp, Artificial Sequence
  sgRNA
cctatctttctcggtcggcc

SEQ ID NO: 14185 - DNA, 20 bp, Artificial Sequence
  sgRNA
cacatgtattagggcgggcc

SEQ ID NO: 14186 - DNA, 20 bp, Artificial Sequence
  sgRNA
aacaggccacagagtgggag

SEQ ID NO: 14187 - DNA, 20 bp, Artificial Sequence
  sgRNA
aaagatgaggccagaaagtt

SEQ ID NO: 14188 - DNA, 20 bp, Artificial Sequence
  sgRNA
gaggttctgtgcagtgcggg

SEQ ID NO: 14189 - DNA, 20 bp, Artificial Sequence
  sgRNA
taggatgctgcgccaatgtg

SEQ ID NO: 14190 - DNA, 20 bp, Artificial Sequence
  sgRNA
agcttcgtgcactcagtcct

SEQ ID NO: 14191 - DNA, 20 bp, Artificial Sequence
  sgRNA
cctcacagttccgagctaga

SEQ ID NO: 14192 - DNA, 20 bp, Artificial Sequence
  sgRNA
cgtgccactatagacattgt

SEQ ID NO: 14193 - DNA, 20 bp, Artificial Sequence
  sgRNA
ccgagtctctataagagggc

SEQ ID NO: 14194 - DNA, 20 bp, Artificial Sequence
  sgRNA
gcacgcatgcgcgcaaccac

SEQ ID NO: 14195 - DNA, 20 bp, Artificial Sequence
  sgRNA
cccaatttggcctgcacctc

SEQ ID NO: 14196 - DNA, 20 bp, Artificial Sequence
  sgRNA
agtccggaggaacggaggag

SEQ ID NO: 14197 - DNA, 20 bp, Artificial Sequence
  sgRNA
gggcaggctgcgattgaaag

SEQ ID NO: 14198 - DNA, 20 bp, Artificial Sequence
  sgRNA
aaacaatacccaaacttctg

SEQ ID NO: 14199 - DNA, 20 bp, Artificial Sequence
  sgRNA
agcagttacctcagaagttt

SEQ ID NO: 14200 - DNA, 20 bp, Artificial Sequence
  sgRNA
tacggcggtgggcacgcggg

SEQ ID NO: 14201 - DNA, 20 bp, Artificial Sequence
  sgRNA
gtgtggttcctaaccggacg

SEQ ID NO: 14202 - DNA, 20 bp, Artificial Sequence
  sgRNA
gcagtagtccgtcggagcga

SEQ ID NO: 14203 - DNA, 20 bp, Artificial Sequence
  sgRNA
tttctctgggtcgggtagga

SEQ ID NO: 14204 - DNA, 20 bp, Artificial Sequence
  sgRNA
ggcgttaggtcgccgtcctc

SEQ ID NO: 14205 - DNA, 20 bp, Artificial Sequence
  sgRNA
tacacatgcgccctgcggcc

SEQ ID NO: 14206 - DNA, 20 bp, Artificial Sequence
  sgRNA
agcatcatcagctctaatcg

SEQ ID NO: 14207 - DNA, 20 bp, Artificial Sequence
  sgRNA
gttcctcccgccttagggtg

SEQ ID NO: 14208 - DNA, 20 bp, Artificial Sequence
  sgRNA
agccgagtccatcggaggcg

SEQ ID NO: 14209 - DNA, 20 bp, Artificial Sequence
  sgRNA
tttgacgccagagcgacgcg

SEQ ID NO: 14210 - DNA, 20 bp, Artificial Sequence
  sgRNA
tgggctgtgcctgccgcggg

SEQ ID NO: 14211 - DNA, 20 bp, Artificial Sequence
  sgRNA
tcgggcggttgccaagagac

SEQ ID NO: 14212 - DNA, 20 bp, Artificial Sequence
  sgRNA
aggcatgagatccaactgta

SEQ ID NO: 14213 - DNA, 20 bp, Artificial Sequence
  sgRNA
ttgggttctataagaagagc

SEQ ID NO: 14214 - DNA, 20 bp, Artificial Sequence
  sgRNA
ttctcaattagcaatcaagg

SEQ ID NO: 14215 - DNA, 20 bp, Artificial Sequence
  sgRNA
aggtcttagaactggcaggt

SEQ ID NO: 14216 - DNA, 20 bp, Artificial Sequence
  sgRNA
tctgctcacgctacatggtg

SEQ ID NO: 14217 - DNA, 20 bp, Artificial Sequence
  sgRNA
acatgggtgtgtctgaccag

SEQ ID NO: 14218 - DNA, 20 bp, Artificial Sequence
  sgRNA
ccattagagaatatagagag

SEQ ID NO: 14219 - DNA, 20 bp, Artificial Sequence
  sgRNA
cggaagtgacggtccatttg

SEQ ID NO: 14220 - DNA, 20 bp, Artificial Sequence
  sgRNA
aaggaaacatttgccattgg

SEQ ID NO: 14221 - DNA, 20 bp, Artificial Sequence
  sgRNA
ttaagatggtgacagatagg

SEQ ID NO: 14222 - DNA, 20 bp, Artificial Sequence
  sgRNA
atacctgatcgaaggctcct

SEQ ID NO: 14223 - DNA, 20 bp, Artificial Sequence
  sgRNA
agagtttcctttcgactcct

SEQ ID NO: 14224 - DNA, 20 bp, Artificial Sequence
  sgRNA
ttctcttcccttacatcaga

SEQ ID NO: 14225 - DNA, 20 bp, Artificial Sequence
  sgRNA
gacgcaactgaagtctaatg

SEQ ID NO: 14226 - DNA, 20 bp, Artificial Sequence
  sgRNA
ccaataggactgggccgtac

SEQ ID NO: 14227 - DNA, 20 bp, Artificial Sequence
  sgRNA
cgccgcagaggaccactgcc

SEQ ID NO: 14228 - DNA, 20 bp, Artificial Sequence
  sgRNA
cccgggcgctgagttgggcg

SEQ ID NO: 14229 - DNA, 20 bp, Artificial Sequence
  sgRNA
actctgtccgcccaggatcg

SEQ ID NO: 14230 - DNA, 20 bp, Artificial Sequence
  sgRNA
ctgcaagataaaccttggcc

SEQ ID NO: 14231 - DNA, 20 bp, Artificial Sequence
  sgRNA
acactagtacacgtgctccc

SEQ ID NO: 14232 - DNA, 20 bp, Artificial Sequence
  sgRNA
ggagtcagcctgttagggac

SEQ ID NO: 14233 - DNA, 20 bp, Artificial Sequence
  sgRNA
cacactgcacaagacctagt

SEQ ID NO: 14234 - DNA, 20 bp, Artificial Sequence
  sgRNA
tagagaggaagaacgttccc

SEQ ID NO: 14235 - DNA, 20 bp, Artificial Sequence
  sgRNA
gactctaaagacacggtgtg

SEQ ID NO: 14236 - DNA, 20 bp, Artificial Sequence
  sgRNA
catgggaaacctactgtccc

SEQ ID NO: 14237 - DNA, 20 bp, Artificial Sequence
  sgRNA
ccctttaggcagccaggacc

SEQ ID NO: 14238 - DNA, 20 bp, Artificial Sequence
  sgRNA
ggccttctcttaattaccag

SEQ ID NO: 14239 - DNA, 20 bp, Artificial Sequence
  sgRNA
ctccggcgcgctgtccgctg

SEQ ID NO: 14240 - DNA, 20 bp, Artificial Sequence
  sgRNA
ggctgcaagtcaccagactg

SEQ ID NO: 14241 - DNA, 20 bp, Artificial Sequence
  sgRNA
gaagactggccgtcacggga

SEQ ID NO: 14242 - DNA, 20 bp, Artificial Sequence
  sgRNA
gcagagacaggatcggttct

SEQ ID NO: 14243 - DNA, 20 bp, Artificial Sequence
  sgRNA
tttaccctgacgacggtgtt

SEQ ID NO: 14244 - DNA, 20 bp, Artificial Sequence
  sgRNA
cctagcgaaaggctcagctg

SEQ ID NO: 14245 - DNA, 20 bp, Artificial Sequence
  sgRNA
gtgtcttctagtctcaaagc

SEQ ID NO: 14246 - DNA, 20 bp, Artificial Sequence
  sgRNA
ccagttcaaatacagactcc

SEQ ID NO: 14247 - DNA, 20 bp, Artificial Sequence
  sgRNA
taaaggtgtgtgtttctacc

SEQ ID NO: 14248 - DNA, 20 bp, Artificial Sequence
  sgRNA
aagttcttcccagtaacaaa

SEQ ID NO: 14249 - DNA, 20 bp, Artificial Sequence
  sgRNA
gagatgtcgtcatcgcgttc

SEQ ID NO: 14250 - DNA, 20 bp, Artificial Sequence
  sgRNA
tagtccttcagcgccacctg

SEQ ID NO: 14251 - DNA, 20 bp, Artificial Sequence
  sgRNA
gatgccaagccttgcgcgag

SEQ ID NO: 14252 - DNA, 20 bp, Artificial Sequence
  sgRNA
actcattccagagggcgatt

SEQ ID NO: 14253 - DNA, 20 bp, Artificial Sequence
  sgRNA
accagggtttcgggttgcca

SEQ ID NO: 14254 - DNA, 20 bp, Artificial Sequence
  sgRNA
ttcacatacacaagttccct

SEQ ID NO: 14255 - DNA, 20 bp, Artificial Sequence
  sgRNA
ctcacttagagcttgaggat

SEQ ID NO: 14256 - DNA, 20 bp, Artificial Sequence
  sgRNA
agtaggtttctaaaccaagg

SEQ ID NO: 14257 - DNA, 20 bp, Artificial Sequence
  sgRNA
ctaatacatcacccaaccgg

SEQ ID NO: 14258 - DNA, 20 bp, Artificial Sequence
  sgRNA
tagagagagaaacattcact

SEQ ID NO: 14259 - DNA, 20 bp, Artificial Sequence
  sgRNA
ggcgatggaagacagctgcg

SEQ ID NO: 14260 - DNA, 20 bp, Artificial Sequence
  sgRNA
cccgctctgtgcttagagta

SEQ ID NO: 14261 - DNA, 20 bp, Artificial Sequence
  sgRNA
taaatggaaagagactccca

SEQ ID NO: 14262 - DNA, 20 bp, Artificial Sequence
  sgRNA
aggcacatggcgagagcctt

SEQ ID NO: 14263 - DNA, 20 bp, Artificial Sequence
  sgRNA
gaggccgtgacgggaggcgg

SEQ ID NO: 14264 - DNA, 20 bp, Artificial Sequence
  sgRNA
gcgcggagcgacgggcagag

SEQ ID NO: 14265 - DNA, 20 bp, Artificial Sequence
  sgRNA
cccgcccgggtccgggcctt

SEQ ID NO: 14266 - DNA, 20 bp, Artificial Sequence
  sgRNA
aaagctggacttgaacgccc

SEQ ID NO: 14267 - DNA, 20 bp, Artificial Sequence
  sgRNA
ggtctccagcaaagtaaatt

SEQ ID NO: 14268 - DNA, 20 bp, Artificial Sequence
  sgRNA
tacgcagtacctctctccct

SEQ ID NO: 14269 - DNA, 20 bp, Artificial Sequence
  sgRNA
ctcttggtcacaaagcagct

SEQ ID NO: 14270 - DNA, 20 bp, Artificial Sequence
  sgRNA
agtgaggtagagcactcagt

SEQ ID NO: 14271 - DNA, 20 bp, Artificial Sequence
  sgRNA
attgggagatgatctgagag

SEQ ID NO: 14272 - DNA, 20 bp, Artificial Sequence
  sgRNA
tgagatgcagttagacttac

SEQ ID NO: 14273 - DNA, 20 bp, Artificial Sequence
  sgRNA
gtcagcatgatctccagacc

SEQ ID NO: 14274 - DNA, 20 bp, Artificial Sequence
  sgRNA
gttgagcaattataggagct

SEQ ID NO: 14275 - DNA, 20 bp, Artificial Sequence
  sgRNA
agtttctgagtttgggatcg

SEQ ID NO: 14276 - DNA, 20 bp, Artificial Sequence
  sgRNA
ggagacgaaagcccagatgt

SEQ ID NO: 14277 - DNA, 20 bp, Artificial Sequence
  sgRNA
atagggttacaccgctgctg

SEQ ID NO: 14278 - DNA, 20 bp, Artificial Sequence
  sgRNA
aaaggaagggagcgcttccc

SEQ ID NO: 14279 - DNA, 20 bp, Artificial Sequence
  sgRNA
gtagctcttcagcggtagca

SEQ ID NO: 14280 - DNA, 20 bp, Artificial Sequence
  sgRNA
tgggctgctgcgaagcctcc

SEQ ID NO: 14281 - DNA, 20 bp, Artificial Sequence
  sgRNA
ccagaggctcagagcggccc

SEQ ID NO: 14282 - DNA, 20 bp, Artificial Sequence
  sgRNA
aggaagggaggtgtaggccg

SEQ ID NO: 14283 - DNA, 20 bp, Artificial Sequence
  sgRNA
gggcagctggattcccggtc

SEQ ID NO: 14284 - DNA, 20 bp, Artificial Sequence
  sgRNA
cgggaccctcggcacccatt

SEQ ID NO: 14285 - DNA, 20 bp, Artificial Sequence
  sgRNA
gcgcgtggtgggagctccct

SEQ ID NO: 14286 - DNA, 20 bp, Artificial Sequence
  sgRNA
gggcgggacaaccgtcacca

SEQ ID NO: 14287 - DNA, 20 bp, Artificial Sequence
  sgRNA
ctgtggagggcgaaaggacg

SEQ ID NO: 14288 - DNA, 20 bp, Artificial Sequence
  sgRNA
ggcgcagaccgtgtcttacc

SEQ ID NO: 14289 - DNA, 20 bp, Artificial Sequence
  sgRNA
gctgggctatgacggcagag

SEQ ID NO: 14290 - DNA, 20 bp, Artificial Sequence
  sgRNA
ttgcggtggccgcagggagg

SEQ ID NO: 14291 - DNA, 20 bp, Artificial Sequence
  sgRNA
gaggaactaactccgaacgc

SEQ ID NO: 14292 - DNA, 20 bp, Artificial Sequence
  sgRNA
tccgccttacagacccttgc

SEQ ID NO: 14293 - DNA, 20 bp, Artificial Sequence
  sgRNA
gtactggtcaagttcttaat

SEQ ID NO: 14294 - DNA, 20 bp, Artificial Sequence
  sgRNA
ttagtatggactcaactggt

SEQ ID NO: 14295 - DNA, 20 bp, Artificial Sequence
  sgRNA
agttcagaattgcatgagca

SEQ ID NO: 14296 - DNA, 20 bp, Artificial Sequence
  sgRNA
tgcatcctctccattcgttc

SEQ ID NO: 14297 - DNA, 20 bp, Artificial Sequence
  sgRNA
tgattaaacaaatggcaact

SEQ ID NO: 14298 - DNA, 20 bp, Artificial Sequence
  sgRNA
atgtcagtctcgagggattc

SEQ ID NO: 14299 - DNA, 20 bp, Artificial Sequence
  sgRNA
ttaacttgctagctctgggc

SEQ ID NO: 14300 - DNA, 20 bp, Artificial Sequence
  sgRNA
catgccagggcattccagct

SEQ ID NO: 14301 - DNA, 20 bp, Artificial Sequence
  sgRNA
tttcctctagagagatctaa

SEQ ID NO: 14302 - DNA, 20 bp, Artificial Sequence
  sgRNA
ttgatctcatcatatctgaa

SEQ ID NO: 14303 - DNA, 20 bp, Artificial Sequence
  sgRNA
tctcaaccaatcacagaaca

SEQ ID NO: 14304 - DNA, 20 bp, Artificial Sequence
  sgRNA
ggtgtcagccgactgggtgg

SEQ ID NO: 14305 - DNA, 20 bp, Artificial Sequence
  sgRNA
gaggaaaccagccagccgcg

SEQ ID NO: 14306 - DNA, 20 bp, Artificial Sequence
  sgRNA
ctccttcagggattggaggt

SEQ ID NO: 14307 - DNA, 20 bp, Artificial Sequence
  sgRNA
ggtaattcagtctacagcag

SEQ ID NO: 14308 - DNA, 20 bp, Artificial Sequence
  sgRNA
tgaatgtcacattcacaagc

SEQ ID NO: 14309 - DNA, 20 bp, Artificial Sequence
  sgRNA
cttcaattctctaggtttgc

SEQ ID NO: 14310 - DNA, 20 bp, Artificial Sequence
  sgRNA
tgaattcggagtgctcgtgg

SEQ ID NO: 14311 - DNA, 20 bp, Artificial Sequence
  sgRNA
tggtcttaataggtgtgggc

SEQ ID NO: 14312 - DNA, 20 bp, Artificial Sequence
  sgRNA
tgggaaggcgcttcgagcga

SEQ ID NO: 14313 - DNA, 20 bp, Artificial Sequence
  sgRNA
ttcttagatcttgcgcaaag

SEQ ID NO: 14314 - DNA, 20 bp, Artificial Sequence
  sgRNA
ccacgaagaatagccctagg

SEQ ID NO: 14315 - DNA, 20 bp, Artificial Sequence
  sgRNA
atctgatactgtttctttag

SEQ ID NO: 14316 - DNA, 20 bp, Artificial Sequence
  sgRNA
cgcgagagttgaggaagttg

SEQ ID NO: 14317 - DNA, 20 bp, Artificial Sequence
  sgRNA
gccttctattggcccagtga

SEQ ID NO: 14318 - DNA, 20 bp, Artificial Sequence
  sgRNA
tttcactttgtctgtagggc

SEQ ID NO: 14319 - DNA, 20 bp, Artificial Sequence
  sgRNA
atgctttcaacaccacattt

SEQ ID NO: 14320 - DNA, 20 bp, Artificial Sequence
  sgRNA
ttaaggagattatgagaaga

SEQ ID NO: 14321 - DNA, 20 bp, Artificial Sequence
  sgRNA
gggtttgggagatactgagt

SEQ ID NO: 14322 - DNA, 20 bp, Artificial Sequence
  sgRNA
gagcttgcccaaaggcctcc

SEQ ID NO: 14323 - DNA, 20 bp, Artificial Sequence
  sgRNA
ctggaatgagccaccagagt

SEQ ID NO: 14324 - DNA, 20 bp, Artificial Sequence
  sgRNA
gtgcctatccgaccgtggtg

SEQ ID NO: 14325 - DNA, 20 bp, Artificial Sequence
  sgRNA
cgcaggttccctctacccta

SEQ ID NO: 14326 - DNA, 20 bp, Artificial Sequence
  sgRNA
ccggctggattgaaagaggg

SEQ ID NO: 14327 - DNA, 20 bp, Artificial Sequence
  sgRNA
atcataatccggctcacacg

SEQ ID NO: 14328 - DNA, 20 bp, Artificial Sequence
  sgRNA
accatgccgatcacgttctc

SEQ ID NO: 14329 - DNA, 20 bp, Artificial Sequence
  sgRNA
cgagcagcacggcgggctgt

SEQ ID NO: 14330 - DNA, 20 bp, Artificial Sequence
  sgRNA
atatgttgtacactggaagc

SEQ ID NO: 14331 - DNA, 20 bp, Artificial Sequence
  sgRNA
catcctccgccatttatcaa

SEQ ID NO: 14332 - DNA, 20 bp, Artificial Sequence
  sgRNA
gcgggagtgagaagcgcgtt

SEQ ID NO: 14333 - DNA, 20 bp, Artificial Sequence
  sgRNA
tcctggtcggtcactcagcc

SEQ ID NO: 14334 - DNA, 20 bp, Artificial Sequence
  sgRNA
agcgttgggcgcctgagtgg

SEQ ID NO: 14335 - DNA, 20 bp, Artificial Sequence
  sgRNA
cagcctcaattctggtagcc

SEQ ID NO: 14336 - DNA, 20 bp, Artificial Sequence
  sgRNA
tcagtcaaacgttatactgg

SEQ ID NO: 14337 - DNA, 20 bp, Artificial Sequence
  sgRNA
ctgcgcagacatttgtagac

SEQ ID NO: 14338 - DNA, 20 bp, Artificial Sequence
  sgRNA
ggtagctgcgctaagaaagg

SEQ ID NO: 14339 - DNA, 20 bp, Artificial Sequence
  sgRNA
attcttgcagagaatttgtt

SEQ ID NO: 14340 - DNA, 20 bp, Artificial Sequence
  sgRNA
tatcatgcaaatgaagctgc

SEQ ID NO: 14341 - DNA, 20 bp, Artificial Sequence
  sgRNA
cagatattcttgctatagaa

SEQ ID NO: 14342 - DNA, 20 bp, Artificial Sequence
  sgRNA
tctcgaggctcacgccctcg

SEQ ID NO: 14343 - DNA, 20 bp, Artificial Sequence
  sgRNA
tcagccattggctagaaacc

SEQ ID NO: 14344 - DNA, 20 bp, Artificial Sequence
  sgRNA
taattgggcattgaagactt

SEQ ID NO: 14345 - DNA, 20 bp, Artificial Sequence
  sgRNA
tggaactctacaaatctcca

SEQ ID NO: 14346 - DNA, 20 bp, Artificial Sequence
  sgRNA
agataactgtgtaagagctc

SEQ ID NO: 14347 - DNA, 20 bp, Artificial Sequence
  sgRNA
ctgcacgaaatgcttctctt

SEQ ID NO: 14348 - DNA, 20 bp, Artificial Sequence
  sgRNA
cagctgcgccgccaaagccc

SEQ ID NO: 14349 - DNA, 20 bp, Artificial Sequence
  sgRNA
gaagcggcgaggaaggcgag

SEQ ID NO: 14350 - DNA, 20 bp, Artificial Sequence
  sgRNA
cgccgccgggagagtgcctg

SEQ ID NO: 14351 - DNA, 20 bp, Artificial Sequence
  sgRNA
gcgatatacgtgcccactct

SEQ ID NO: 14352 - DNA, 20 bp, Artificial Sequence
  sgRNA
cctgggctaaatcagtagca

SEQ ID NO: 14353 - DNA, 20 bp, Artificial Sequence
  sgRNA
accatctggtaaagaggatg

SEQ ID NO: 14354 - DNA, 20 bp, Artificial Sequence
  sgRNA
agtaacgtcacgccacggcg

SEQ ID NO: 14355 - DNA, 20 bp, Artificial Sequence
  sgRNA
tctggctggcgtggaatctg

SEQ ID NO: 14356 - DNA, 20 bp, Artificial Sequence
  sgRNA
cgcaccggaagttgacggcc

SEQ ID NO: 14357 - DNA, 20 bp, Artificial Sequence
  sgRNA
ctgaggtttgctactgggag

SEQ ID NO: 14358 - DNA, 20 bp, Artificial Sequence
  sgRNA
cttgtgatagcagctgaact

SEQ ID NO: 14359 - DNA, 20 bp, Artificial Sequence
  sgRNA
tgcacaaacttggccacttc

SEQ ID NO: 14360 - DNA, 20 bp, Artificial Sequence
  sgRNA
gagctgatgtggagatggtg

SEQ ID NO: 14361 - DNA, 20 bp, Artificial Sequence
  sgRNA
tccagagaagtcagggaggt

SEQ ID NO: 14362 - DNA, 20 bp, Artificial Sequence
  sgRNA
ggtgtggaggaggccattcc

SEQ ID NO: 14363 - DNA, 20 bp, Artificial Sequence
  sgRNA
tgcttagctgcgcagctttg

SEQ ID NO: 14364 - DNA, 20 bp, Artificial Sequence
  sgRNA
ataaagcattcagccctgcg

SEQ ID NO: 14365 - DNA, 20 bp, Artificial Sequence
  sgRNA
tggctgactgatgtccgcgg

SEQ ID NO: 14366 - DNA, 20 bp, Artificial Sequence
  sgRNA
ctgaacgctcgctttatcag

SEQ ID NO: 14367 - DNA, 20 bp, Artificial Sequence
  sgRNA
gtaaaggtccttctttgccg

SEQ ID NO: 14368 - DNA, 20 bp, Artificial Sequence
  sgRNA
gtagacgggtcccttgcttt

SEQ ID NO: 14369 - DNA, 20 bp, Artificial Sequence
  sgRNA
gggcccgggccagggtctcg

SEQ ID NO: 14370 - DNA, 20 bp, Artificial Sequence
  sgRNA
cggctccctcggcccgcagg

SEQ ID NO: 14371 - DNA, 20 bp, Artificial Sequence
  sgRNA
gcgtgagagggccacgagcc

SEQ ID NO: 14372 - DNA, 20 bp, Artificial Sequence
  sgRNA
atagacactcagcgcgcgca

SEQ ID NO: 14373 - DNA, 20 bp, Artificial Sequence
  sgRNA
gggtcaacttccgttccgag

SEQ ID NO: 14374 - DNA, 20 bp, Artificial Sequence
  sgRNA
cttcgtctccagaagcgaca

SEQ ID NO: 14375 - DNA, 20 bp, Artificial Sequence
  sgRNA
ggcgagggagaggacgccct

SEQ ID NO: 14376 - DNA, 20 bp, Artificial Sequence
  sgRNA
cggaggctggaactcacctg

SEQ ID NO: 14377 - DNA, 20 bp, Artificial Sequence
  sgRNA
ggcggagtttagggaagcag

SEQ ID NO: 14378 - DNA, 20 bp, Artificial Sequence
  sgRNA
tagagtccgccgagtgggct

SEQ ID NO: 14379 - DNA, 20 bp, Artificial Sequence
  sgRNA
agccgcggacccgcccattc

SEQ ID NO: 14380 - DNA, 20 bp, Artificial Sequence
  sgRNA
ccacggcgggtccgcgcgac

SEQ ID NO: 14381 - DNA, 20 bp, Artificial Sequence
  sgRNA
ttaagggcgaaggagggatc

SEQ ID NO: 14382 - DNA, 20 bp, Artificial Sequence
  sgRNA
gcagaggtgtgatccggcag

SEQ ID NO: 14383 - DNA, 20 bp, Artificial Sequence
  sgRNA
ctcagctgatgtcaccgccc

SEQ ID NO: 14384 - DNA, 20 bp, Artificial Sequence
  sgRNA
catgtaggtagcatgggaag

SEQ ID NO: 14385 - DNA, 20 bp, Artificial Sequence
  sgRNA
cccttcccattgttaggctg

SEQ ID NO: 14386 - DNA, 20 bp, Artificial Sequence
  sgRNA
atgtatttaacagggacgtg

SEQ ID NO: 14387 - DNA, 20 bp, Artificial Sequence
  sgRNA
gaggcacccgccgcccttac

SEQ ID NO: 14388 - DNA, 20 bp, Artificial Sequence
  sgRNA
gaacggctgcggacgctagg

SEQ ID NO: 14389 - DNA, 20 bp, Artificial Sequence
  sgRNA
aattctagactaggcaggtc

SEQ ID NO: 14390 - DNA, 20 bp, Artificial Sequence
  sgRNA
ttcctccagctaacgccaag

SEQ ID NO: 14391 - DNA, 20 bp, Artificial Sequence
  sgRNA
tcaaggcgctccagaaaccg

SEQ ID NO: 14392 - DNA, 20 bp, Artificial Sequence
  sgRNA
cgaccctttgtgatgtcacc

SEQ ID NO: 14393 - DNA, 20 bp, Artificial Sequence
  sgRNA
gggatcgccacggctagact

SEQ ID NO: 14394 - DNA, 20 bp, Artificial Sequence
  sgRNA
tctgcgcggtctaacgacag

SEQ ID NO: 14395 - DNA, 20 bp, Artificial Sequence
  sgRNA
ttgggtgagacccgtgtgtg

SEQ ID NO: 14396 - DNA, 20 bp, Artificial Sequence
  sgRNA
gccctctcctctcgggtact

SEQ ID NO: 14397 - DNA, 20 bp, Artificial Sequence
  sgRNA
ggagggagggaggtgcaaag

SEQ ID NO: 14398 - DNA, 20 bp, Artificial Sequence
  sgRNA
ctgtgactcactcagctttg

SEQ ID NO: 14399 - DNA, 20 bp, Artificial Sequence
  sgRNA
gttgttacacctgctagtat

SEQ ID NO: 14400 - DNA, 20 bp, Artificial Sequence
  sgRNA
gcgtctccgacgacccgtag

SEQ ID NO: 14401 - DNA, 20 bp, Artificial Sequence
  sgRNA
cgggatttccggcctcgctc

SEQ ID NO: 14402 - DNA, 20 bp, Artificial Sequence
  sgRNA
tcaagccttctgccacactt

SEQ ID NO: 14403 - DNA, 20 bp, Artificial Sequence
  sgRNA
aaacattcctcaggatgact

SEQ ID NO: 14404 - DNA, 20 bp, Artificial Sequence
  sgRNA
gatagggatgctagcagcat

SEQ ID NO: 14405 - DNA, 20 bp, Artificial Sequence
  sgRNA
ggagctccattgaaccacac

SEQ ID NO: 14406 - DNA, 20 bp, Artificial Sequence
  sgRNA
gtgaacctgtatgtacccgg

SEQ ID NO: 14407 - DNA, 20 bp, Artificial Sequence
  sgRNA
agagcgccagggagggacct

SEQ ID NO: 14408 - DNA, 20 bp, Artificial Sequence
  sgRNA
catgatgaggtcaaagaatt

SEQ ID NO: 14409 - DNA, 20 bp, Artificial Sequence
  sgRNA
taaacattaagcattaccct

SEQ ID NO: 14410 - DNA, 20 bp, Artificial Sequence
  sgRNA
ttcccagaaggttctagtcc

SEQ ID NO: 14411 - DNA, 20 bp, Artificial Sequence
  sgRNA
agttctcagtatttacatac

SEQ ID NO: 14412 - DNA, 20 bp, Artificial Sequence
  sgRNA
tttctgcgcgcggagcttca

SEQ ID NO: 14413 - DNA, 20 bp, Artificial Sequence
  sgRNA
ctgctcagggaagaggcggt

SEQ ID NO: 14414 - DNA, 20 bp, Artificial Sequence
  sgRNA
cgtagttccagacgccgagt

SEQ ID NO: 14415 - DNA, 20 bp, Artificial Sequence
  sgRNA
gagtgttcattggttagctg

SEQ ID NO: 14416 - DNA, 20 bp, Artificial Sequence
  sgRNA
atccagagttagcctatcag

SEQ ID NO: 14417 - DNA, 20 bp, Artificial Sequence
  sgRNA
gtggatttgggacgaactgc

SEQ ID NO: 14418 - DNA, 20 bp, Artificial Sequence
  sgRNA
tttcacgagttactgctaaa

SEQ ID NO: 14419 - DNA, 20 bp, Artificial Sequence
  sgRNA
ttgcgcagccaatgaaacgg

SEQ ID NO: 14420 - DNA, 20 bp, Artificial Sequence
  sgRNA
ggaagctctcacatccaagc

SEQ ID NO: 14421 - DNA, 20 bp, Artificial Sequence
  sgRNA
agacgtgctctgaagactac

SEQ ID NO: 14422 - DNA, 20 bp, Artificial Sequence
  sgRNA
cctaccttattaacttagtg

SEQ ID NO: 14423 - DNA, 20 bp, Artificial Sequence
  sgRNA
gcgggacgcgcccacttggc

SEQ ID NO: 14424 - DNA, 20 bp, Artificial Sequence
  sgRNA
aaggttcgcgaagtgccgct

SEQ ID NO: 14425 - DNA, 20 bp, Artificial Sequence
  sgRNA
ggacgattacccgcgggagg

SEQ ID NO: 14426 - DNA, 20 bp, Artificial Sequence
  sgRNA
tgagctctagcagcaatgac

SEQ ID NO: 14427 - DNA, 20 bp, Artificial Sequence
  sgRNA
ccgtttggagcttaccctga

SEQ ID NO: 14428 - DNA, 20 bp, Artificial Sequence
  sgRNA
ataaaggactttctctagtc

SEQ ID NO: 14429 - DNA, 20 bp, Artificial Sequence
  sgRNA
ggttagcactcgtgattctg

SEQ ID NO: 14430 - DNA, 20 bp, Artificial Sequence
  sgRNA
ctagattaacagtactaacg

SEQ ID NO: 14431 - DNA, 20 bp, Artificial Sequence
  sgRNA
agtgtgtcattacacagaac

SEQ ID NO: 14432 - DNA, 20 bp, Artificial Sequence
  sgRNA
acgaaacttcaagtaccaaa

SEQ ID NO: 14433 - DNA, 20 bp, Artificial Sequence
  sgRNA
acgtggtgctctcgcgagag

SEQ ID NO: 14434 - DNA, 20 bp, Artificial Sequence
  sgRNA
atgctggagtttggtcaatg

SEQ ID NO: 14435 - DNA, 20 bp, Artificial Sequence
  sgRNA
caggcacccttagccaaccc

SEQ ID NO: 14436 - DNA, 20 bp, Artificial Sequence
  sgRNA
atcactcttgtggtgccctg

SEQ ID NO: 14437 - DNA, 20 bp, Artificial Sequence
  sgRNA
ctagtccctacctgtagctc

SEQ ID NO: 14438 - DNA, 20 bp, Artificial Sequence
  sgRNA
gagaggagatggatgtccct

SEQ ID NO: 14439 - DNA, 20 bp, Artificial Sequence
  sgRNA
aacattcggaactggactga

SEQ ID NO: 14440 - DNA, 20 bp, Artificial Sequence
  sgRNA
ccaagacgggaggaaagcct

SEQ ID NO: 14441 - DNA, 20 bp, Artificial Sequence
  sgRNA
gtctgcagagccagcctccg

SEQ ID NO: 14442 - DNA, 20 bp, Artificial Sequence
  sgRNA
ccaacagaagctgtcggagc

SEQ ID NO: 14443 - DNA, 20 bp, Artificial Sequence
  sgRNA
tcgcgcctgcgctacaatcc

SEQ ID NO: 14444 - DNA, 20 bp, Artificial Sequence
  sgRNA
gggacttccgctacgcccgc

SEQ ID NO: 14445 - DNA, 20 bp, Artificial Sequence
  sgRNA
agaagctcctgcggacaagg

SEQ ID NO: 14446 - DNA, 20 bp, Artificial Sequence
  sgRNA
cgctgtcccgcgcatccttg

SEQ ID NO: 14447 - DNA, 20 bp, Artificial Sequence
  sgRNA
gcatccggtcccgcccactg

SEQ ID NO: 14448 - DNA, 20 bp, Artificial Sequence
  sgRNA
ttcaggagaagactttgagc

SEQ ID NO: 14449 - DNA, 20 bp, Artificial Sequence
  sgRNA
ctcccagagtttaatgatcg

SEQ ID NO: 14450 - DNA, 20 bp, Artificial Sequence
  sgRNA
tactgggagaggcacggagc

SEQ ID NO: 14451 - DNA, 20 bp, Artificial Sequence
  sgRNA
gagagagtgtcagagtcact

SEQ ID NO: 14452 - DNA, 20 bp, Artificial Sequence
  sgRNA
tggcggtggcatgagaattg

SEQ ID NO: 14453 - DNA, 20 bp, Artificial Sequence
  sgRNA
cttaaagctcttcccaagct

SEQ ID NO: 14454 - DNA, 20 bp, Artificial Sequence
  sgRNA
tcaggacagacagttaggca

SEQ ID NO: 14455 - DNA, 20 bp, Artificial Sequence
  sgRNA
atgggcagggccaaactccc

SEQ ID NO: 14456 - DNA, 20 bp, Artificial Sequence
  sgRNA
tgcgcgagacacaggtcctg

SEQ ID NO: 14457 - DNA, 20 bp, Artificial Sequence
  sgRNA
atgcgccgtgcaattggcgc

SEQ ID NO: 14458 - DNA, 20 bp, Artificial Sequence
  sgRNA
ccgattcgcttcgaaacttg

SEQ ID NO: 14459 - DNA, 20 bp, Artificial Sequence
  sgRNA
cgaactcctcacaagttctc

SEQ ID NO: 14460 - DNA, 20 bp, Artificial Sequence
  sgRNA
ctcaggtagagattgataaa

SEQ ID NO: 14461 - DNA, 20 bp, Artificial Sequence
  sgRNA
gctcatgggaggagggtctc

SEQ ID NO: 14462 - DNA, 20 bp, Artificial Sequence
  sgRNA
gtcacctgtttgggacgcca

SEQ ID NO: 14463 - DNA, 20 bp, Artificial Sequence
  sgRNA
tgcttggcaaggaacgccac

SEQ ID NO: 14464 - DNA, 20 bp, Artificial Sequence
  sgRNA
tcctgaatcgccctcgcaat

SEQ ID NO: 14465 - DNA, 20 bp, Artificial Sequence
  sgRNA
cggttgtcttcacgtgcttt

SEQ ID NO: 14466 - DNA, 20 bp, Artificial Sequence
  sgRNA
ccataaacatacgcacctcc

SEQ ID NO: 14467 - DNA, 20 bp, Artificial Sequence
  sgRNA
gaagagcataaggacaaccc

SEQ ID NO: 14468 - DNA, 20 bp, Artificial Sequence
  sgRNA
acatacccaaacccagtgtc

SEQ ID NO: 14469 - DNA, 20 bp, Artificial Sequence
  sgRNA
gatgtggacaactggttaag

SEQ ID NO: 14470 - DNA, 20 bp, Artificial Sequence
  sgRNA
agaaagactggaaatggaaa

SEQ ID NO: 14471 - DNA, 20 bp, Artificial Sequence
  sgRNA
ctgagccagtgcacagtgaa

SEQ ID NO: 14472 - DNA, 20 bp, Artificial Sequence
  sgRNA
aggtctcacacttgtgtcat

SEQ ID NO: 14473 - DNA, 20 bp, Artificial Sequence
  sgRNA
gagcagagtccgcaccacct

SEQ ID NO: 14474 - DNA, 20 bp, Artificial Sequence
  sgRNA
agaccgtgccttacatggcc

SEQ ID NO: 14475 - DNA, 20 bp, Artificial Sequence
  sgRNA
caaacacacgtggctgtgca

SEQ ID NO: 14476 - DNA, 20 bp, Artificial Sequence
  sgRNA
gcctggacttatgtagccaa

SEQ ID NO: 14477 - DNA, 20 bp, Artificial Sequence
  sgRNA
gctatctgcaacatcctaga

SEQ ID NO: 14478 - DNA, 20 bp, Artificial Sequence
  sgRNA
aactgcagctaggcacccga

SEQ ID NO: 14479 - DNA, 20 bp, Artificial Sequence
  sgRNA
atttgaagagggacctgcta

SEQ ID NO: 14480 - DNA, 20 bp, Artificial Sequence
  sgRNA
tttcggttctactcctgcag

SEQ ID NO: 14481 - DNA, 20 bp, Artificial Sequence
  sgRNA
cagcttcgcctttgcgcaac

SEQ ID NO: 14482 - DNA, 20 bp, Artificial Sequence
  sgRNA
ctaaggaaggagagcctcga

SEQ ID NO: 14483 - DNA, 20 bp, Artificial Sequence
  sgRNA
ataaagggaattactggcaa

SEQ ID NO: 14484 - DNA, 20 bp, Artificial Sequence
  sgRNA
tgcattcccaatggttaatg

SEQ ID NO: 14485 - DNA, 20 bp, Artificial Sequence
  sgRNA
tgggctatgctaatgaaacc

SEQ ID NO: 14486 - DNA, 20 bp, Artificial Sequence
  sgRNA
gccggatccaaattccaggg

SEQ ID NO: 14487 - DNA, 20 bp, Artificial Sequence
  sgRNA
ccgtgcctttctcgggcctt

SEQ ID NO: 14488 - DNA, 20 bp, Artificial Sequence
  sgRNA
ccagacccggagttaaaggg

SEQ ID NO: 14489 - DNA, 20 bp, Artificial Sequence
  sgRNA
aggctaaagatcggcgcctg

SEQ ID NO: 14490 - DNA, 20 bp, Artificial Sequence
  sgRNA
ttcttcgtattgtgggagag

SEQ ID NO: 14491 - DNA, 20 bp, Artificial Sequence
  sgRNA
tctttctctaaccgaccttc

SEQ ID NO: 14492 - DNA, 20 bp, Artificial Sequence
  sgRNA
aaagggaacttgcccagtgc

SEQ ID NO: 14493 - DNA, 20 bp, Artificial Sequence
  sgRNA
agtggccatgacaagtgtcc

SEQ ID NO: 14494 - DNA, 20 bp, Artificial Sequence
  sgRNA
ggcgtggtgagagcgcagaa

SEQ ID NO: 14495 - DNA, 20 bp, Artificial Sequence
  sgRNA
ctcggaagagagggccgagc

SEQ ID NO: 14496 - DNA, 20 bp, Artificial Sequence
  sgRNA
aaactgcgggaaagacgcct

SEQ ID NO: 14497 - DNA, 20 bp, Artificial Sequence
  sgRNA
acctctgctgattggttctc

SEQ ID NO: 14498 - DNA, 20 bp, Artificial Sequence
  sgRNA
gtggtgtcggattggtcttc

SEQ ID NO: 14499 - DNA, 20 bp, Artificial Sequence
  sgRNA
tttcactcggctcggtcctg

SEQ ID NO: 14500 - DNA, 20 bp, Artificial Sequence
  sgRNA
tgtctctcggtctttccagc

SEQ ID NO: 14501 - DNA, 20 bp, Artificial Sequence
  sgRNA
cttcatgtaataacttctcc

SEQ ID NO: 14502 - DNA, 20 bp, Artificial Sequence
  sgRNA
atctggcctcattcatgaaa

SEQ ID NO: 14503 - DNA, 20 bp, Artificial Sequence
  sgRNA
gttagtgactttactgcatg

SEQ ID NO: 14504 - DNA, 20 bp, Artificial Sequence
  sgRNA
ccaatgcccagcccaaggtt

SEQ ID NO: 14505 - DNA, 20 bp, Artificial Sequence
  sgRNA
attggtcccgcccatctgag

SEQ ID NO: 14506 - DNA, 20 bp, Artificial Sequence
  sgRNA
ccaccgtgacagcttcttaa

SEQ ID NO: 14507 - DNA, 20 bp, Artificial Sequence
  sgRNA
agagaacttcaggctgtccg

SEQ ID NO: 14508 - DNA, 20 bp, Artificial Sequence
  sgRNA
tcactgactgggctaggacc

SEQ ID NO: 14509 - DNA, 20 bp, Artificial Sequence
  sgRNA
gactacccgggagctgtcta

SEQ ID NO: 14510 - DNA, 20 bp, Artificial Sequence
  sgRNA
gtctattagagagagataaa

SEQ ID NO: 14511 - DNA, 20 bp, Artificial Sequence
  sgRNA
ttagtcaatgatgctcaaag

SEQ ID NO: 14512 - DNA, 20 bp, Artificial Sequence
  sgRNA
gggcactctgtaaaggtcaa

SEQ ID NO: 14513 - DNA, 20 bp, Artificial Sequence
  sgRNA
gcacccacttcccatattga

SEQ ID NO: 14514 - DNA, 20 bp, Artificial Sequence
  sgRNA
aacataagcacccatcagct

SEQ ID NO: 14515 - DNA, 20 bp, Artificial Sequence
  sgRNA
gggctaagtggctacccgct

SEQ ID NO: 14516 - DNA, 20 bp, Artificial Sequence
  sgRNA
gcagagcctttggtacgcat

SEQ ID NO: 14517 - DNA, 20 bp, Artificial Sequence
  sgRNA
atcaaaccagcccgctctat

SEQ ID NO: 14518 - DNA, 20 bp, Artificial Sequence
  sgRNA
agactaccaccgtagacaag

SEQ ID NO: 14519 - DNA, 20 bp, Artificial Sequence
  sgRNA
tctcttcctgccagcactgc

SEQ ID NO: 14520 - DNA, 20 bp, Artificial Sequence
  sgRNA
ctatatttaagacggttaca

SEQ ID NO: 14521 - DNA, 20 bp, Artificial Sequence
  sgRNA
ctgagacagtgcggtgacaa

SEQ ID NO: 14522 - DNA, 20 bp, Artificial Sequence
  sgRNA
cgtcgtgacgtctgaacggg

SEQ ID NO: 14523 - DNA, 20 bp, Artificial Sequence
  sgRNA
gcgggacaagcgcccgtttc

SEQ ID NO: 14524 - DNA, 20 bp, Artificial Sequence
  sgRNA
ggtaacggttgcgtctgacg

SEQ ID NO: 14525 - DNA, 20 bp, Artificial Sequence
  sgRNA
agacagattgctctcttact

SEQ ID NO: 14526 - DNA, 20 bp, Artificial Sequence
  sgRNA
gcttataataacaacaaagg

SEQ ID NO: 14527 - DNA, 20 bp, Artificial Sequence
  sgRNA
tagggttctacagttcagaa

SEQ ID NO: 14528 - DNA, 20 bp, Artificial Sequence
  sgRNA
ggctatcagccgggtaggac

SEQ ID NO: 14529 - DNA, 20 bp, Artificial Sequence
  sgRNA
taaactcttccctacttcgc

SEQ ID NO: 14530 - DNA, 20 bp, Artificial Sequence
  sgRNA
tgtggacgtgcattccctga

SEQ ID NO: 14531 - DNA, 20 bp, Artificial Sequence
  sgRNA
aaagccgcactcacgggagg

SEQ ID NO: 14532 - DNA, 20 bp, Artificial Sequence
  sgRNA
ggcacttccggaatcttggc

SEQ ID NO: 14533 - DNA, 20 bp, Artificial Sequence
  sgRNA
gaaccttgctaattcctaga

SEQ ID NO: 14534 - DNA, 20 bp, Artificial Sequence
  sgRNA
ggagagaggacacgacctac

SEQ ID NO: 14535 - DNA, 20 bp, Artificial Sequence
  sgRNA
tctccggcagagtcggttcc

SEQ ID NO: 14536 - DNA, 20 bp, Artificial Sequence
  sgRNA
ttcaggcgggacaactgttc

SEQ ID NO: 14537 - DNA, 20 bp, Artificial Sequence
  sgRNA
ctgtgtttagaagcgttgct

SEQ ID NO: 14538 - DNA, 20 bp, Artificial Sequence
  sgRNA
tatgggtaaaggtgctgagt

SEQ ID NO: 14539 - DNA, 20 bp, Artificial Sequence
  sgRNA
ctagtttacccaaatgagaa

SEQ ID NO: 14540 - DNA, 20 bp, Artificial Sequence
  sgRNA
gcctagtgggcaatgaacca

SEQ ID NO: 14541 - DNA, 20 bp, Artificial Sequence
  sgRNA
ggaagagtgcctgcaaatgg

SEQ ID NO: 14542 - DNA, 20 bp, Artificial Sequence
  sgRNA
gggtggtcacaccttaggtt

SEQ ID NO: 14543 - DNA, 20 bp, Artificial Sequence
  sgRNA
ggtcactaccaagtttggtt

SEQ ID NO: 14544 - DNA, 20 bp, Artificial Sequence
  sgRNA
agcgcactgggcgtggttag

SEQ ID NO: 14545 - DNA, 20 bp, Artificial Sequence
  sgRNA
aagagctcccgggaaccgcc

SEQ ID NO: 14546 - DNA, 20 bp, Artificial Sequence
  sgRNA
ggacttgggagcgtggctag

SEQ ID NO: 14547 - DNA, 20 bp, Artificial Sequence
  sgRNA
agcggttagccggcgccact

SEQ ID NO: 14548 - DNA, 20 bp, Artificial Sequence
  sgRNA
gggctccggagagagagccg

SEQ ID NO: 14549 - DNA, 20 bp, Artificial Sequence
  sgRNA
gaggtggaatttataacccg

SEQ ID NO: 14550 - DNA, 20 bp, Artificial Sequence
  sgRNA
acaaacagaaacccaactgt

SEQ ID NO: 14551 - DNA, 20 bp, Artificial Sequence
  sgRNA
gccgccgggagccctcaaac

SEQ ID NO: 14552 - DNA, 20 bp, Artificial Sequence
  sgRNA
tgggctcagataaggaggcg

SEQ ID NO: 14553 - DNA, 20 bp, Artificial Sequence
  sgRNA
cgtgggacaactcaaagtcc

SEQ ID NO: 14554 - DNA, 20 bp, Artificial Sequence
  sgRNA
catgaagggactgcttctac

SEQ ID NO: 14555 - DNA, 20 bp, Artificial Sequence
  sgRNA
tggctggctgtacgtgagaa

SEQ ID NO: 14556 - DNA, 20 bp, Artificial Sequence
  sgRNA
gacagggtatcctagcggag

SEQ ID NO: 14557 - DNA, 20 bp, Artificial Sequence
  sgRNA
gctgagcttatggtggcctc

SEQ ID NO: 14558 - DNA, 20 bp, Artificial Sequence
  sgRNA
cttaacctcgtgtttgcacg

SEQ ID NO: 14559 - DNA, 20 bp, Artificial Sequence
  sgRNA
gacgcagggcgctaaattcc

SEQ ID NO: 14560 - DNA, 20 bp, Artificial Sequence
  sgRNA
cgggcgtcagcttggagctg

SEQ ID NO: 14561 - DNA, 20 bp, Artificial Sequence
  sgRNA
gcggcgatatgggcgggtgg

SEQ ID NO: 14562 - DNA, 20 bp, Artificial Sequence
  sgRNA
gtgaggtgctagtttaggtc

SEQ ID NO: 14563 - DNA, 20 bp, Artificial Sequence
  sgRNA
tgggcacctgatgtccacct

SEQ ID NO: 14564 - DNA, 20 bp, Artificial Sequence
  sgRNA
ctcagctctttctcatcaga

SEQ ID NO: 14565 - DNA, 20 bp, Artificial Sequence
  sgRNA
agaaccatctgtggctcctg

SEQ ID NO: 14566 - DNA, 20 bp, Artificial Sequence
  sgRNA
cttctggcgtggagcgccgc

SEQ ID NO: 14567 - DNA, 20 bp, Artificial Sequence
  sgRNA
gtcctcgttgggctacgcgg

SEQ ID NO: 14568 - DNA, 20 bp, Artificial Sequence
  sgRNA
gggattccgcaagggttcgt

SEQ ID NO: 14569 - DNA, 20 bp, Artificial Sequence
  sgRNA
ttaaagacacgcccacgtca

SEQ ID NO: 14570 - DNA, 20 bp, Artificial Sequence
  sgRNA
ttaatctctctagggaggaa

SEQ ID NO: 14571 - DNA, 20 bp, Artificial Sequence
  sgRNA
ttgggaactggaatgtcaca

SEQ ID NO: 14572 - DNA, 20 bp, Artificial Sequence
  sgRNA
gggtggctaggaatggtatg

SEQ ID NO: 14573 - DNA, 20 bp, Artificial Sequence
  sgRNA
aaatgacaccagggcaacgt

SEQ ID NO: 14574 - DNA, 20 bp, Artificial Sequence
  sgRNA
ctgagctcgtgggacagcct

SEQ ID NO: 14575 - DNA, 20 bp, Artificial Sequence
  sgRNA
tctgtttgctttctcctaac

SEQ ID NO: 14576 - DNA, 20 bp, Artificial Sequence
  sgRNA
tgaatgagtctttcgccaat

SEQ ID NO: 14577 - DNA, 20 bp, Artificial Sequence
  sgRNA
gcagtctttcagtggattta

SEQ ID NO: 14578 - DNA, 20 bp, Artificial Sequence
  sgRNA
ctgtctgaaacataacagca

SEQ ID NO: 14579 - DNA, 20 bp, Artificial Sequence
  sgRNA
taactgtgcgcagtgttcaa

SEQ ID NO: 14580 - DNA, 20 bp, Artificial Sequence
  sgRNA
tcgtcctatgcctgagcggc

SEQ ID NO: 14581 - DNA, 20 bp, Artificial Sequence
  sgRNA
gttactagtgtgacaaaggc

SEQ ID NO: 14582 - DNA, 20 bp, Artificial Sequence
  sgRNA
gtaggtactgtgctctgcca

SEQ ID NO: 14583 - DNA, 20 bp, Artificial Sequence
  sgRNA
atgctcgcacagtgtcctca

SEQ ID NO: 14584 - DNA, 20 bp, Artificial Sequence
  sgRNA
gcacacgtgcagagaacata

SEQ ID NO: 14585 - DNA, 20 bp, Artificial Sequence
  sgRNA
gccacaaagtaaccgcgtcc

SEQ ID NO: 14586 - DNA, 20 bp, Artificial Sequence
  sgRNA
aggtaacagtacagtgggac

SEQ ID NO: 14587 - DNA, 20 bp, Artificial Sequence
  sgRNA
ataagtcttctcactgagcc

SEQ ID NO: 14588 - DNA, 20 bp, Artificial Sequence
  sgRNA
aagttatgtctaagcccaga

SEQ ID NO: 14589 - DNA, 20 bp, Artificial Sequence
  sgRNA
ctcattgggctgtgtcaagg

SEQ ID NO: 14590 - DNA, 20 bp, Artificial Sequence
  sgRNA
gaacaatatctggagagatc

SEQ ID NO: 14591 - DNA, 20 bp, Artificial Sequence
  sgRNA
ctggtgattatagagaaata

SEQ ID NO: 14592 - DNA, 20 bp, Artificial Sequence
  sgRNA
aagggagagagctctaaggc

SEQ ID NO: 14593 - DNA, 20 bp, Artificial Sequence
  sgRNA
cagcctggaaagcaagtagt

SEQ ID NO: 14594 - DNA, 20 bp, Artificial Sequence
  sgRNA
atatagggtgtcaagggatg

SEQ ID NO: 14595 - DNA, 20 bp, Artificial Sequence
  sgRNA
gagcagtgatcatgtggtac

SEQ ID NO: 14596 - DNA, 20 bp, Artificial Sequence
  sgRNA
tgtgactgagccgacgaagc

SEQ ID NO: 14597 - DNA, 20 bp, Artificial Sequence
  sgRNA
cccagttattcacaaccgcc

SEQ ID NO: 14598 - DNA, 20 bp, Artificial Sequence
  sgRNA
actgtcaagagctgtcatga

SEQ ID NO: 14599 - DNA, 20 bp, Artificial Sequence
  sgRNA
aaggagctggatagatcaac

SEQ ID NO: 14600 - DNA, 20 bp, Artificial Sequence
  sgRNA
ggcctcccgggcacgttccg

SEQ ID NO: 14601 - DNA, 20 bp, Artificial Sequence
  sgRNA
ctcgtcatatccgttagccg

SEQ ID NO: 14602 - DNA, 20 bp, Artificial Sequence
  sgRNA
ctcctccgtggccaaggtca

SEQ ID NO: 14603 - DNA, 20 bp, Artificial Sequence
  sgRNA
aaacacattaagagacactg

SEQ ID NO: 14604 - DNA, 20 bp, Artificial Sequence
  sgRNA
aggctcgtttgtgtctattt

SEQ ID NO: 14605 - DNA, 20 bp, Artificial Sequence
  sgRNA
ggtggcgcttcgggattgtt

SEQ ID NO: 14606 - DNA, 20 bp, Artificial Sequence
  sgRNA
gatgcttccagggcagcccg

SEQ ID NO: 14607 - DNA, 20 bp, Artificial Sequence
  sgRNA
gacacgatgagtggaggcgt

SEQ ID NO: 14608 - DNA, 20 bp, Artificial Sequence
  sgRNA
gggcttgtaaccgaatccac

SEQ ID NO: 14609 - DNA, 20 bp, Artificial Sequence
  sgRNA
ctcgctcaaccgggtccctc

SEQ ID NO: 14610 - DNA, 20 bp, Artificial Sequence
  sgRNA
agacgggcccgattggctgc

SEQ ID NO: 14611 - DNA, 20 bp, Artificial Sequence
  sgRNA
agagtgttacgaagtttaaa

SEQ ID NO: 14612 - DNA, 20 bp, Artificial Sequence
  sgRNA
ggctgaggagctccgcgcac

SEQ ID NO: 14613 - DNA, 20 bp, Artificial Sequence
  sgRNA
gtagactcaacaagttccag

SEQ ID NO: 14614 - DNA, 20 bp, Artificial Sequence
  sgRNA
accctattgatttcttcttc

SEQ ID NO: 14615 - DNA, 20 bp, Artificial Sequence
  sgRNA
ggtgagacaggattccggct

SEQ ID NO: 14616 - DNA, 20 bp, Artificial Sequence
  sgRNA
gggatgcagacttgttcctc

SEQ ID NO: 14617 - DNA, 20 bp, Artificial Sequence
  sgRNA
ccctcaccgggtcccgtctg

SEQ ID NO: 14618 - DNA, 20 bp, Artificial Sequence
  sgRNA
tgggccctctgcaggtagcg

SEQ ID NO: 14619 - DNA, 20 bp, Artificial Sequence
  sgRNA
ccgatagccgttcctttccc

SEQ ID NO: 14620 - DNA, 20 bp, Artificial Sequence
  sgRNA
tcgcctgtgatggtggcatc

SEQ ID NO: 14621 - DNA, 20 bp, Artificial Sequence
  sgRNA
gcccttctctcctacgcccg

SEQ ID NO: 14622 - DNA, 20 bp, Artificial Sequence
  sgRNA
ggatactctccgctgatcca

SEQ ID NO: 14623 - DNA, 20 bp, Artificial Sequence
  sgRNA
gcttgcagttcacgtcatca

SEQ ID NO: 14624 - DNA, 20 bp, Artificial Sequence
  sgRNA
tttcaggactcgcctttatt

SEQ ID NO: 14625 - DNA, 20 bp, Artificial Sequence
  sgRNA
aattgctaacaatcagatag

SEQ ID NO: 14626 - DNA, 20 bp, Artificial Sequence
  sgRNA
tgtttgaagacccagggcac

SEQ ID NO: 14627 - DNA, 20 bp, Artificial Sequence
  sgRNA
gtgtatctatctctgcgtag

SEQ ID NO: 14628 - DNA, 20 bp, Artificial Sequence
  sgRNA
gatgtcaccacaacgcgtcg

SEQ ID NO: 14629 - DNA, 20 bp, Artificial Sequence
  sgRNA
agtttgaatagtggcgtagc

SEQ ID NO: 14630 - DNA, 20 bp, Artificial Sequence
  sgRNA
ttaatctcctttggatttag

SEQ ID NO: 14631 - DNA, 20 bp, Artificial Sequence
  sgRNA
aggttcaactaccgttccca

SEQ ID NO: 14632 - DNA, 20 bp, Artificial Sequence
  sgRNA
gggttgtgattccaagcagg

SEQ ID NO: 14633 - DNA, 20 bp, Artificial Sequence
  sgRNA
gctggagatgtagggatggg

SEQ ID NO: 14634 - DNA, 20 bp, Artificial Sequence
  sgRNA
gggagtctcatgctcagatc

SEQ ID NO: 14635 - DNA, 20 bp, Artificial Sequence
  sgRNA
catcaagatccttagggatg

SEQ ID NO: 14636 - DNA, 20 bp, Artificial Sequence
  sgRNA
ggagcgcgctgtggactccg

SEQ ID NO: 14637 - DNA, 20 bp, Artificial Sequence
  sgRNA
ggaggagcgagcggactggt

SEQ ID NO: 14638 - DNA, 20 bp, Artificial Sequence
  sgRNA
agaccgccgaggtttggtgc

SEQ ID NO: 14639 - DNA, 20 bp, Artificial Sequence
  sgRNA
tgctttgtgcctgccaaacc

SEQ ID NO: 14640 - DNA, 20 bp, Artificial Sequence
  sgRNA
ggcgctcccggcccgagaca

SEQ ID NO: 14641 - DNA, 20 bp, Artificial Sequence
  sgRNA
cactgaggtcaaagttctga

SEQ ID NO: 14642 - DNA, 20 bp, Artificial Sequence
  sgRNA
tggaggcgttccttgtttga

SEQ ID NO: 14643 - DNA, 20 bp, Artificial Sequence
  sgRNA
ggcctctgaccactttggcc

SEQ ID NO: 14644 - DNA, 20 bp, Artificial Sequence
  sgRNA
ggatgtcagacaggaagaac

SEQ ID NO: 14645 - DNA, 20 bp, Artificial Sequence
  sgRNA
gggtggagaggccatttaaa

SEQ ID NO: 14646 - DNA, 20 bp, Artificial Sequence
  sgRNA
ctggtgaatctggctgcgtg

SEQ ID NO: 14647 - DNA, 20 bp, Artificial Sequence
  sgRNA
ggtgaggccttggccacagg

SEQ ID NO: 14648 - DNA, 20 bp, Artificial Sequence
  sgRNA
cttcggtgcctagcgggtgc

SEQ ID NO: 14649 - DNA, 20 bp, Artificial Sequence
  sgRNA
gcagccctgcccagattaag

SEQ ID NO: 14650 - DNA, 20 bp, Artificial Sequence
  sgRNA
ggtcaacgtgaggaatttag

SEQ ID NO: 14651 - DNA, 20 bp, Artificial Sequence
  sgRNA
gaagcattctcatagaccag

SEQ ID NO: 14652 - DNA, 20 bp, Artificial Sequence
  sgRNA
agttgctctcagcggctaca

SEQ ID NO: 14653 - DNA, 20 bp, Artificial Sequence
  sgRNA
gcagacacaccttatgagtc

SEQ ID NO: 14654 - DNA, 20 bp, Artificial Sequence
  sgRNA
gggctgcctagccattggct

SEQ ID NO: 14655 - DNA, 20 bp, Artificial Sequence
  sgRNA
gaggcagtctttgagagtcc

SEQ ID NO: 14656 - DNA, 20 bp, Artificial Sequence
  sgRNA
ccaggcgtgtcctgttggcc

SEQ ID NO: 14657 - DNA, 20 bp, Artificial Sequence
  sgRNA
gacatcctcttgtacaccgt

SEQ ID NO: 14658 - DNA, 20 bp, Artificial Sequence
  sgRNA
tgtgtgatgtgctctgcact

SEQ ID NO: 14659 - DNA, 20 bp, Artificial Sequence
  sgRNA
gaaagtctccaaatacagtc

SEQ ID NO: 14660 - DNA, 20 bp, Artificial Sequence
  sgRNA
gtctgattccctggcgcggc

SEQ ID NO: 14661 - DNA, 20 bp, Artificial Sequence
  sgRNA
atttaaggcgctgcgcggcc

SEQ ID NO: 14662 - DNA, 20 bp, Artificial Sequence
  sgRNA
tttctacttgtgcatgggct

SEQ ID NO: 14663 - DNA, 20 bp, Artificial Sequence
  sgRNA
cactaaccctgagccaagag

SEQ ID NO: 14664 - DNA, 20 bp, Artificial Sequence
  sgRNA
tggtaaggtctaggaggctt

SEQ ID NO: 14665 - DNA, 20 bp, Artificial Sequence
  sgRNA
gcagttgtgcaggtctcacg

SEQ ID NO: 14666 - DNA, 20 bp, Artificial Sequence
  sgRNA
agagaggcatagcgccatat

SEQ ID NO: 14667 - DNA, 20 bp, Artificial Sequence
  sgRNA
taggcaaagaaatggtggcc

SEQ ID NO: 14668 - DNA, 20 bp, Artificial Sequence
  sgRNA
gaatggctgggccctgtagt

SEQ ID NO: 14669 - DNA, 20 bp, Artificial Sequence
  sgRNA
gcacgtgggattccaaccgt

SEQ ID NO: 14670 - DNA, 20 bp, Artificial Sequence
  sgRNA
tcttggttctataatagagc

SEQ ID NO: 14671 - DNA, 20 bp, Artificial Sequence
  sgRNA
gtagctaggtaacaagcact

SEQ ID NO: 14672 - DNA, 20 bp, Artificial Sequence
  sgRNA
gtcatcacacatcataaagc

SEQ ID NO: 14673 - DNA, 20 bp, Artificial Sequence
  sgRNA
ctgggcatcaccaagcaaat

SEQ ID NO: 14674 - DNA, 20 bp, Artificial Sequence
  sgRNA
ggtgcaactgagactggaca

SEQ ID NO: 14675 - DNA, 20 bp, Artificial Sequence
  sgRNA
ctagagcgggttgttgaatc

SEQ ID NO: 14676 - DNA, 20 bp, Artificial Sequence
  sgRNA
atttgtcacccgtcttgggc

SEQ ID NO: 14677 - DNA, 20 bp, Artificial Sequence
  sgRNA
gccgagtctaagctcgctgc

SEQ ID NO: 14678 - DNA, 20 bp, Artificial Sequence
  sgRNA
tttggctggctggtaacctg

SEQ ID NO: 14679 - DNA, 20 bp, Artificial Sequence
  sgRNA
gccacctgcgtcgacggcgg

SEQ ID NO: 14680 - DNA, 20 bp, Artificial Sequence
  sgRNA
atggatcacaaacagacgta

SEQ ID NO: 14681 - DNA, 20 bp, Artificial Sequence
  sgRNA
ccattcaacccaagtctgcc

SEQ ID NO: 14682 - DNA, 20 bp, Artificial Sequence
  sgRNA
gctatgttcggagtattaag

SEQ ID NO: 14683 - DNA, 20 bp, Artificial Sequence
  sgRNA
ggaatcagttacaattcctc

SEQ ID NO: 14684 - DNA, 20 bp, Artificial Sequence
  sgRNA
ctttgaacttgtaaagactg

SEQ ID NO: 14685 - DNA, 20 bp, Artificial Sequence
  sgRNA
tgacggctttcttaagacat

SEQ ID NO: 14686 - DNA, 20 bp, Artificial Sequence
  sgRNA
gtgcgcggacagccatttcc

SEQ ID NO: 14687 - DNA, 20 bp, Artificial Sequence
  sgRNA
cctcgcggccgagagaggtt

SEQ ID NO: 14688 - DNA, 20 bp, Artificial Sequence
  sgRNA
cgcacgcgcggcgtgtcacg

SEQ ID NO: 14689 - DNA, 20 bp, Artificial Sequence
  sgRNA
tgggagtctccagttccttc

SEQ ID NO: 14690 - DNA, 20 bp, Artificial Sequence
  sgRNA
taggactgggaggttgccgg

SEQ ID NO: 14691 - DNA, 20 bp, Artificial Sequence
  sgRNA
tgtctgtctgaactaggccg

SEQ ID NO: 14692 - DNA, 20 bp, Artificial Sequence
  sgRNA
tttatatcttgaaactcagc

SEQ ID NO: 14693 - DNA, 20 bp, Artificial Sequence
  sgRNA
tgaggttgagtatcactagg

SEQ ID NO: 14694 - DNA, 20 bp, Artificial Sequence
  sgRNA
tttgcttagataaagaggag

SEQ ID NO: 14695 - DNA, 20 bp, Artificial Sequence
  sgRNA
gatagacactcctacagaga

SEQ ID NO: 14696 - DNA, 20 bp, Artificial Sequence
  sgRNA
aagccaggaagtcagcccaa

SEQ ID NO: 14697 - DNA, 20 bp, Artificial Sequence
  sgRNA
ggtgggtttgtagtgcagag

SEQ ID NO: 14698 - DNA, 20 bp, Artificial Sequence
  sgRNA
gagtaagcctagaaatctct

SEQ ID NO: 14699 - DNA, 20 bp, Artificial Sequence
  sgRNA
ggatataaagttgaccgctt

SEQ ID NO: 14700 - DNA, 20 bp, Artificial Sequence
  sgRNA
ttcacagagctagtgacccg

SEQ ID NO: 14701 - DNA, 20 bp, Artificial Sequence
  sgRNA
aatgaggatagctgatgcag

SEQ ID NO: 14702 - DNA, 20 bp, Artificial Sequence
  sgRNA
acaactagaggcctcgggac

SEQ ID NO: 14703 - DNA, 20 bp, Artificial Sequence
  sgRNA
ccaggcagccggaggttgac

SEQ ID NO: 14704 - DNA, 20 bp, Artificial Sequence
  sgRNA
aggaaggtagtgccgagctg

SEQ ID NO: 14705 - DNA, 20 bp, Artificial Sequence
  sgRNA
gaagcaacatttattcagta

SEQ ID NO: 14706 - DNA, 20 bp, Artificial Sequence
  sgRNA
cctagctcggagggatgtca

SEQ ID NO: 14707 - DNA, 20 bp, Artificial Sequence
  sgRNA
tagggagagacacccgccaa

SEQ ID NO: 14708 - DNA, 20 bp, Artificial Sequence
  sgRNA
caagggtgggaagggcgagc

SEQ ID NO: 14709 - DNA, 20 bp, Artificial Sequence
  sgRNA
gtatttctttgaaatcccga

SEQ ID NO: 14710 - DNA, 20 bp, Artificial Sequence
  sgRNA
tctgtagctgccggatgagg

SEQ ID NO: 14711 - DNA, 20 bp, Artificial Sequence
  sgRNA
ccattcttcccaggctaagg

SEQ ID NO: 14712 - DNA, 20 bp, Artificial Sequence
  sgRNA
gtgatggaagggagcactcc

SEQ ID NO: 14713 - DNA, 20 bp, Artificial Sequence
  sgRNA
tcctctgcatcagtttggag

SEQ ID NO: 14714 - DNA, 20 bp, Artificial Sequence
  sgRNA
agatgcgaactggcaaccaa

SEQ ID NO: 14715 - DNA, 20 bp, Artificial Sequence
  sgRNA
agacacagagtttaagcttt

SEQ ID NO: 14716 - DNA, 20 bp, Artificial Sequence
  sgRNA
gggttggcgcgagagtcaaa

SEQ ID NO: 14717 - DNA, 20 bp, Artificial Sequence
  sgRNA
cagtcgtggcgcgtggagtg

SEQ ID NO: 14718 - DNA, 20 bp, Artificial Sequence
  sgRNA
gagagaggctgaaatgtcgt

SEQ ID NO: 14719 - DNA, 20 bp, Artificial Sequence
  sgRNA
tcataaatatgcgcccgcca

SEQ ID NO: 14720 - DNA, 20 bp, Artificial Sequence
  sgRNA
aaattccgtagactcgccta

SEQ ID NO: 14721 - DNA, 20 bp, Artificial Sequence
  sgRNA
ttggaagggagaaagactta

SEQ ID NO: 14722 - DNA, 20 bp, Artificial Sequence
  sgRNA
ccgcctctcagagtaacgat

SEQ ID NO: 14723 - DNA, 20 bp, Artificial Sequence
  sgRNA
gataagtacttcaggaatcc

SEQ ID NO: 14724 - DNA, 20 bp, Artificial Sequence
  sgRNA
cggctctcccgatagcagct

SEQ ID NO: 14725 - DNA, 20 bp, Artificial Sequence
  sgRNA
aaacgggcatcaggcaacag

SEQ ID NO: 14726 - DNA, 20 bp, Artificial Sequence
  sgRNA
cgagtacgtgccgggagtct

SEQ ID NO: 14727 - DNA, 20 bp, Artificial Sequence
  sgRNA
tcctcgtccggagactgctg

SEQ ID NO: 14728 - DNA, 20 bp, Artificial Sequence
  sgRNA
agtccgggccggagcatttc

SEQ ID NO: 14729 - DNA, 20 bp, Artificial Sequence
  sgRNA
aacggattcctggcagcctc

SEQ ID NO: 14730 - DNA, 20 bp, Artificial Sequence
  sgRNA
tgagagatcaaatgctaaat

SEQ ID NO: 14731 - DNA, 20 bp, Artificial Sequence
  sgRNA
ccacgcagatgcagtacagc

SEQ ID NO: 14732 - DNA, 20 bp, Artificial Sequence
  sgRNA
gtttctatttcccagatccc

SEQ ID NO: 14733 - DNA, 20 bp, Artificial Sequence
  sgRNA
tcggtgatggaacacactgt

SEQ ID NO: 14734 - DNA, 20 bp, Artificial Sequence
  sgRNA
aaagatgattgctcaagccc

SEQ ID NO: 14735 - DNA, 20 bp, Artificial Sequence
  sgRNA
ctagacgatattaagtgctt

SEQ ID NO: 14736 - DNA, 20 bp, Artificial Sequence
  sgRNA
tcagcaggttccctcgcctc

SEQ ID NO: 14737 - DNA, 20 bp, Artificial Sequence
  sgRNA
aaagtagcggaccggaaggg

SEQ ID NO: 14738 - DNA, 20 bp, Artificial Sequence
  sgRNA
cgtggctaagaacggagtcg

SEQ ID NO: 14739 - DNA, 20 bp, Artificial Sequence
  sgRNA
agcgggtcacgacgctgcgg

SEQ ID NO: 14740 - DNA, 20 bp, Artificial Sequence
  sgRNA
accttgtgtgacagtggcac

SEQ ID NO: 14741 - DNA, 20 bp, Artificial Sequence
  sgRNA
gggtaatggttaacagcaat

SEQ ID NO: 14742 - DNA, 20 bp, Artificial Sequence
  sgRNA
aggtagggcgcaagacctgg

SEQ ID NO: 14743 - DNA, 20 bp, Artificial Sequence
  sgRNA
aagacgctgcaaggaagcat

SEQ ID NO: 14744 - DNA, 20 bp, Artificial Sequence
  sgRNA
agcgctgcagccgcagaggc

SEQ ID NO: 14745 - DNA, 20 bp, Artificial Sequence
  sgRNA
ccggcttctatgagctcacg

SEQ ID NO: 14746 - DNA, 20 bp, Artificial Sequence
  sgRNA
gggagcggcggcgtccctct

SEQ ID NO: 14747 - DNA, 20 bp, Artificial Sequence
  sgRNA
actgcaaactgacgccgacg

SEQ ID NO: 14748 - DNA, 20 bp, Artificial Sequence
  sgRNA
cggaacttaatagacaccaa

SEQ ID NO: 14749 - DNA, 20 bp, Artificial Sequence
  sgRNA
gacagtgagaagcgcaaacc

SEQ ID NO: 14750 - DNA, 20 bp, Artificial Sequence
  sgRNA
tttaatgttgggtggtgatg

SEQ ID NO: 14751 - DNA, 20 bp, Artificial Sequence
  sgRNA
aagctatttagaaagcgatg

SEQ ID NO: 14752 - DNA, 20 bp, Artificial Sequence
  sgRNA
ttcagattgtactctgtacg

SEQ ID NO: 14753 - DNA, 20 bp, Artificial Sequence
  sgRNA
cgcgttgggatcgcggcgtg

SEQ ID NO: 14754 - DNA, 20 bp, Artificial Sequence
  sgRNA
ctaagatttcactccgcgcc

SEQ ID NO: 14755 - DNA, 20 bp, Artificial Sequence
  sgRNA
gatagtctccaaactcactt

SEQ ID NO: 14756 - DNA, 20 bp, Artificial Sequence
  sgRNA
ggctgcctgccttctcggcg

SEQ ID NO: 14757 - DNA, 20 bp, Artificial Sequence
  sgRNA
ggactaccagcaagcctgtg

SEQ ID NO: 14758 - DNA, 20 bp, Artificial Sequence
  sgRNA
tcgcaggctcagatagcgcg

SEQ ID NO: 14759 - DNA, 20 bp, Artificial Sequence
  sgRNA
gagaggtgtgaacgaggtgt

SEQ ID NO: 14760 - DNA, 20 bp, Artificial Sequence
  sgRNA
cacaggtgtcctatccattg

SEQ ID NO: 14761 - DNA, 20 bp, Artificial Sequence
  sgRNA
cacctcctggtggaacatct

SEQ ID NO: 14762 - DNA, 20 bp, Artificial Sequence
  sgRNA
agagcagcatcgggaagtag

SEQ ID NO: 14763 - DNA, 20 bp, Artificial Sequence
  sgRNA
aaggatgcagggttaggaaa

SEQ ID NO: 14764 - DNA, 20 bp, Artificial Sequence
  sgRNA
agaatgagatgtcaattcag

SEQ ID NO: 14765 - DNA, 20 bp, Artificial Sequence
  sgRNA
ggctcgcgaccatagagaag

SEQ ID NO: 14766 - DNA, 20 bp, Artificial Sequence
  sgRNA
taattcacactccggtgaag

SEQ ID NO: 14767 - DNA, 20 bp, Artificial Sequence
  sgRNA
cgagtctagttctattaagt

SEQ ID NO: 14768 - DNA, 20 bp, Artificial Sequence
  sgRNA
tagctgtgagatgcagcgtt

SEQ ID NO: 14769 - DNA, 20 bp, Artificial Sequence
  sgRNA
tctatgatctatgtcagaca

SEQ ID NO: 14770 - DNA, 20 bp, Artificial Sequence
  sgRNA
tttgctttctcggttagagg

SEQ ID NO: 14771 - DNA, 20 bp, Artificial Sequence
  sgRNA
gcccgtctgtggagcgcgta

SEQ ID NO: 14772 - DNA, 20 bp, Artificial Sequence
  sgRNA
gaagggtcttaaccgaaagg

SEQ ID NO: 14773 - DNA, 20 bp, Artificial Sequence
  sgRNA
tgagctcacaatcccggccg

SEQ ID NO: 14774 - DNA, 20 bp, Artificial Sequence
  sgRNA
aaaccaggcgcggatcaggc

SEQ ID NO: 14775 - DNA, 20 bp, Artificial Sequence
  sgRNA
gggcatgcgcgagttggcgc

SEQ ID NO: 14776 - DNA, 20 bp, Artificial Sequence
  sgRNA
cccgccaaaccggttccagc

SEQ ID NO: 14777 - DNA, 20 bp, Artificial Sequence
  sgRNA
acccgtttgtgacacatcac

SEQ ID NO: 14778 - DNA, 20 bp, Artificial Sequence
  sgRNA
ctataaacgacaggattacc

SEQ ID NO: 14779 - DNA, 20 bp, Artificial Sequence
  sgRNA
cctgctaattactggcagcc

SEQ ID NO: 14780 - DNA, 20 bp, Artificial Sequence
  sgRNA
ctacatttcccaagagtctc

SEQ ID NO: 14781 - DNA, 20 bp, Artificial Sequence
  sgRNA
tgtgacgagtgcccgcgcgg

SEQ ID NO: 14782 - DNA, 20 bp, Artificial Sequence
  sgRNA
gcggcctgagcgcgcgtaag

SEQ ID NO: 14783 - DNA, 20 bp, Artificial Sequence
  sgRNA
gaattgtgagtagacagaac

SEQ ID NO: 14784 - DNA, 20 bp, Artificial Sequence
  sgRNA
agcagggttcaaagttctac

SEQ ID NO: 14785 - DNA, 20 bp, Artificial Sequence
  sgRNA
tatggtgagtttaacactaa

SEQ ID NO: 14786 - DNA, 20 bp, Artificial Sequence
  sgRNA
tgctagctgacaaatagact

SEQ ID NO: 14787 - DNA, 20 bp, Artificial Sequence
  sgRNA
ctctgcgcgggatgacgccc

SEQ ID NO: 14788 - DNA, 20 bp, Artificial Sequence
  sgRNA
cgccatggaggccaacgctg

SEQ ID NO: 14789 - DNA, 20 bp, Artificial Sequence
  sgRNA
ctgcgcttgcccgggaaccc

SEQ ID NO: 14790 - DNA, 20 bp, Artificial Sequence
  sgRNA
tcattgctgcagaaggctgt

SEQ ID NO: 14791 - DNA, 20 bp, Artificial Sequence
  sgRNA
gccggcccgaggtgggtccc

SEQ ID NO: 14792 - DNA, 20 bp, Artificial Sequence
  sgRNA
aagaatttcagccaagctgg

SEQ ID NO: 14793 - DNA, 20 bp, Artificial Sequence
  sgRNA
cactaagaaatattcaccaa

SEQ ID NO: 14794 - DNA, 20 bp, Artificial Sequence
  sgRNA
gactttaaagtctattccat

SEQ ID NO: 14795 - DNA, 20 bp, Artificial Sequence
  sgRNA
ttccgtaaacttgacttagt

SEQ ID NO: 14796 - DNA, 20 bp, Artificial Sequence
  sgRNA
ccattattggcgttcatccc

SEQ ID NO: 14797 - DNA, 20 bp, Artificial Sequence
  sgRNA
aggcactcacctttagatag

SEQ ID NO: 14798 - DNA, 20 bp, Artificial Sequence
  sgRNA
ctggccatgtggctgtataa

SEQ ID NO: 14799 - DNA, 20 bp, Artificial Sequence
  sgRNA
taactggcaccgccctgcgg

SEQ ID NO: 14800 - DNA, 20 bp, Artificial Sequence
  sgRNA
taaatgttgctctccagctt

SEQ ID NO: 14801 - DNA, 20 bp, Artificial Sequence
  sgRNA
acactggcttgtgcaagatg

SEQ ID NO: 14802 - DNA, 20 bp, Artificial Sequence
  sgRNA
ccaggaacctttctgatatt

SEQ ID NO: 14803 - DNA, 20 bp, Artificial Sequence
  sgRNA
ctcctgctggaagcgaaacg

SEQ ID NO: 14804 - DNA, 20 bp, Artificial Sequence
  sgRNA
cgctcggccgcgcgtcggga

SEQ ID NO: 14805 - DNA, 20 bp, Artificial Sequence
  sgRNA
ggaggcgccgagccgtcctg

SEQ ID NO: 14806 - DNA, 20 bp, Artificial Sequence
  sgRNA
gggcggccgggcgcagcctg

SEQ ID NO: 14807 - DNA, 20 bp, Artificial Sequence
  sgRNA
aaccgacccaacatggcgcc

SEQ ID NO: 14808 - DNA, 20 bp, Artificial Sequence
  sgRNA
ggaaggcggtgacgcgctcc

SEQ ID NO: 14809 - DNA, 20 bp, Artificial Sequence
  sgRNA
gagcccggcgaagagttcag

SEQ ID NO: 14810 - DNA, 20 bp, Artificial Sequence
  sgRNA
tactggaggtgatttattat

SEQ ID NO: 14811 - DNA, 20 bp, Artificial Sequence
  sgRNA
acatttgcctacaatataag

SEQ ID NO: 14812 - DNA, 20 bp, Artificial Sequence
  sgRNA
tttaacctcttgaccctaaa

SEQ ID NO: 14813 - DNA, 20 bp, Artificial Sequence
  sgRNA
gggaacctagccgggaaaga

SEQ ID NO: 14814 - DNA, 20 bp, Artificial Sequence
  sgRNA
gcgccagcatttggagcggg

SEQ ID NO: 14815 - DNA, 20 bp, Artificial Sequence
  sgRNA
cgcgaggcgcgctgtaggcg

SEQ ID NO: 14816 - DNA, 20 bp, Artificial Sequence
  sgRNA
ggcctggctgtaatgaggga

SEQ ID NO: 14817 - DNA, 20 bp, Artificial Sequence
  sgRNA
tgagcttgagcctaaggctt

SEQ ID NO: 14818 - DNA, 20 bp, Artificial Sequence
  sgRNA
ttcaaatctcatttcctgtc

SEQ ID NO: 14819 - DNA, 20 bp, Artificial Sequence
  sgRNA
cgcacgtgacccgcagtttg

SEQ ID NO: 14820 - DNA, 20 bp, Artificial Sequence
  sgRNA
gggcacttccgaggccgctc

SEQ ID NO: 14821 - DNA, 20 bp, Artificial Sequence
  sgRNA
ctctgctggcctcctaatcc

SEQ ID NO: 14822 - DNA, 20 bp, Artificial Sequence
  sgRNA
acatagtagctatgttgaca

SEQ ID NO: 14823 - DNA, 20 bp, Artificial Sequence
  sgRNA
gggaatcacttgtgtagctc

SEQ ID NO: 14824 - DNA, 20 bp, Artificial Sequence
  sgRNA
ccgctctgctgtgcgattta

SEQ ID NO: 14825 - DNA, 20 bp, Artificial Sequence
  sgRNA
atgacggacgggcggaccgg

SEQ ID NO: 14826 - DNA, 20 bp, Artificial Sequence
  sgRNA
ggctggcggcttcgaagccc

SEQ ID NO: 14827 - DNA, 20 bp, Artificial Sequence
  sgRNA
cgagacacctgctgcacagg

SEQ ID NO: 14828 - DNA, 20 bp, Artificial Sequence
  sgRNA
gaagacaggcggtggaccaa

SEQ ID NO: 14829 - DNA, 20 bp, Artificial Sequence
  sgRNA
caactaggcagttggactcc

SEQ ID NO: 14830 - DNA, 20 bp, Artificial Sequence
  sgRNA
gttgaatcccatgccagttc

SEQ ID NO: 14831 - DNA, 20 bp, Artificial Sequence
  sgRNA
ggagcggcgcgcaaaccttc

SEQ ID NO: 14832 - DNA, 20 bp, Artificial Sequence
  sgRNA
gaagtgaacagcaggcgacc

SEQ ID NO: 14833 - DNA, 20 bp, Artificial Sequence
  sgRNA
ctgcgcagccgagaggcggg

SEQ ID NO: 14834 - DNA, 20 bp, Artificial Sequence
  sgRNA
ggcgcatgcgcgcggactag

SEQ ID NO: 14835 - DNA, 20 bp, Artificial Sequence
  sgRNA
gtgtgtctcgccctgagccg

SEQ ID NO: 14836 - DNA, 20 bp, Artificial Sequence
  sgRNA
ccgcggcgaggtgaccgccc

SEQ ID NO: 14837 - DNA, 20 bp, Artificial Sequence
  sgRNA
gtggctggctgactaggttt

SEQ ID NO: 14838 - DNA, 20 bp, Artificial Sequence
  sgRNA
cacctgcgtcagatgctagc

SEQ ID NO: 14839 - DNA, 20 bp, Artificial Sequence
  sgRNA
gaaaggtgcccgaactccct

SEQ ID NO: 14840 - DNA, 20 bp, Artificial Sequence
  sgRNA
ggctggcttctccatcatgg

SEQ ID NO: 14841 - DNA, 20 bp, Artificial Sequence
  sgRNA
cccaggctgcctgtcacttg

SEQ ID NO: 14842 - DNA, 20 bp, Artificial Sequence
  sgRNA
gctctgccagaggcgggatg

SEQ ID NO: 14843 - DNA, 20 bp, Artificial Sequence
  sgRNA
caacctgcattaacttgaac

SEQ ID NO: 14844 - DNA, 20 bp, Artificial Sequence
  sgRNA
atggacacctttagagtaag

SEQ ID NO: 14845 - DNA, 20 bp, Artificial Sequence
  sgRNA
ccctccaaagattggatgac

SEQ ID NO: 14846 - DNA, 20 bp, Artificial Sequence
  sgRNA
cccgtaagactttccattgg

SEQ ID NO: 14847 - DNA, 20 bp, Artificial Sequence
  sgRNA
gccgcctcctgaggccatca

SEQ ID NO: 14848 - DNA, 20 bp, Artificial Sequence
  sgRNA
gactggctagagagcgactc

SEQ ID NO: 14849 - DNA, 20 bp, Artificial Sequence
  sgRNA
ctctgttgggcgtgttgcct

SEQ ID NO: 14850 - DNA, 20 bp, Artificial Sequence
  sgRNA
ctacactggagtgcgttgcc

SEQ ID NO: 14851 - DNA, 20 bp, Artificial Sequence
  sgRNA
taggtggcaaagttggctca

SEQ ID NO: 14852 - DNA, 20 bp, Artificial Sequence
  sgRNA
ggcctgaatcactttctttg

SEQ ID NO: 14853 - DNA, 20 bp, Artificial Sequence
  sgRNA
tggtaatctgcactcactga

SEQ ID NO: 14854 - DNA, 20 bp, Artificial Sequence
  sgRNA
gctcacgcctgcgcgtgcgc

SEQ ID NO: 14855 - DNA, 20 bp, Artificial Sequence
  sgRNA
aaatggctgcccggcccaca

SEQ ID NO: 14856 - DNA, 20 bp, Artificial Sequence
  sgRNA
ctagtgggcgtgaaggaggc

SEQ ID NO: 14857 - DNA, 20 bp, Artificial Sequence
  sgRNA
agtgtggctctggaggtttg

SEQ ID NO: 14858 - DNA, 20 bp, Artificial Sequence
  sgRNA
tctttctctgagtttgggag

SEQ ID NO: 14859 - DNA, 20 bp, Artificial Sequence
  sgRNA
ctctcttagccttgagctgg

SEQ ID NO: 14860 - DNA, 20 bp, Artificial Sequence
  sgRNA
tgtctcagcgtctatttggc

SEQ ID NO: 14861 - DNA, 20 bp, Artificial Sequence
  sgRNA
ggatttgtagtccagcattc

SEQ ID NO: 14862 - DNA, 20 bp, Artificial Sequence
  sgRNA
gggcgtggctctctgaggta

SEQ ID NO: 14863 - DNA, 20 bp, Artificial Sequence
  sgRNA
gacgctgtacactgttgtta

SEQ ID NO: 14864 - DNA, 20 bp, Artificial Sequence
  sgRNA
ttgtagttctgagactcaaa

SEQ ID NO: 14865 - DNA, 20 bp, Artificial Sequence
  sgRNA
catggagaccatgcacgctt

SEQ ID NO: 14866 - DNA, 20 bp, Artificial Sequence
  sgRNA
ggacctaagaggcgcggccg

SEQ ID NO: 14867 - DNA, 20 bp, Artificial Sequence
  sgRNA
gcgctctgcctgcccagtgg

SEQ ID NO: 14868 - DNA, 20 bp, Artificial Sequence
  sgRNA
gcggagcaggtggtcacggg

SEQ ID NO: 14869 - DNA, 20 bp, Artificial Sequence
  sgRNA
accctaaacatgatgtcatc

SEQ ID NO: 14870 - DNA, 20 bp, Artificial Sequence
  sgRNA
cccaggtccgaggtgagttg

SEQ ID NO: 14871 - DNA, 20 bp, Artificial Sequence
  sgRNA
ctgacttaagtggtcctcag

SEQ ID NO: 14872 - DNA, 20 bp, Artificial Sequence
  sgRNA
gtgctttgattggttgcctg

SEQ ID NO: 14873 - DNA, 20 bp, Artificial Sequence
  sgRNA
tgcacacgtttgatgcttga

SEQ ID NO: 14874 - DNA, 20 bp, Artificial Sequence
  sgRNA
catcgggaccatctgcctag

SEQ ID NO: 14875 - DNA, 20 bp, Artificial Sequence
  sgRNA
gctctggtcgcgccgccgaa

SEQ ID NO: 14876 - DNA, 20 bp, Artificial Sequence
  sgRNA
aagtttcctgctgtcaactc

SEQ ID NO: 14877 - DNA, 20 bp, Artificial Sequence
  sgRNA
tgagcccaccgcggcccggg

SEQ ID NO: 14878 - DNA, 20 bp, Artificial Sequence
  sgRNA
acgcctccacccgggtcgcg

SEQ ID NO: 14879 - DNA, 20 bp, Artificial Sequence
  sgRNA
gctctccatcagtcgttccg

SEQ ID NO: 14880 - DNA, 20 bp, Artificial Sequence
  sgRNA
gggcgggcagcctccagacc

SEQ ID NO: 14881 - DNA, 20 bp, Artificial Sequence
  sgRNA
tctgccctataaatgcaggt

SEQ ID NO: 14882 - DNA, 20 bp, Artificial Sequence
  sgRNA
ttagagaaggcactctttga

SEQ ID NO: 14883 - DNA, 20 bp, Artificial Sequence
  sgRNA
ttgatgttcctctgttctga

SEQ ID NO: 14884 - DNA, 20 bp, Artificial Sequence
  sgRNA
atccacgtggcagagggacc

SEQ ID NO: 14885 - DNA, 20 bp, Artificial Sequence
  sgRNA
aaagcccggaccagctatcc

SEQ ID NO: 14886 - DNA, 20 bp, Artificial Sequence
  sgRNA
tgaggaaacaaactcgttca

SEQ ID NO: 14887 - DNA, 20 bp, Artificial Sequence
  sgRNA
gaggtgtggcagcagaccat

SEQ ID NO: 14888 - DNA, 20 bp, Artificial Sequence
  sgRNA
tggcttagaagctctacttc

SEQ ID NO: 14889 - DNA, 20 bp, Artificial Sequence
  sgRNA
tgtagtccacggacgcttgt

SEQ ID NO: 14890 - DNA, 20 bp, Artificial Sequence
  sgRNA
gtatgtctacagataacttc

SEQ ID NO: 14891 - DNA, 20 bp, Artificial Sequence
  sgRNA
gacttcaatactcgttgttt

SEQ ID NO: 14892 - DNA, 20 bp, Artificial Sequence
  sgRNA
gaagcttagtgcaggaggtg

SEQ ID NO: 14893 - DNA, 20 bp, Artificial Sequence
  sgRNA
ctgcatacttaggcactgca

SEQ ID NO: 14894 - DNA, 20 bp, Artificial Sequence
  sgRNA
tggaaacaggatcctgcaag

SEQ ID NO: 14895 - DNA, 20 bp, Artificial Sequence
  sgRNA
aaccgtatggcgcggctcct

SEQ ID NO: 14896 - DNA, 20 bp, Artificial Sequence
  sgRNA
gtgacgcacttcctattgcg

SEQ ID NO: 14897 - DNA, 20 bp, Artificial Sequence
  sgRNA
agatgcaacgtcatcacgcc

SEQ ID NO: 14898 - DNA, 20 bp, Artificial Sequence
  sgRNA
tgaacccgaaaggttagcgt

SEQ ID NO: 14899 - DNA, 20 bp, Artificial Sequence
  sgRNA
gctgcttcgggagtgcgctt

SEQ ID NO: 14900 - DNA, 20 bp, Artificial Sequence
  sgRNA
tctaactctggaaggcgcag

SEQ ID NO: 14901 - DNA, 20 bp, Artificial Sequence
  sgRNA
ccgaagggcccggtgtcggg

SEQ ID NO: 14902 - DNA, 20 bp, Artificial Sequence
  sgRNA
ggtgggtgcgcctcttggtt

SEQ ID NO: 14903 - DNA, 20 bp, Artificial Sequence
  sgRNA
tcagacaagaaatccagttc

SEQ ID NO: 14904 - DNA, 20 bp, Artificial Sequence
  sgRNA
ttgaggagtaaatagcacct

SEQ ID NO: 14905 - DNA, 20 bp, Artificial Sequence
  sgRNA
cccgcgtcgcctgccgtggg

SEQ ID NO: 14906 - DNA, 20 bp, Artificial Sequence
  sgRNA
ggctgaggtgagaaccgcga

SEQ ID NO: 14907 - DNA, 20 bp, Artificial Sequence
  sgRNA
tggttggatgccggaacctt

SEQ ID NO: 14908 - DNA, 20 bp, Artificial Sequence
  sgRNA
ttccaagcggtgcaacgagc

SEQ ID NO: 14909 - DNA, 20 bp, Artificial Sequence
  sgRNA
gtggctagagggattggcgc

SEQ ID NO: 14910 - DNA, 20 bp, Artificial Sequence
  sgRNA
cgcgtagcagcgtcgaggcg

SEQ ID NO: 14911 - DNA, 20 bp, Artificial Sequence
  sgRNA
gggcaggagcatacccacag

SEQ ID NO: 14912 - DNA, 20 bp, Artificial Sequence
  sgRNA
ggagtggagattgatttcgg

SEQ ID NO: 14913 - DNA, 20 bp, Artificial Sequence
  sgRNA
tgtgggcagccacaattagc

SEQ ID NO: 14914 - DNA, 20 bp, Artificial Sequence
  sgRNA
aagattccagtagggacttt

SEQ ID NO: 14915 - DNA, 20 bp, Artificial Sequence
  sgRNA
attcaccacaagcacagcaa

SEQ ID NO: 14916 - DNA, 20 bp, Artificial Sequence
  sgRNA
tccttggctgggtccagtga

SEQ ID NO: 14917 - DNA, 20 bp, Artificial Sequence
  sgRNA
gtactgggttctttagctcc

SEQ ID NO: 14918 - DNA, 20 bp, Artificial Sequence
  sgRNA
ttatcccaccaatcggtctc

SEQ ID NO: 14919 - DNA, 20 bp, Artificial Sequence
  sgRNA
acgggtcaggccttggttca

SEQ ID NO: 14920 - DNA, 20 bp, Artificial Sequence
  sgRNA
ttctagaagagactgtcagg

SEQ ID NO: 14921 - DNA, 20 bp, Artificial Sequence
  sgRNA
cccgagccagaggtgaggga

SEQ ID NO: 14922 - DNA, 20 bp, Artificial Sequence
  sgRNA
gggaccatcccaacaacttc

SEQ ID NO: 14923 - DNA, 20 bp, Artificial Sequence
  sgRNA
gttctgtaccgggcaggaac

SEQ ID NO: 14924 - DNA, 20 bp, Artificial Sequence
  sgRNA
tagggagagggcttagggct

SEQ ID NO: 14925 - DNA, 20 bp, Artificial Sequence
  sgRNA
ctgttaggttcataaacact

SEQ ID NO: 14926 - DNA, 20 bp, Artificial Sequence
  sgRNA
ggaaaggtaaggtatcttcc

SEQ ID NO: 14927 - DNA, 20 bp, Artificial Sequence
  sgRNA
cgtccgctgctcggcggcca

SEQ ID NO: 14928 - DNA, 20 bp, Artificial Sequence
  sgRNA
aggcgggaaaggtgtgagca

SEQ ID NO: 14929 - DNA, 20 bp, Artificial Sequence
  sgRNA
ggcgccacagcgccctcgtg

SEQ ID NO: 14930 - DNA, 20 bp, Artificial Sequence
  sgRNA
gaggagctgtgggattggcc

SEQ ID NO: 14931 - DNA, 20 bp, Artificial Sequence
  sgRNA
gggaccatgagaatcaaggt

SEQ ID NO: 14932 - DNA, 20 bp, Artificial Sequence
  sgRNA
gtcactaagtggatgaatag

SEQ ID NO: 14933 - DNA, 20 bp, Artificial Sequence
  sgRNA
cactccttcgtcagatttag

SEQ ID NO: 14934 - DNA, 20 bp, Artificial Sequence
  sgRNA
aaactgcagttctaaagctc

SEQ ID NO: 14935 - DNA, 20 bp, Artificial Sequence
  sgRNA
tagtcccgagaatttgctgc

SEQ ID NO: 14936 - DNA, 20 bp, Artificial Sequence
  sgRNA
tatccctgtcagaacaatgg

SEQ ID NO: 14937 - DNA, 20 bp, Artificial Sequence
  sgRNA
gattctcaggcagtcttatc

SEQ ID NO: 14938 - DNA, 20 bp, Artificial Sequence
  sgRNA
ctcccagccaaaggcagcta

SEQ ID NO: 14939 - DNA, 20 bp, Artificial Sequence
  sgRNA
agctgtttgcggcgacgatc

SEQ ID NO: 14940 - DNA, 20 bp, Artificial Sequence
  sgRNA
aatctagtgcgcatgctctt

SEQ ID NO: 14941 - DNA, 20 bp, Artificial Sequence
  sgRNA
ccttccgattgggcggcggt

SEQ ID NO: 14942 - DNA, 20 bp, Artificial Sequence
  sgRNA
gggtcacgcctgcgcactgg

SEQ ID NO: 14943 - DNA, 20 bp, Artificial Sequence
  sgRNA
cccacctccgcgattgcggg

SEQ ID NO: 14944 - DNA, 20 bp, Artificial Sequence
  sgRNA
ggcgcagagactgacagctg

SEQ ID NO: 14945 - DNA, 20 bp, Artificial Sequence
  sgRNA
atttggtcgcaggaagtggg

SEQ ID NO: 14946 - DNA, 20 bp, Artificial Sequence
  sgRNA
ggaaccgagggtctggctgg

SEQ ID NO: 14947 - DNA, 20 bp, Artificial Sequence
  sgRNA
tgctgatgaagtggtagagc

SEQ ID NO: 14948 - DNA, 20 bp, Artificial Sequence
  sgRNA
ctgagcactgggcggagtca

SEQ ID NO: 14949 - DNA, 20 bp, Artificial Sequence
  sgRNA
agtggtttcccggaccctgc

SEQ ID NO: 14950 - DNA, 20 bp, Artificial Sequence
  sgRNA
cataaggcctacagagttct

SEQ ID NO: 14951 - DNA, 20 bp, Artificial Sequence
  sgRNA
tcgcaggccgcctgaggttg

SEQ ID NO: 14952 - DNA, 20 bp, Artificial Sequence
  sgRNA
ggcactcactgttcgagcct

SEQ ID NO: 14953 - DNA, 20 bp, Artificial Sequence
  sgRNA
gagccgagcccggccgcata

SEQ ID NO: 14954 - DNA, 20 bp, Artificial Sequence
  sgRNA
tgtgtggaggcttcagacat

SEQ ID NO: 14955 - DNA, 20 bp, Artificial Sequence
  sgRNA
gcgcaggcgtgccgagctcg

SEQ ID NO: 14956 - DNA, 20 bp, Artificial Sequence
  sgRNA
aaccgtgaaaggaacccggg

SEQ ID NO: 14957 - DNA, 20 bp, Artificial Sequence
  sgRNA
tgggtccggatgggaattaa

SEQ ID NO: 14958 - DNA, 20 bp, Artificial Sequence
  sgRNA
tcctgcactcaggaagtggg

SEQ ID NO: 14959 - DNA, 20 bp, Artificial Sequence
  sgRNA
gttcatgcatgtgcccactc

SEQ ID NO: 14960 - DNA, 20 bp, Artificial Sequence
  sgRNA
ttctttggaccggaagcagg

SEQ ID NO: 14961 - DNA, 20 bp, Artificial Sequence
  sgRNA
ggcagcatctggactgcagc

SEQ ID NO: 14962 - DNA, 20 bp, Artificial Sequence
  sgRNA
agagccgagagagatgcttg

SEQ ID NO: 14963 - DNA, 20 bp, Artificial Sequence
  sgRNA
aggcaggtggagttaccaaa

SEQ ID NO: 14964 - DNA, 20 bp, Artificial Sequence
  sgRNA
cagccgccttgggcgtatcc

SEQ ID NO: 14965 - DNA, 20 bp, Artificial Sequence
  sgRNA
actctatagtaacaggattg

SEQ ID NO: 14966 - DNA, 20 bp, Artificial Sequence
  sgRNA
aactcatatgggttggaggg

SEQ ID NO: 14967 - DNA, 20 bp, Artificial Sequence
  sgRNA
tcatcctgaaagtcagggtt

SEQ ID NO: 14968 - DNA, 20 bp, Artificial Sequence
  sgRNA
gggaaagttataaagagaac

SEQ ID NO: 14969 - DNA, 20 bp, Artificial Sequence
  sgRNA
aacttcacccgaagaatcct

SEQ ID NO: 14970 - DNA, 20 bp, Artificial Sequence
  sgRNA
gtgtgaaggtaggatgtggc

SEQ ID NO: 14971 - DNA, 20 bp, Artificial Sequence
  sgRNA
tgcctgtgccggccactggg

SEQ ID NO: 14972 - DNA, 20 bp, Artificial Sequence
  sgRNA
atcaggagggtttgattgaa

SEQ ID NO: 14973 - DNA, 20 bp, Artificial Sequence
  sgRNA
aggcagtcaggagcagccag

SEQ ID NO: 14974 - DNA, 20 bp, Artificial Sequence
  sgRNA
aagcagtgcccgtgaccctg

SEQ ID NO: 14975 - DNA, 20 bp, Artificial Sequence
  sgRNA
ggcaagaccggagaggagga

SEQ ID NO: 14976 - DNA, 20 bp, Artificial Sequence
  sgRNA
ggagaactggtgaagggagg

SEQ ID NO: 14977 - DNA, 20 bp, Artificial Sequence
  sgRNA
agggaggaggaatgagagag

SEQ ID NO: 14978 - DNA, 20 bp, Artificial Sequence
  sgRNA
ccttccagaggattctgatt

SEQ ID NO: 14979 - DNA, 20 bp, Artificial Sequence
  sgRNA
tggacctaagattaggctag

SEQ ID NO: 14980 - DNA, 20 bp, Artificial Sequence
  sgRNA
atctcaagtctgagagccta

SEQ ID NO: 14981 - DNA, 20 bp, Artificial Sequence
  sgRNA
cggatgtgggcggtgcctcg

SEQ ID NO: 14982 - DNA, 20 bp, Artificial Sequence
  sgRNA
tccctaagtccttgatatcc

SEQ ID NO: 14983 - DNA, 20 bp, Artificial Sequence
  sgRNA
acttccttcagtgtttggct

SEQ ID NO: 14984 - DNA, 20 bp, Artificial Sequence
  sgRNA
ctttgtcagcaaagacctcc

SEQ ID NO: 14985 - DNA, 20 bp, Artificial Sequence
  sgRNA
gccctttgtttcagcagaag

SEQ ID NO: 14986 - DNA, 20 bp, Artificial Sequence
  sgRNA
gtgagggtagtacctgtccc

SEQ ID NO: 14987 - DNA, 20 bp, Artificial Sequence
  sgRNA
cacacacacacacacatagc

SEQ ID NO: 14988 - DNA, 20 bp, Artificial Sequence
  sgRNA
ttggaggatggcgactgggc

SEQ ID NO: 14989 - DNA, 20 bp, Artificial Sequence
  sgRNA
gtgtgtgtgtctgcctttgg

SEQ ID NO: 14990 - DNA, 20 bp, Artificial Sequence
  sgRNA
gtataaatttcagcacccag

SEQ ID NO: 14991 - DNA, 20 bp, Artificial Sequence
  sgRNA
actcttggatggatggctgt

SEQ ID NO: 14992 - DNA, 20 bp, Artificial Sequence
  sgRNA
tcctatcctcccagaggagc

SEQ ID NO: 14993 - DNA, 20 bp, Artificial Sequence
  sgRNA
gggtgattctgagggccagg

SEQ ID NO: 14994 - DNA, 20 bp, Artificial Sequence
  sgRNA
gacccacagacagagtagaa

SEQ ID NO: 14995 - DNA, 20 bp, Artificial Sequence
  sgRNA
gccactgcactccaccgatc

SEQ ID NO: 14996 - DNA, 20 bp, Artificial Sequence
  sgRNA
cgccgggaagccgagtcctc

SEQ ID NO: 14997 - DNA, 20 bp, Artificial Sequence
  sgRNA
ttcgctgcctagccgcacgg

SEQ ID NO: 14998 - DNA, 20 bp, Artificial Sequence
  sgRNA
gggcggaacctggtcttgtg

SEQ ID NO: 14999 - DNA, 20 bp, Artificial Sequence
  sgRNA
ctcctgaacttggcgcctcg

SEQ ID NO: 15000 - DNA, 20 bp, Artificial Sequence
  sgRNA
tggctaaatgtttggaggtg

SEQ ID NO: 15001 - DNA, 20 bp, Artificial Sequence
  sgRNA
gaagcttccggcggacgcca

SEQ ID NO: 15002 - DNA, 20 bp, Artificial Sequence
  sgRNA
gctgcgtgcgcacgtcatca

SEQ ID NO: 15003 - DNA, 20 bp, Artificial Sequence
  sgRNA
gtcacttccgcccaccggag

SEQ ID NO: 15004 - DNA, 20 bp, Artificial Sequence
  sgRNA
gggttagacagccaccacag

SEQ ID NO: 15005 - DNA, 20 bp, Artificial Sequence
  sgRNA
atgccagacaaggaatgtag

SEQ ID NO: 15006 - DNA, 20 bp, Artificial Sequence
  sgRNA
tggctctggagcagtgccca

SEQ ID NO: 15007 - DNA, 20 bp, Artificial Sequence
  sgRNA
gttcctgagacctgagcgct

SEQ ID NO: 15008 - DNA, 20 bp, Artificial Sequence
  sgRNA
ggagacgcggtgacacggcg

SEQ ID NO: 15009 - DNA, 20 bp, Artificial Sequence
  sgRNA
gcgtgatcacacgcttagcc

SEQ ID NO: 15010 - DNA, 20 bp, Artificial Sequence
  sgRNA
tctctaggagaaaggaagct

SEQ ID NO: 15011 - DNA, 20 bp, Artificial Sequence
  sgRNA
tttagagaaggcaagtggtg

SEQ ID NO: 15012 - DNA, 20 bp, Artificial Sequence
  sgRNA
agatctctttgggtatacaa

SEQ ID NO: 15013 - DNA, 20 bp, Artificial Sequence
  sgRNA
cccgcctccagcttcgcgcg

SEQ ID NO: 15014 - DNA, 20 bp, Artificial Sequence
  sgRNA
gcggagagagggtttgagaa

SEQ ID NO: 15015 - DNA, 20 bp, Artificial Sequence
  sgRNA
aggagaccacagactgggtg

SEQ ID NO: 15016 - DNA, 20 bp, Artificial Sequence
  sgRNA
ggatgagggatgatggagat

SEQ ID NO: 15017 - DNA, 20 bp, Artificial Sequence
  sgRNA
gaatggctggcaatcttact

SEQ ID NO: 15018 - DNA, 20 bp, Artificial Sequence
  sgRNA
caattctaaggcccgccttt

SEQ ID NO: 15019 - DNA, 20 bp, Artificial Sequence
  sgRNA
cattgtagagaaggcctgtg

SEQ ID NO: 15020 - DNA, 20 bp, Artificial Sequence
  sgRNA
ggacctagaggtagaggatc

SEQ ID NO: 15021 - DNA, 20 bp, Artificial Sequence
  sgRNA
aggatcaagttacacctcac

SEQ ID NO: 15022 - DNA, 20 bp, Artificial Sequence
  sgRNA
tgtcacccttgtgccctgct

SEQ ID NO: 15023 - DNA, 20 bp, Artificial Sequence
  sgRNA
gagagacatcagttgttgaa

SEQ ID NO: 15024 - DNA, 20 bp, Artificial Sequence
  sgRNA
ttcccaccctagcggctgag

SEQ ID NO: 15025 - DNA, 20 bp, Artificial Sequence
  sgRNA
aaacgtagcatgtttaactt

SEQ ID NO: 15026 - DNA, 20 bp, Artificial Sequence
  sgRNA
gaagaatgggttaatgaccc

SEQ ID NO: 15027 - DNA, 20 bp, Artificial Sequence
  sgRNA
aggcttgagaaactgtgtac

SEQ ID NO: 15028 - DNA, 20 bp, Artificial Sequence
  sgRNA
tgggctcagaacctatgccc

SEQ ID NO: 15029 - DNA, 20 bp, Artificial Sequence
  sgRNA
gggttggagctgacagcatg

SEQ ID NO: 15030 - DNA, 20 bp, Artificial Sequence
  sgRNA
gagggagcttctgaaggtgg

SEQ ID NO: 15031 - DNA, 20 bp, Artificial Sequence
  sgRNA
ggtgaggcccaggtgcggac

SEQ ID NO: 15032 - DNA, 20 bp, Artificial Sequence
  sgRNA
tgccaggaggatattcaaac

SEQ ID NO: 15033 - DNA, 20 bp, Artificial Sequence
  sgRNA
ctcaggagctgttactctag

SEQ ID NO: 15034 - DNA, 20 bp, Artificial Sequence
  sgRNA
tttagggtggagatagaact

SEQ ID NO: 15035 - DNA, 20 bp, Artificial Sequence
  sgRNA
ttctagcgattgttaacgcc

SEQ ID NO: 15036 - DNA, 20 bp, Artificial Sequence
  sgRNA
agatggctttgcataaatgc

SEQ ID NO: 15037 - DNA, 20 bp, Artificial Sequence
  sgRNA
ggaaggaggaaggcagccgt

SEQ ID NO: 15038 - DNA, 20 bp, Artificial Sequence
  sgRNA
cagacctctaggctccactg

SEQ ID NO: 15039 - DNA, 20 bp, Artificial Sequence
  sgRNA
ggcagggcagtagtagaaag

SEQ ID NO: 15040 - DNA, 20 bp, Artificial Sequence
  sgRNA
ggctacacagggaaaggacc

SEQ ID NO: 15041 - DNA, 20 bp, Artificial Sequence
  sgRNA
gttgcaggcctgcttgcctc

SEQ ID NO: 15042 - DNA, 20 bp, Artificial Sequence
  sgRNA
aaagaagaaatcaatgtgcc

SEQ ID NO: 15043 - DNA, 20 bp, Artificial Sequence
  sgRNA
ttgcgcgggcccaatgagcg

SEQ ID NO: 15044 - DNA, 20 bp, Artificial Sequence
  sgRNA
ggctccacgtgggcgcaccc

SEQ ID NO: 15045 - DNA, 20 bp, Artificial Sequence
  sgRNA
gagctaatgctgggctccat

SEQ ID NO: 15046 - DNA, 20 bp, Artificial Sequence
  sgRNA
tctgcttcagttctgataga

SEQ ID NO: 15047 - DNA, 20 bp, Artificial Sequence
  sgRNA
agttacacttgtaggaggac

SEQ ID NO: 15048 - DNA, 20 bp, Artificial Sequence
  sgRNA
tcagagtagactatgcagag

SEQ ID NO: 15049 - DNA, 20 bp, Artificial Sequence
  sgRNA
agagatgagcacggagtggg

SEQ ID NO: 15050 - DNA, 20 bp, Artificial Sequence
  sgRNA
tttatgctccgtattctcag

SEQ ID NO: 15051 - DNA, 20 bp, Artificial Sequence
  sgRNA
agattaaggatgttgtctct

SEQ ID NO: 15052 - DNA, 20 bp, Artificial Sequence
  sgRNA
gtcttgtcccacttgctctg

SEQ ID NO: 15053 - DNA, 20 bp, Artificial Sequence
  sgRNA
cattatccctctcaactgtc

SEQ ID NO: 15054 - DNA, 20 bp, Artificial Sequence
  sgRNA
cgcacgcgcagcttgcgcaa

SEQ ID NO: 15055 - DNA, 20 bp, Artificial Sequence
  sgRNA
tgtgttcactaagtcttccc

SEQ ID NO: 15056 - DNA, 20 bp, Artificial Sequence
  sgRNA
aacgtaatttcccttcccag

SEQ ID NO: 15057 - DNA, 20 bp, Artificial Sequence
  sgRNA
gatggctgcacacagaggct

SEQ ID NO: 15058 - DNA, 20 bp, Artificial Sequence
  sgRNA
caaactgctggcgagtcaag

SEQ ID NO: 15059 - DNA, 20 bp, Artificial Sequence
  sgRNA
caggtgtcaccacgccggga

SEQ ID NO: 15060 - DNA, 20 bp, Artificial Sequence
  sgRNA
aacatggccgccgaggaggg

SEQ ID NO: 15061 - DNA, 20 bp, Artificial Sequence
  sgRNA
gggaattgcaatttccactg

SEQ ID NO: 15062 - DNA, 20 bp, Artificial Sequence
  sgRNA
caccagccaccaccaaccac

SEQ ID NO: 15063 - DNA, 20 bp, Artificial Sequence
  sgRNA
gcccagctccggagcgctgg

SEQ ID NO: 15064 - DNA, 20 bp, Artificial Sequence
  sgRNA
ataaatcaatatgacggaag

SEQ ID NO: 15065 - DNA, 20 bp, Artificial Sequence
  sgRNA
taggtgtgtttgactgattg

SEQ ID NO: 15066 - DNA, 20 bp, Artificial Sequence
  sgRNA
ttaacagtttgactaatccg

SEQ ID NO: 15067 - DNA, 20 bp, Artificial Sequence
  sgRNA
tgagcacagagtcccgctag

SEQ ID NO: 15068 - DNA, 20 bp, Artificial Sequence
  sgRNA
ctagctagcgagcatcctct

SEQ ID NO: 15069 - DNA, 20 bp, Artificial Sequence
  sgRNA
gttagccaatggcacggcgg

SEQ ID NO: 15070 - DNA, 20 bp, Artificial Sequence
  sgRNA
ggccggccaccgccctacgg

SEQ ID NO: 15071 - DNA, 20 bp, Artificial Sequence
  sgRNA
aggaagaggcgccagtccgc

SEQ ID NO: 15072 - DNA, 20 bp, Artificial Sequence
  sgRNA
cggcgcgcatgagcactgtg

SEQ ID NO: 15073 - DNA, 20 bp, Artificial Sequence
  sgRNA
tgtactgatctgggatctca

SEQ ID NO: 15074 - DNA, 20 bp, Artificial Sequence
  sgRNA
cgtgatagcccagctgcctg

SEQ ID NO: 15075 - DNA, 20 bp, Artificial Sequence
  sgRNA
ccaacctggtgccacaatat

SEQ ID NO: 15076 - DNA, 20 bp, Artificial Sequence
  sgRNA
gataatcaagtctactatga

SEQ ID NO: 15077 - DNA, 20 bp, Artificial Sequence
  sgRNA
agggtggagcttcttgggtt

SEQ ID NO: 15078 - DNA, 20 bp, Artificial Sequence
  sgRNA
gctatgagtcatgttgccaa

SEQ ID NO: 15079 - DNA, 20 bp, Artificial Sequence
  sgRNA
tcagttccgcagcttaagga

SEQ ID NO: 15080 - DNA, 20 bp, Artificial Sequence
  sgRNA
agtcgggcgtggctcgaaag

SEQ ID NO: 15081 - DNA, 20 bp, Artificial Sequence
  sgRNA
aacgggaagtgtgcgctgat

SEQ ID NO: 15082 - DNA, 20 bp, Artificial Sequence
  sgRNA
gggcggagatcgctccgagg

SEQ ID NO: 15083 - DNA, 20 bp, Artificial Sequence
  sgRNA
cggtgagtgtgcacgagcct

SEQ ID NO: 15084 - DNA, 20 bp, Artificial Sequence
  sgRNA
gcacgcgcgtgacgtgaccg

SEQ ID NO: 15085 - DNA, 20 bp, Artificial Sequence
  sgRNA
atcaacctagctgaggcctg

SEQ ID NO: 15086 - DNA, 20 bp, Artificial Sequence
  sgRNA
aaagaatggctactctgttt

SEQ ID NO: 15087 - DNA, 20 bp, Artificial Sequence
  sgRNA
gtcctgccttaactgtcaga

SEQ ID NO: 15088 - DNA, 20 bp, Artificial Sequence
  sgRNA
gtctgcagggtctgcgctca

SEQ ID NO: 15089 - DNA, 20 bp, Artificial Sequence
  sgRNA
ggtgggacgcccagtcttca

SEQ ID NO: 15090 - DNA, 20 bp, Artificial Sequence
  sgRNA
atctcgcgagaagtcagcta

SEQ ID NO: 15091 - DNA, 20 bp, Artificial Sequence
  sgRNA
ggtcatgtctggtgcgcggc

SEQ ID NO: 15092 - DNA, 20 bp, Artificial Sequence
  sgRNA
gcgcgcggcactggctggat

SEQ ID NO: 15093 - DNA, 20 bp, Artificial Sequence
  sgRNA
gcgggacggccggtgcccgg

SEQ ID NO: 15094 - DNA, 20 bp, Artificial Sequence
  sgRNA
acagtgctagagaatcgatt

SEQ ID NO: 15095 - DNA, 20 bp, Artificial Sequence
  sgRNA
tactcaagaatgcagcatct

SEQ ID NO: 15096 - DNA, 20 bp, Artificial Sequence
  sgRNA
tatctagtcctcatttgcag

SEQ ID NO: 15097 - DNA, 20 bp, Artificial Sequence
  sgRNA
ggcagtccctggctggaggg

SEQ ID NO: 15098 - DNA, 20 bp, Artificial Sequence
  sgRNA
ctcaggccggcgagtttgcc

SEQ ID NO: 15099 - DNA, 20 bp, Artificial Sequence
  sgRNA
cggaaagggccgagtccctg

SEQ ID NO: 15100 - DNA, 20 bp, Artificial Sequence
  sgRNA
gggcaggacagcagttgcta

SEQ ID NO: 15101 - DNA, 20 bp, Artificial Sequence
  sgRNA
ccaatttggagcaggagggc

SEQ ID NO: 15102 - DNA, 20 bp, Artificial Sequence
  sgRNA
agcttggtccagaccgccca

SEQ ID NO: 15103 - DNA, 20 bp, Artificial Sequence
  sgRNA
gcggtcaccgcacaagcaag

SEQ ID NO: 15104 - DNA, 20 bp, Artificial Sequence
  sgRNA
aaaccttcgctacccgcacg

SEQ ID NO: 15105 - DNA, 20 bp, Artificial Sequence
  sgRNA
gccaccggcaaagctagaaa

SEQ ID NO: 15106 - DNA, 20 bp, Artificial Sequence
  sgRNA
ggagctccacgctcggacct

SEQ ID NO: 15107 - DNA, 20 bp, Artificial Sequence
  sgRNA
ggctccctggtctgcacctc

SEQ ID NO: 15108 - DNA, 20 bp, Artificial Sequence
  sgRNA
accgttcaaccacgtgcggg

SEQ ID NO: 15109 - DNA, 20 bp, Artificial Sequence
  sgRNA
tttccattgtcccactggca

SEQ ID NO: 15110 - DNA, 20 bp, Artificial Sequence
  sgRNA
ttcagaaacagggagcgaag

SEQ ID NO: 15111 - DNA, 20 bp, Artificial Sequence
  sgRNA
gatgctgcggagtaagcagg

SEQ ID NO: 15112 - DNA, 20 bp, Artificial Sequence
  sgRNA
ggtatctaccctcgtgttct

SEQ ID NO: 15113 - DNA, 20 bp, Artificial Sequence
  sgRNA
ccctcccttcctgagtggtt

SEQ ID NO: 15114 - DNA, 20 bp, Artificial Sequence
  sgRNA
agcaagtaaaggcttctgca

SEQ ID NO: 15115 - DNA, 20 bp, Artificial Sequence
  sgRNA
ctaaggcatgagggccaggc

SEQ ID NO: 15116 - DNA, 20 bp, Artificial Sequence
  sgRNA
tgctgtgagctcagaacaac

SEQ ID NO: 15117 - DNA, 20 bp, Artificial Sequence
  sgRNA
gactgagactctgtcccagt

SEQ ID NO: 15118 - DNA, 20 bp, Artificial Sequence
  sgRNA
acacaccgcggacgagctgg

SEQ ID NO: 15119 - DNA, 20 bp, Artificial Sequence
  sgRNA
cccagaagccagggcgaacc

SEQ ID NO: 15120 - DNA, 20 bp, Artificial Sequence
  sgRNA
gggcgacttctgcaatcaag

SEQ ID NO: 15121 - DNA, 20 bp, Artificial Sequence
  sgRNA
cctcagtataaagtccagcc

SEQ ID NO: 15122 - DNA, 20 bp, Artificial Sequence
  sgRNA
tcaggatgaccaatgtcaac

SEQ ID NO: 15123 - DNA, 20 bp, Artificial Sequence
  sgRNA
atgtcataggacagacacta

SEQ ID NO: 15124 - DNA, 20 bp, Artificial Sequence
  sgRNA
gcagagacctgaagggcctg

SEQ ID NO: 15125 - DNA, 20 bp, Artificial Sequence
  sgRNA
caggtgactagtgctggtca

SEQ ID NO: 15126 - DNA, 20 bp, Artificial Sequence
  sgRNA
acctgctgagccaatcccgc

SEQ ID NO: 15127 - DNA, 20 bp, Artificial Sequence
  sgRNA
tgtgcgcatgagattagagg

SEQ ID NO: 15128 - DNA, 20 bp, Artificial Sequence
  sgRNA
cttctgcaacatcttccttc

SEQ ID NO: 15129 - DNA, 20 bp, Artificial Sequence
  sgRNA
gattgccacgtcgccagcag

SEQ ID NO: 15130 - DNA, 20 bp, Artificial Sequence
  sgRNA
cgtacagccaaccagcgaaa

SEQ ID NO: 15131 - DNA, 20 bp, Artificial Sequence
  sgRNA
tcataaggagcgtgcgcgac

SEQ ID NO: 15132 - DNA, 20 bp, Artificial Sequence
  sgRNA
tcacagacgagtatgtgaga

SEQ ID NO: 15133 - DNA, 20 bp, Artificial Sequence
  sgRNA
cctgcgctgggaggaccgaa

SEQ ID NO: 15134 - DNA, 20 bp, Artificial Sequence
  sgRNA
agcggcaggcatggtggacc

SEQ ID NO: 15135 - DNA, 20 bp, Artificial Sequence
  sgRNA
actaacaacagtggctgagt

SEQ ID NO: 15136 - DNA, 20 bp, Artificial Sequence
  sgRNA
tgtagtagcttgtgcagctt

SEQ ID NO: 15137 - DNA, 20 bp, Artificial Sequence
  sgRNA
tgcagcgtgggcgggtgaca

SEQ ID NO: 15138 - DNA, 20 bp, Artificial Sequence
  sgRNA
ggcttcgggagagagagcta

SEQ ID NO: 15139 - DNA, 20 bp, Artificial Sequence
  sgRNA
cgggaaagttggttccactc

SEQ ID NO: 15140 - DNA, 20 bp, Artificial Sequence
  sgRNA
gcagaacccggctgtgcctc

SEQ ID NO: 15141 - DNA, 20 bp, Artificial Sequence
  sgRNA
cctgggtcctcccgtgccga

SEQ ID NO: 15142 - DNA, 20 bp, Artificial Sequence
  sgRNA
ccaggcctgggcaatgcctt

SEQ ID NO: 15143 - DNA, 20 bp, Artificial Sequence
  sgRNA
gcagctgacccgctggcgat

SEQ ID NO: 15144 - DNA, 20 bp, Artificial Sequence
  sgRNA
cgtgcggcgcggcatgtcgc

SEQ ID NO: 15145 - DNA, 20 bp, Artificial Sequence
  sgRNA
gcgtcccaggcctccctgcc

SEQ ID NO: 15146 - DNA, 20 bp, Artificial Sequence
  sgRNA
gacgagagtgatggacaagc

SEQ ID NO: 15147 - DNA, 20 bp, Artificial Sequence
  sgRNA
aggctgcgcggtgcctacgt

SEQ ID NO: 15148 - DNA, 20 bp, Artificial Sequence
  sgRNA
atgtcatggaaccctatccc

SEQ ID NO: 15149 - DNA, 20 bp, Artificial Sequence
  sgRNA
gcctctcttcccaaatatgc

SEQ ID NO: 15150 - DNA, 20 bp, Artificial Sequence
  sgRNA
tatcaggccttctaatataa

SEQ ID NO: 15151 - DNA, 20 bp, Artificial Sequence
  sgRNA
gaaggcgggcgcgcgcccat

SEQ ID NO: 15152 - DNA, 20 bp, Artificial Sequence
  sgRNA
agactgctggctgcagacgc

SEQ ID NO: 15153 - DNA, 20 bp, Artificial Sequence
  sgRNA
ggcgcgatgtcccggcgcgg

SEQ ID NO: 15154 - DNA, 20 bp, Artificial Sequence
  sgRNA
gtgattgggtgagacccggt

SEQ ID NO: 15155 - DNA, 20 bp, Artificial Sequence
  sgRNA
cacatggtgggaacgtgagg

SEQ ID NO: 15156 - DNA, 20 bp, Artificial Sequence
  sgRNA
gaggcgatccagactccttg

SEQ ID NO: 15157 - DNA, 20 bp, Artificial Sequence
  sgRNA
agagctcggaggtgtgggta

SEQ ID NO: 15158 - DNA, 20 bp, Artificial Sequence
  sgRNA
ctgtgcaactgtagagttgg

SEQ ID NO: 15159 - DNA, 20 bp, Artificial Sequence
  sgRNA
ttgaaagggaagctggcgag

SEQ ID NO: 15160 - DNA, 20 bp, Artificial Sequence
  sgRNA
tggagtggtgtccgtcgtac

SEQ ID NO: 15161 - DNA, 20 bp, Artificial Sequence
  sgRNA
gcctcggcaaatgcagcaat

SEQ ID NO: 15162 - DNA, 20 bp, Artificial Sequence
  sgRNA
gggccagtcagtctgggctt

SEQ ID NO: 15163 - DNA, 20 bp, Artificial Sequence
  sgRNA
ctgccgctcgcccaggcttt

SEQ ID NO: 15164 - DNA, 20 bp, Artificial Sequence
  sgRNA
gcgcccgtcgtctaggcgag

SEQ ID NO: 15165 - DNA, 20 bp, Artificial Sequence
  sgRNA
agcgggcgggacgtaagggt

SEQ ID NO: 15166 - DNA, 20 bp, Artificial Sequence
  sgRNA
ttcttcctgaaggcagagac

SEQ ID NO: 15167 - DNA, 20 bp, Artificial Sequence
  sgRNA
gctgtacttacaaaggagag

SEQ ID NO: 15168 - DNA, 20 bp, Artificial Sequence
  sgRNA
ccagagcccttcagcaccat

SEQ ID NO: 15169 - DNA, 20 bp, Artificial Sequence
  sgRNA
agggagccaggatgaactgt

SEQ ID NO: 15170 - DNA, 20 bp, Artificial Sequence
  sgRNA
gagggaaagttgcacgctga

SEQ ID NO: 15171 - DNA, 20 bp, Artificial Sequence
  sgRNA
aggtggagtctcaggatagg

SEQ ID NO: 15172 - DNA, 20 bp, Artificial Sequence
  sgRNA
gatcagagctttagttgctc

SEQ ID NO: 15173 - DNA, 20 bp, Artificial Sequence
  sgRNA
ctgtatgcaaatatctcaag

SEQ ID NO: 15174 - DNA, 20 bp, Artificial Sequence
  sgRNA
gcttagtttctgcacacctt

SEQ ID NO: 15175 - DNA, 20 bp, Artificial Sequence
  sgRNA
gagtcttgaccaatcgacaa

SEQ ID NO: 15176 - DNA, 20 bp, Artificial Sequence
  sgRNA
cgtgttgcagccttgaggcg

SEQ ID NO: 15177 - DNA, 20 bp, Artificial Sequence
  sgRNA
ccaattgacgtggcgttact

SEQ ID NO: 15178 - DNA, 20 bp, Artificial Sequence
  sgRNA
cttctgcgcaagcacatttg

SEQ ID NO: 15179 - DNA, 20 bp, Artificial Sequence
  sgRNA
cgaaagctaaggcgggagtt

SEQ ID NO: 15180 - DNA, 20 bp, Artificial Sequence
  sgRNA
gctcaacgacgccctacgag

SEQ ID NO: 15181 - DNA, 20 bp, Artificial Sequence
  sgRNA
gaactgatggacaccgagtg

SEQ ID NO: 15182 - DNA, 20 bp, Artificial Sequence
  sgRNA
acactcaagagttcttgacc

SEQ ID NO: 15183 - DNA, 20 bp, Artificial Sequence
  sgRNA
acttgaggagtccgtgacgc

SEQ ID NO: 15184 - DNA, 20 bp, Artificial Sequence
  sgRNA
gcctcctccgggacggcggg

SEQ ID NO: 15185 - DNA, 20 bp, Artificial Sequence
  sgRNA
ggctccgcccggccgtcggg

SEQ ID NO: 15186 - DNA, 20 bp, Artificial Sequence
  sgRNA
agcgggctggtgtgggctcg

SEQ ID NO: 15187 - DNA, 20 bp, Artificial Sequence
  sgRNA
cacacaacgtttgcagaacg

SEQ ID NO: 15188 - DNA, 20 bp, Artificial Sequence
  sgRNA
gcactgattgatcctgggag

SEQ ID NO: 15189 - DNA, 20 bp, Artificial Sequence
  sgRNA
gggaaggcagcggaaagtag

SEQ ID NO: 15190 - DNA, 20 bp, Artificial Sequence
  sgRNA
aggaagtcaataccgtcagg

SEQ ID NO: 15191 - DNA, 20 bp, Artificial Sequence
  sgRNA
atggtgggattgggcttctg

SEQ ID NO: 15192 - DNA, 20 bp, Artificial Sequence
  sgRNA
ttggattcgcgcgccggccc

SEQ ID NO: 15193 - DNA, 20 bp, Artificial Sequence
  sgRNA
caagttggctaggagcccag

SEQ ID NO: 15194 - DNA, 20 bp, Artificial Sequence
  sgRNA
gagaaacaggatgtgtgttt

SEQ ID NO: 15195 - DNA, 20 bp, Artificial Sequence
  sgRNA
tggcctaagccaaagaacag

SEQ ID NO: 15196 - DNA, 20 bp, Artificial Sequence
  sgRNA
gacaccggtgcgtgtcaacc

SEQ ID NO: 15197 - DNA, 20 bp, Artificial Sequence
  sgRNA
ctccttctcctagactaccc

SEQ ID NO: 15198 - DNA, 20 bp, Artificial Sequence
  sgRNA
ggagctccgccctgagtcat

SEQ ID NO: 15199 - DNA, 20 bp, Artificial Sequence
  sgRNA
ggagtctaatagggaagggc

SEQ ID NO: 15200 - DNA, 20 bp, Artificial Sequence
  sgRNA
gtggattcttgctccgctcg

SEQ ID NO: 15201 - DNA, 20 bp, Artificial Sequence
  sgRNA
tgctacttctggtctatcag

SEQ ID NO: 15202 - DNA, 20 bp, Artificial Sequence
  sgRNA
ggcgcacaaggtcaagtcac

SEQ ID NO: 15203 - DNA, 20 bp, Artificial Sequence
  sgRNA
aagcgggcaggaggtggcct

SEQ ID NO: 15204 - DNA, 20 bp, Artificial Sequence
  sgRNA
gggtcggaccgcacgggacg

SEQ ID NO: 15205 - DNA, 20 bp, Artificial Sequence
  sgRNA
tcccagttcctcttccactg

SEQ ID NO: 15206 - DNA, 20 bp, Artificial Sequence
  sgRNA
cctgccaaagctcagctaag

SEQ ID NO: 15207 - DNA, 20 bp, Artificial Sequence
  sgRNA
attaaacttagggcattgcc

SEQ ID NO: 15208 - DNA, 20 bp, Artificial Sequence
  sgRNA
gattcttaggaggtttctct

SEQ ID NO: 15209 - DNA, 20 bp, Artificial Sequence
  sgRNA
aagttctcaccaagccagac

SEQ ID NO: 15210 - DNA, 20 bp, Artificial Sequence
  sgRNA
gtcagtggagacagctatgc

SEQ ID NO: 15211 - DNA, 20 bp, Artificial Sequence
  sgRNA
cgcgtgcgcacaggacggga

SEQ ID NO: 15212 - DNA, 20 bp, Artificial Sequence
  sgRNA
ggtgagagcgccttgaggtg

SEQ ID NO: 15213 - DNA, 20 bp, Artificial Sequence
  sgRNA
ccctggcctagggtggtgag

SEQ ID NO: 15214 - DNA, 20 bp, Artificial Sequence
  sgRNA
gtatctcaattcaaacattg

SEQ ID NO: 15215 - DNA, 20 bp, Artificial Sequence
  sgRNA
gggagctagccctgcttcca

SEQ ID NO: 15216 - DNA, 20 bp, Artificial Sequence
  sgRNA
agacttggctcacaaagaac

SEQ ID NO: 15217 - DNA, 20 bp, Artificial Sequence
  sgRNA
gggagatattctgggtcacg

SEQ ID NO: 15218 - DNA, 20 bp, Artificial Sequence
  sgRNA
tggctccttcctggaatcaa

SEQ ID NO: 15219 - DNA, 20 bp, Artificial Sequence
  sgRNA
aaagcaagctcatcattaca

SEQ ID NO: 15220 - DNA, 20 bp, Artificial Sequence
  sgRNA
agcgggagcgcgaaagcgcg

SEQ ID NO: 15221 - DNA, 20 bp, Artificial Sequence
  sgRNA
gccgggctgggctcgggcgg

SEQ ID NO: 15222 - DNA, 20 bp, Artificial Sequence
  sgRNA
cgcgtgcggcggctcgatcc

SEQ ID NO: 15223 - DNA, 20 bp, Artificial Sequence
  sgRNA
tggaacggaagttccggcgg

SEQ ID NO: 15224 - DNA, 20 bp, Artificial Sequence
  sgRNA
gcaacatggcagcttctacc

SEQ ID NO: 15225 - DNA, 20 bp, Artificial Sequence
  sgRNA
acgctgccacctacagcgtc

SEQ ID NO: 15226 - DNA, 20 bp, Artificial Sequence
  sgRNA
ggatcctagtgtttcacgtg

SEQ ID NO: 15227 - DNA, 20 bp, Artificial Sequence
  sgRNA
ttctatagtgacggcgcgtc

SEQ ID NO: 15228 - DNA, 20 bp, Artificial Sequence
  sgRNA
atctctgcttgacaagatca

SEQ ID NO: 15229 - DNA, 20 bp, Artificial Sequence
  sgRNA
gggaaatgggaaggcacttc

SEQ ID NO: 15230 - DNA, 20 bp, Artificial Sequence
  sgRNA
tgggagggcgcggtacagaa

SEQ ID NO: 15231 - DNA, 20 bp, Artificial Sequence
  sgRNA
gtcctatccagttctggctt

SEQ ID NO: 15232 - DNA, 20 bp, Artificial Sequence
  sgRNA
ccgcgtgttcctggatttga

SEQ ID NO: 15233 - DNA, 20 bp, Artificial Sequence
  sgRNA
ccgaagccgcgcagtttaga

SEQ ID NO: 15234 - DNA, 20 bp, Artificial Sequence
  sgRNA
ggcgggcagaagcctgtgat

SEQ ID NO: 15235 - DNA, 20 bp, Artificial Sequence
  sgRNA
gcgctgagctcgccctccgg

SEQ ID NO: 15236 - DNA, 20 bp, Artificial Sequence
  sgRNA
tgtattaaaggagctgcggc

SEQ ID NO: 15237 - DNA, 20 bp, Artificial Sequence
  sgRNA
cgctagctgccttgtactgc

SEQ ID NO: 15238 - DNA, 20 bp, Artificial Sequence
  sgRNA
agcagtaaggatgaacgcca

SEQ ID NO: 15239 - DNA, 20 bp, Artificial Sequence
  sgRNA
ttgatgcagggagcaccaaa

SEQ ID NO: 15240 - DNA, 20 bp, Artificial Sequence
  sgRNA
ttgcagtgccttgtcgcaca

SEQ ID NO: 15241 - DNA, 20 bp, Artificial Sequence
  sgRNA
aactttggagcaggagtagg

SEQ ID NO: 15242 - DNA, 20 bp, Artificial Sequence
  sgRNA
aggttctggtcagtttgctc

SEQ ID NO: 15243 - DNA, 20 bp, Artificial Sequence
  sgRNA
cggaggtgactggactaata

SEQ ID NO: 15244 - DNA, 20 bp, Artificial Sequence
  sgRNA
cggtagcgtgaagccacatc

SEQ ID NO: 15245 - DNA, 20 bp, Artificial Sequence
  sgRNA
acgtacacaaccaccagatc

SEQ ID NO: 15246 - DNA, 20 bp, Artificial Sequence
  sgRNA
tcgcgtccctcagttgagaa

SEQ ID NO: 15247 - DNA, 20 bp, Artificial Sequence
  sgRNA
gtcgctgtgctccttgtgat

SEQ ID NO: 15248 - DNA, 20 bp, Artificial Sequence
  sgRNA
gggcaaagctagctccggat

SEQ ID NO: 15249 - DNA, 20 bp, Artificial Sequence
  sgRNA
tgtaggcggcgggatctaga

SEQ ID NO: 15250 - DNA, 20 bp, Artificial Sequence
  sgRNA
gagcagttcttccagccaat

SEQ ID NO: 15251 - DNA, 20 bp, Artificial Sequence
  sgRNA
ggaggcggaagttcggcaag

SEQ ID NO: 15252 - DNA, 20 bp, Artificial Sequence
  sgRNA
gggcggaaactctcgggccc

SEQ ID NO: 15253 - DNA, 20 bp, Artificial Sequence
  sgRNA
ctccaggagattctcgctct

SEQ ID NO: 15254 - DNA, 20 bp, Artificial Sequence
  sgRNA
cagtcacttctctggttaca

SEQ ID NO: 15255 - DNA, 20 bp, Artificial Sequence
  sgRNA
tgggaagctgggtggagctc

SEQ ID NO: 15256 - DNA, 20 bp, Artificial Sequence
  sgRNA
gcgtcccacgggtcgaacaa

SEQ ID NO: 15257 - DNA, 20 bp, Artificial Sequence
  sgRNA
tcttgagagtgggtacgtgg

SEQ ID NO: 15258 - DNA, 20 bp, Artificial Sequence
  sgRNA
gttgcctccatattgcaagc

SEQ ID NO: 15259 - DNA, 20 bp, Artificial Sequence
  sgRNA
tgcttgcccaagtcgtgtcg

SEQ ID NO: 15260 - DNA, 20 bp, Artificial Sequence
  sgRNA
agaacaccctaggacgtgag

SEQ ID NO: 15261 - DNA, 20 bp, Artificial Sequence
  sgRNA
gcgcacgcggtgacgcacct

SEQ ID NO: 15262 - DNA, 20 bp, Artificial Sequence
  sgRNA
ctgtgtgccggccgccaccg

SEQ ID NO: 15263 - DNA, 20 bp, Artificial Sequence
  sgRNA
gcaagcccagctttgagagc

SEQ ID NO: 15264 - DNA, 20 bp, Artificial Sequence
  sgRNA
acgtcaggcggcgtcacgcg

SEQ ID NO: 15265 - DNA, 20 bp, Artificial Sequence
  sgRNA
tgggactcaaaggcagtgtt

SEQ ID NO: 15266 - DNA, 20 bp, Artificial Sequence
  sgRNA
aacagcctgtgtcaccgaaa

SEQ ID NO: 15267 - DNA, 20 bp, Artificial Sequence
  sgRNA
tgcttccaactcgcatctaa

SEQ ID NO: 15268 - DNA, 20 bp, Artificial Sequence
  sgRNA
gactgctggtggtatggctg

SEQ ID NO: 15269 - DNA, 20 bp, Artificial Sequence
  sgRNA
caggtcacaaaggacggcag

SEQ ID NO: 15270 - DNA, 20 bp, Artificial Sequence
  sgRNA
gggtgttggtctgatttgag

SEQ ID NO: 15271 - DNA, 20 bp, Artificial Sequence
  sgRNA
agggacacaagggcgaagcc

SEQ ID NO: 15272 - DNA, 20 bp, Artificial Sequence
  sgRNA
agactcggagggtcgccttc

SEQ ID NO: 15273 - DNA, 20 bp, Artificial Sequence
  sgRNA
aggaaatgacgctcgggacc

SEQ ID NO: 15274 - DNA, 20 bp, Artificial Sequence
  sgRNA
gcaaatcgaagtgagacaca

SEQ ID NO: 15275 - DNA, 20 bp, Artificial Sequence
  sgRNA
tgatatctgtttactctaga

SEQ ID NO: 15276 - DNA, 20 bp, Artificial Sequence
  sgRNA
gaatggcacagcgagatagt

SEQ ID NO: 15277 - DNA, 20 bp, Artificial Sequence
  sgRNA
ttgttcctgcctctttgctg

SEQ ID NO: 15278 - DNA, 20 bp, Artificial Sequence
  sgRNA
ggaggtcctaacaaacaccc

SEQ ID NO: 15279 - DNA, 20 bp, Artificial Sequence
  sgRNA
ccctcctccaaagagctccc

SEQ ID NO: 15280 - DNA, 20 bp, Artificial Sequence
  sgRNA
gggctagaaagataggcttg

SEQ ID NO: 15281 - DNA, 20 bp, Artificial Sequence
  sgRNA
gcggatatggagaacagaac

SEQ ID NO: 15282 - DNA, 20 bp, Artificial Sequence
  sgRNA
acactagtcgagaatctaaa

SEQ ID NO: 15283 - DNA, 20 bp, Artificial Sequence
  sgRNA
actggagataagcaatgtaa

SEQ ID NO: 15284 - DNA, 20 bp, Artificial Sequence
  sgRNA
ccatggaaaccaaagtatgc

SEQ ID NO: 15285 - DNA, 20 bp, Artificial Sequence
  sgRNA
taggatgtagaaaggcctgc

SEQ ID NO: 15286 - DNA, 20 bp, Artificial Sequence
  sgRNA
aatggcatcgttggccaaat

SEQ ID NO: 15287 - DNA, 20 bp, Artificial Sequence
  sgRNA
agaacacacggtgtgtttat

SEQ ID NO: 15288 - DNA, 20 bp, Artificial Sequence
  sgRNA
gggctgggtaggatcggaca

SEQ ID NO: 15289 - DNA, 20 bp, Artificial Sequence
  sgRNA
tcatcaatcacgcttatggg

SEQ ID NO: 15290 - DNA, 20 bp, Artificial Sequence
  sgRNA
agtcagcactagttgtactg

SEQ ID NO: 15291 - DNA, 20 bp, Artificial Sequence
  sgRNA
gctagtagcttagccagagg

SEQ ID NO: 15292 - DNA, 20 bp, Artificial Sequence
  sgRNA
tcccaatgggaccagagcag

SEQ ID NO: 15293 - DNA, 20 bp, Artificial Sequence
  sgRNA
ggcgtgtctcaacagagaat

SEQ ID NO: 15294 - DNA, 20 bp, Artificial Sequence
  sgRNA
tgcgaggtcctagacatcct

SEQ ID NO: 15295 - DNA, 20 bp, Artificial Sequence
  sgRNA
attgtactttacgttgggaa

SEQ ID NO: 15296 - DNA, 20 bp, Artificial Sequence
  sgRNA
cacatgtatacagtatttgt

SEQ ID NO: 15297 - DNA, 20 bp, Artificial Sequence
  sgRNA
tatgtggagatattggttca

SEQ ID NO: 15298 - DNA, 20 bp, Artificial Sequence
  sgRNA
gagggtaggaagtgccgccg

SEQ ID NO: 15299 - DNA, 20 bp, Artificial Sequence
  sgRNA
agtggactacaagtcccgtg

SEQ ID NO: 15300 - DNA, 20 bp, Artificial Sequence
  sgRNA
tgcccagatcggcagagtag

SEQ ID NO: 15301 - DNA, 20 bp, Artificial Sequence
  sgRNA
ggctgcccatctgagcaagc

SEQ ID NO: 15302 - DNA, 20 bp, Artificial Sequence
  sgRNA
gctgccattgacccatcaca

SEQ ID NO: 15303 - DNA, 20 bp, Artificial Sequence
  sgRNA
ggtgggagaggccgtccttg

SEQ ID NO: 15304 - DNA, 20 bp, Artificial Sequence
  sgRNA
ttctagaaacttggattcca

SEQ ID NO: 15305 - DNA, 20 bp, Artificial Sequence
  sgRNA
tacaggattccaggaagagt

SEQ ID NO: 15306 - DNA, 20 bp, Artificial Sequence
  sgRNA
ttgcctagagttgctaagtt

SEQ ID NO: 15307 - DNA, 20 bp, Artificial Sequence
  sgRNA
ggacaggtctggcgagttct

SEQ ID NO: 15308 - DNA, 20 bp, Artificial Sequence
  sgRNA
ttagctgagtaactgggatg

SEQ ID NO: 15309 - DNA, 20 bp, Artificial Sequence
  sgRNA
ggaagtcggtgggacgtgtg

SEQ ID NO: 15310 - DNA, 20 bp, Artificial Sequence
  sgRNA
agccctggcgaaggcactac

SEQ ID NO: 15311 - DNA, 20 bp, Artificial Sequence
  sgRNA
gtacatctattacgttcgtc

SEQ ID NO: 15312 - DNA, 20 bp, Artificial Sequence
  sgRNA
ctaaggagcacaacgcttgc

SEQ ID NO: 15313 - DNA, 20 bp, Artificial Sequence
  sgRNA
gacaggaagagccagcatcc

SEQ ID NO: 15314 - DNA, 20 bp, Artificial Sequence
  sgRNA
gctcttatggcatgtctgcc

SEQ ID NO: 15315 - DNA, 20 bp, Artificial Sequence
  sgRNA
acacatggaccaccattatg

SEQ ID NO: 15316 - DNA, 20 bp, Artificial Sequence
  sgRNA
ccacgcggcaaggcgaggcc

SEQ ID NO: 15317 - DNA, 20 bp, Artificial Sequence
  sgRNA
agctgcagggcgctgtccgg

SEQ ID NO: 15318 - DNA, 20 bp, Artificial Sequence
  sgRNA
cgaggagatcccgcgcccag

SEQ ID NO: 15319 - DNA, 20 bp, Artificial Sequence
  sgRNA
aaacaactctaaagttacac

SEQ ID NO: 15320 - DNA, 20 bp, Artificial Sequence
  sgRNA
gaagggagaggatgctaatc

SEQ ID NO: 15321 - DNA, 20 bp, Artificial Sequence
  sgRNA
ctttatcagatagtttacac

SEQ ID NO: 15322 - DNA, 20 bp, Artificial Sequence
  sgRNA
ctccgactacaagtcccaaa

SEQ ID NO: 15323 - DNA, 20 bp, Artificial Sequence
  sgRNA
gttacgcatgcgactggagg

SEQ ID NO: 15324 - DNA, 20 bp, Artificial Sequence
  sgRNA
atgaagacagacgcggttcc

SEQ ID NO: 15325 - DNA, 20 bp, Artificial Sequence
  sgRNA
ggttgactgttgtggaatga

SEQ ID NO: 15326 - DNA, 20 bp, Artificial Sequence
  sgRNA
gggaccggaagtgtgtaacc

SEQ ID NO: 15327 - DNA, 20 bp, Artificial Sequence
  sgRNA
acgtagactgtgagacttct

SEQ ID NO: 15328 - DNA, 20 bp, Artificial Sequence
  sgRNA
catttccacttggcctgtga

SEQ ID NO: 15329 - DNA, 20 bp, Artificial Sequence
  sgRNA
aaagcactcagttagctggc

SEQ ID NO: 15330 - DNA, 20 bp, Artificial Sequence
  sgRNA
cctgcagcataaacatttcc

SEQ ID NO: 15331 - DNA, 20 bp, Artificial Sequence
  sgRNA
gccaaatgagctgccagacc

SEQ ID NO: 15332 - DNA, 20 bp, Artificial Sequence
  sgRNA
aagccagttcaggtggaact

SEQ ID NO: 15333 - DNA, 20 bp, Artificial Sequence
  sgRNA
tgtagccagtgaaagtacag

SEQ ID NO: 15334 - DNA, 20 bp, Artificial Sequence
  sgRNA
acaatactgcaagtggactc

SEQ ID NO: 15335 - DNA, 20 bp, Artificial Sequence
  sgRNA
ctcttgatttggatttgatg

SEQ ID NO: 15336 - DNA, 20 bp, Artificial Sequence
  sgRNA
cactgctgagtggtaggcag

SEQ ID NO: 15337 - DNA, 20 bp, Artificial Sequence
  sgRNA
cggatgtctgtgcgcatgct

SEQ ID NO: 15338 - DNA, 20 bp, Artificial Sequence
  sgRNA
gacgcgcatgcgtgtctcca

SEQ ID NO: 15339 - DNA, 20 bp, Artificial Sequence
  sgRNA
cttggcgattggacgagagt

SEQ ID NO: 15340 - DNA, 20 bp, Artificial Sequence
  sgRNA
accagaagcgcttcatcttc

SEQ ID NO: 15341 - DNA, 20 bp, Artificial Sequence
  sgRNA
agagagggtgctgcgctcgt

SEQ ID NO: 15342 - DNA, 20 bp, Artificial Sequence
  sgRNA
tccaagctgtgatcatttgc

SEQ ID NO: 15343 - DNA, 20 bp, Artificial Sequence
  sgRNA
cgggattcggccactactcc

SEQ ID NO: 15344 - DNA, 20 bp, Artificial Sequence
  sgRNA
agcgcagcagggtgggccgg

SEQ ID NO: 15345 - DNA, 20 bp, Artificial Sequence
  sgRNA
aaaggaccatgcggtgctgc

SEQ ID NO: 15346 - DNA, 20 bp, Artificial Sequence
  sgRNA
cgagcgggcacgcgctgtcc

SEQ ID NO: 15347 - DNA, 20 bp, Artificial Sequence
  sgRNA
gggctcgccgggcagagaca

SEQ ID NO: 15348 - DNA, 20 bp, Artificial Sequence
  sgRNA
gggcagtgcactctgacagt

SEQ ID NO: 15349 - DNA, 20 bp, Artificial Sequence
  sgRNA
acatctaccacagcgtagag

SEQ ID NO: 15350 - DNA, 20 bp, Artificial Sequence
  sgRNA
tccagctggagtatggctgt

SEQ ID NO: 15351 - DNA, 20 bp, Artificial Sequence
  sgRNA
taatctgtgggcctgagggt

SEQ ID NO: 15352 - DNA, 20 bp, Artificial Sequence
  sgRNA
tgtaccacgagatgctgtct

SEQ ID NO: 15353 - DNA, 20 bp, Artificial Sequence
  sgRNA
acccagtcccactgacgcgg

SEQ ID NO: 15354 - DNA, 20 bp, Artificial Sequence
  sgRNA
ggtccgcaacacacagggtg

SEQ ID NO: 15355 - DNA, 20 bp, Artificial Sequence
  sgRNA
aagtcactcaagcccaagcc

SEQ ID NO: 15356 - DNA, 20 bp, Artificial Sequence
  sgRNA
atattctctgatgacacagc

SEQ ID NO: 15357 - DNA, 20 bp, Artificial Sequence
  sgRNA
ggcctccaggtctccaactg

SEQ ID NO: 15358 - DNA, 20 bp, Artificial Sequence
  sgRNA
gggctgcactggctagggcg

SEQ ID NO: 15359 - DNA, 20 bp, Artificial Sequence
  sgRNA
cgcgcctcgggcgcggaaag

SEQ ID NO: 15360 - DNA, 20 bp, Artificial Sequence
  sgRNA
gcgggttccagggaggactg

SEQ ID NO: 15361 - DNA, 20 bp, Artificial Sequence
  sgRNA
aggagagtctgtgcagatcc

SEQ ID NO: 15362 - DNA, 20 bp, Artificial Sequence
  sgRNA
agcagggtattctgggaggc

SEQ ID NO: 15363 - DNA, 20 bp, Artificial Sequence
  sgRNA
aggtttagggtctatggact

SEQ ID NO: 15364 - DNA, 20 bp, Artificial Sequence
  sgRNA
gagaggtgtttactatcact

SEQ ID NO: 15365 - DNA, 20 bp, Artificial Sequence
  sgRNA
ggtctttcatgaggtctagt

SEQ ID NO: 15366 - DNA, 20 bp, Artificial Sequence
  sgRNA
gcaaagctaaagccgtgcag

SEQ ID NO: 15367 - DNA, 20 bp, Artificial Sequence
  sgRNA
cccttcgctagccgggaccc

SEQ ID NO: 15368 - DNA, 20 bp, Artificial Sequence
  sgRNA
ccgagcccagaggacgcgtc

SEQ ID NO: 15369 - DNA, 20 bp, Artificial Sequence
  sgRNA
gggtccagcgagcctgaccg

SEQ ID NO: 15370 - DNA, 20 bp, Artificial Sequence
  sgRNA
ccgaagtctgtctgagcctg

SEQ ID NO: 15371 - DNA, 20 bp, Artificial Sequence
  sgRNA
gggtttcccttggcgctttc

SEQ ID NO: 15372 - DNA, 20 bp, Artificial Sequence
  sgRNA
aaggttccgccctacccgtc

SEQ ID NO: 15373 - DNA, 20 bp, Artificial Sequence
  sgRNA
agggaggtcaagtgaggccc

SEQ ID NO: 15374 - DNA, 20 bp, Artificial Sequence
  sgRNA
agattgcctggaggccttcc

SEQ ID NO: 15375 - DNA, 20 bp, Artificial Sequence
  sgRNA
tgagagggagaggaggtttc

SEQ ID NO: 15376 - DNA, 20 bp, Artificial Sequence
  sgRNA
aggacttccggcgtgtgccg

SEQ ID NO: 15377 - DNA, 20 bp, Artificial Sequence
  sgRNA
tctgactcagccacgtcatc

SEQ ID NO: 15378 - DNA, 20 bp, Artificial Sequence
  sgRNA
gcagcacagcagcggcgact

SEQ ID NO: 15379 - DNA, 20 bp, Artificial Sequence
  sgRNA
attaaatcttcccagaggtt

SEQ ID NO: 15380 - DNA, 20 bp, Artificial Sequence
  sgRNA
ttactacgcgtagcttctgg

SEQ ID NO: 15381 - DNA, 20 bp, Artificial Sequence
  sgRNA
aaaggtgacgtgtggtccaa

SEQ ID NO: 15382 - DNA, 20 bp, Artificial Sequence
  sgRNA
aaaggctgatgagctgtggt

SEQ ID NO: 15383 - DNA, 20 bp, Artificial Sequence
  sgRNA
catctggcaccagtgtgtgg

SEQ ID NO: 15384 - DNA, 20 bp, Artificial Sequence
  sgRNA
gactcggccaaagatttagc

SEQ ID NO: 15385 - DNA, 20 bp, Artificial Sequence
  sgRNA
gcagcaaagaattgaacgga

SEQ ID NO: 15386 - DNA, 20 bp, Artificial Sequence
  sgRNA
aaggcctatgtacccttggg

SEQ ID NO: 15387 - DNA, 20 bp, Artificial Sequence
  sgRNA
gtcattcagcatgggtttcc

SEQ ID NO: 15388 - DNA, 20 bp, Artificial Sequence
  sgRNA
aacttgccgctgatctgggc

SEQ ID NO: 15389 - DNA, 20 bp, Artificial Sequence
  sgRNA
gggtacggaaccgttagtga

SEQ ID NO: 15390 - DNA, 20 bp, Artificial Sequence
  sgRNA
cacgaaggtcagatttagag

SEQ ID NO: 15391 - DNA, 20 bp, Artificial Sequence
  sgRNA
ccacgcctcttcgcgctaac

SEQ ID NO: 15392 - DNA, 20 bp, Artificial Sequence
  sgRNA
ggtcccttagttagagcaag

SEQ ID NO: 15393 - DNA, 20 bp, Artificial Sequence
  sgRNA
aactaagggctagatctgca

SEQ ID NO: 15394 - DNA, 20 bp, Artificial Sequence
  sgRNA
tgagagacggcttcagccaa

SEQ ID NO: 15395 - DNA, 20 bp, Artificial Sequence
  sgRNA
tgcgcccgcccaatagcgca

SEQ ID NO: 15396 - DNA, 20 bp, Artificial Sequence
  sgRNA
tgagcgggtgagtctcaaga

SEQ ID NO: 15397 - DNA, 20 bp, Artificial Sequence
  sgRNA
tgcacattgaagctgttggg

SEQ ID NO: 15398 - DNA, 20 bp, Artificial Sequence
  sgRNA
gtgctgcggctcgtgctccc

SEQ ID NO: 15399 - DNA, 20 bp, Artificial Sequence
  sgRNA
gggcggcagcaggaaaggaa

SEQ ID NO: 15400 - DNA, 20 bp, Artificial Sequence
  sgRNA
gagacacaggtcctgcggac

SEQ ID NO: 15401 - DNA, 20 bp, Artificial Sequence
  sgRNA
atccgggtccctcggcagag

SEQ ID NO: 15402 - DNA, 20 bp, Artificial Sequence
  sgRNA
tcgaagcgaatcggctgtcg

SEQ ID NO: 15403 - DNA, 20 bp, Artificial Sequence
  sgRNA
attggcctacagcgtgccgg

SEQ ID NO: 15404 - DNA, 20 bp, Artificial Sequence
  sgRNA
aaaggcattaacagcgtgag

SEQ ID NO: 15405 - DNA, 20 bp, Artificial Sequence
  sgRNA
agggtgttaagctgcactgt

SEQ ID NO: 15406 - DNA, 20 bp, Artificial Sequence
  sgRNA
aaccgaacccagggtcgagg

SEQ ID NO: 15407 - DNA, 20 bp, Artificial Sequence
  sgRNA
cagggcgcgcgtgtgagtcc

SEQ ID NO: 15408 - DNA, 20 bp, Artificial Sequence
  sgRNA
agactgcgggtcctgccctt

SEQ ID NO: 15409 - DNA, 20 bp, Artificial Sequence
  sgRNA
accgggaagaggtgggagac

SEQ ID NO: 15410 - DNA, 20 bp, Artificial Sequence
  sgRNA
ggtggagatggagataagga

SEQ ID NO: 15411 - DNA, 20 bp, Artificial Sequence
  sgRNA
gtggagagaagacaagaaag

SEQ ID NO: 15412 - DNA, 20 bp, Artificial Sequence
  sgRNA
ggtgctcttgagtgctggct

SEQ ID NO: 15413 - DNA, 20 bp, Artificial Sequence
  sgRNA
tctggaactcagcagaagag

SEQ ID NO: 15414 - DNA, 20 bp, Artificial Sequence
  sgRNA
cacagttcacagtgctgttc

SEQ ID NO: 15415 - DNA, 20 bp, Artificial Sequence
  sgRNA
aagacaagggagagtaagag

SEQ ID NO: 15416 - DNA, 20 bp, Artificial Sequence
  sgRNA
ctggtttgctcttagggccc

SEQ ID NO: 15417 - DNA, 20 bp, Artificial Sequence
  sgRNA
tgtcctggacaccctactga

SEQ ID NO: 15418 - DNA, 20 bp, Artificial Sequence
  sgRNA
agctttgatttgaactgggc

SEQ ID NO: 15419 - DNA, 20 bp, Artificial Sequence
  sgRNA
agtaaactagctgtttgcag

SEQ ID NO: 15420 - DNA, 20 bp, Artificial Sequence
  sgRNA
ggcgggaacacatcctgagg

SEQ ID NO: 15421 - DNA, 20 bp, Artificial Sequence
  sgRNA
aatcacgctcatcgacctat

SEQ ID NO: 15422 - DNA, 20 bp, Artificial Sequence
  sgRNA
gacaaagatctgaacgttat

SEQ ID NO: 15423 - DNA, 20 bp, Artificial Sequence
  sgRNA
ctaagttgtgtggttcataa

SEQ ID NO: 15424 - DNA, 20 bp, Artificial Sequence
  sgRNA
acctagaagttacttcggag

SEQ ID NO: 15425 - DNA, 20 bp, Artificial Sequence
  sgRNA
ggcactcagaaagaagtacc

SEQ ID NO: 15426 - DNA, 20 bp, Artificial Sequence
  sgRNA
ccagttccgatcagtgggaa

SEQ ID NO: 15427 - DNA, 20 bp, Artificial Sequence
  sgRNA
gggccgcgcggccttggcaa

SEQ ID NO: 15428 - DNA, 20 bp, Artificial Sequence
  sgRNA
acacacgcgctccgcctctg

SEQ ID NO: 15429 - DNA, 20 bp, Artificial Sequence
  sgRNA
gcaagcgcggtggcgagctg

SEQ ID NO: 15430 - DNA, 20 bp, Artificial Sequence
  sgRNA
aatactctgggaacaccgat

SEQ ID NO: 15431 - DNA, 20 bp, Artificial Sequence
  sgRNA
gtcattagttgtcagggagc

SEQ ID NO: 15432 - DNA, 20 bp, Artificial Sequence
  sgRNA
agtgcagtaagcgtccttgg

SEQ ID NO: 15433 - DNA, 20 bp, Artificial Sequence
  sgRNA
agcatcatggcgtctctggc

SEQ ID NO: 15434 - DNA, 20 bp, Artificial Sequence
  sgRNA
tggtcagtgcagcacgccag

SEQ ID NO: 15435 - DNA, 20 bp, Artificial Sequence
  sgRNA
agccggcattcattgcacag

SEQ ID NO: 15436 - DNA, 20 bp, Artificial Sequence
  sgRNA
gaagtgggtggagatcaata

SEQ ID NO: 15437 - DNA, 20 bp, Artificial Sequence
  sgRNA
aaactccagctaaactcgga

SEQ ID NO: 15438 - DNA, 20 bp, Artificial Sequence
  sgRNA
ttgagcgaggcactgactag

SEQ ID NO: 15439 - DNA, 20 bp, Artificial Sequence
  sgRNA
ggcactaaatatagacttca

SEQ ID NO: 15440 - DNA, 20 bp, Artificial Sequence
  sgRNA
gggaggaccaatctggaaga

SEQ ID NO: 15441 - DNA, 20 bp, Artificial Sequence
  sgRNA
gggcaaagattgcctgagcc

SEQ ID NO: 15442 - DNA, 20 bp, Artificial Sequence
  sgRNA
gctagacagttgccttcttt

SEQ ID NO: 15443 - DNA, 20 bp, Artificial Sequence
  sgRNA
tggattcagatggaaatgtc

SEQ ID NO: 15444 - DNA, 20 bp, Artificial Sequence
  sgRNA
ggtacttggagctgaaacct

SEQ ID NO: 15445 - DNA, 20 bp, Artificial Sequence
  sgRNA
tcaggcatggactatgattt

SEQ ID NO: 15446 - DNA, 20 bp, Artificial Sequence
  sgRNA
tcacaggttgggcagagccc

SEQ ID NO: 15447 - DNA, 20 bp, Artificial Sequence
  sgRNA
cctgactcctgacacccatg

SEQ ID NO: 15448 - DNA, 20 bp, Artificial Sequence
  sgRNA
gtgcatgtatgcatgcatgt

SEQ ID NO: 15449 - DNA, 20 bp, Artificial Sequence
  sgRNA
agtcgtctggatcagcttga

SEQ ID NO: 15450 - DNA, 20 bp, Artificial Sequence
  sgRNA
gagggtggcagaagggcttc

SEQ ID NO: 15451 - DNA, 20 bp, Artificial Sequence
  sgRNA
tgggtttgaaataaatgtcc

SEQ ID NO: 15452 - DNA, 20 bp, Artificial Sequence
  sgRNA
tccactagggtgacgatact

SEQ ID NO: 15453 - DNA, 20 bp, Artificial Sequence
  sgRNA
tgtacagctaggcatgcttg

SEQ ID NO: 15454 - DNA, 20 bp, Artificial Sequence
  sgRNA
caaccttagacttaggcatg

SEQ ID NO: 15455 - DNA, 20 bp, Artificial Sequence
  sgRNA
gtagagcaaggcctgctgag

SEQ ID NO: 15456 - DNA, 20 bp, Artificial Sequence
  sgRNA
ccctcggctttacgactttc

SEQ ID NO: 15457 - DNA, 20 bp, Artificial Sequence
  sgRNA
cggcagtgtggcgggctcac

SEQ ID NO: 15458 - DNA, 20 bp, Artificial Sequence
  sgRNA
tctgctctactcttggataa

SEQ ID NO: 15459 - DNA, 20 bp, Artificial Sequence
  sgRNA
tgcttccgcctgtaacctga

SEQ ID NO: 15460 - DNA, 20 bp, Artificial Sequence
  sgRNA
aggaatgaatggccatcagg

SEQ ID NO: 15461 - DNA, 20 bp, Artificial Sequence
  sgRNA
tgaaggaaggcagtccgcac

SEQ ID NO: 15462 - DNA, 20 bp, Artificial Sequence
  sgRNA
gcttctgcttgaatacttct

SEQ ID NO: 15463 - DNA, 20 bp, Artificial Sequence
  sgRNA
ggctttgcggcacttccgat

SEQ ID NO: 15464 - DNA, 20 bp, Artificial Sequence
  sgRNA
ggacctacggagattacttc

SEQ ID NO: 15465 - DNA, 20 bp, Artificial Sequence
  sgRNA
gcttcttcccggatacccta

SEQ ID NO: 15466 - DNA, 20 bp, Artificial Sequence
  sgRNA
gacacgaatccaatccaggc

SEQ ID NO: 15467 - DNA, 20 bp, Artificial Sequence
  sgRNA
ttctctattaggagcaatca

SEQ ID NO: 15468 - DNA, 20 bp, Artificial Sequence
  sgRNA
agacggtaaccagtcaatcc

SEQ ID NO: 15469 - DNA, 20 bp, Artificial Sequence
  sgRNA
ttgctatgtctttgaatgat

SEQ ID NO: 15470 - DNA, 20 bp, Artificial Sequence
  sgRNA
cttactttctcctctttatt

SEQ ID NO: 15471 - DNA, 20 bp, Artificial Sequence
  sgRNA
gtctccgcccatgctgatcg

SEQ ID NO: 15472 - DNA, 20 bp, Artificial Sequence
  sgRNA
ggtaccggaacaaatcttgc

SEQ ID NO: 15473 - DNA, 20 bp, Artificial Sequence
  sgRNA
gccgatagaggagtggccac

SEQ ID NO: 15474 - DNA, 20 bp, Artificial Sequence
  sgRNA
ggtgctcgcgcgttgccttt

SEQ ID NO: 15475 - DNA, 20 bp, Artificial Sequence
  sgRNA
agttcagacagcgtgcaccc

SEQ ID NO: 15476 - DNA, 20 bp, Artificial Sequence
  sgRNA
acggaagcgccagtttccat

SEQ ID NO: 15477 - DNA, 20 bp, Artificial Sequence
  sgRNA
tactttatccttgatgatca

SEQ ID NO: 15478 - DNA, 20 bp, Artificial Sequence
  sgRNA
cagcggaggcagcaatctga

SEQ ID NO: 15479 - DNA, 20 bp, Artificial Sequence
  sgRNA
tgacgggcagtttcctccaa

SEQ ID NO: 15480 - DNA, 20 bp, Artificial Sequence
  sgRNA
ggcctttaatacgctcgctg

SEQ ID NO: 15481 - DNA, 20 bp, Artificial Sequence
  sgRNA
gcgcagacagatcacggcgg

SEQ ID NO: 15482 - DNA, 20 bp, Artificial Sequence
  sgRNA
ttcggcgagggaaagtccgc

SEQ ID NO: 15483 - DNA, 20 bp, Artificial Sequence
  sgRNA
ccaacgtcgccacgggttcc

SEQ ID NO: 15484 - DNA, 20 bp, Artificial Sequence
  sgRNA
cagtgaccacatgaaccttg

SEQ ID NO: 15485 - DNA, 20 bp, Artificial Sequence
  sgRNA
gtttgcccgaagcactctgt

SEQ ID NO: 15486 - DNA, 20 bp, Artificial Sequence
  sgRNA
gaaacagtacttccggcctc

SEQ ID NO: 15487 - DNA, 20 bp, Artificial Sequence
  sgRNA
gctaccatcgggccaggcct

SEQ ID NO: 15488 - DNA, 20 bp, Artificial Sequence
  sgRNA
gtggccgaagaggagcgaac

SEQ ID NO: 15489 - DNA, 20 bp, Artificial Sequence
  sgRNA
aggcgcgaaacccgcaacct

SEQ ID NO: 15490 - DNA, 20 bp, Artificial Sequence
  sgRNA
ctgtcgtcgacgcggcgcgc

SEQ ID NO: 15491 - DNA, 20 bp, Artificial Sequence
  sgRNA
acgccttgcctctcagaacg

SEQ ID NO: 15492 - DNA, 20 bp, Artificial Sequence
  sgRNA
tacagcttaggtaggcggat

SEQ ID NO: 15493 - DNA, 20 bp, Artificial Sequence
  sgRNA
tcgtcctgctcgtgttgctt

SEQ ID NO: 15494 - DNA, 20 bp, Artificial Sequence
  sgRNA
tcaaagcaaacagtgatagg

SEQ ID NO: 15495 - DNA, 20 bp, Artificial Sequence
  sgRNA
gagatcgggtctagctctgt

SEQ ID NO: 15496 - DNA, 20 bp, Artificial Sequence
  sgRNA
tatgtacacattgcctcctc

SEQ ID NO: 15497 - DNA, 20 bp, Artificial Sequence
  sgRNA
aaccattctagaatgtctgg

SEQ ID NO: 15498 - DNA, 20 bp, Artificial Sequence
  sgRNA
ttcagccttatgactcagtg

SEQ ID NO: 15499 - DNA, 20 bp, Artificial Sequence
  sgRNA
tcgtcagagcctgagttccc

SEQ ID NO: 15500 - DNA, 20 bp, Artificial Sequence
  sgRNA
cgtttctgagcgttctgcgc

SEQ ID NO: 15501 - DNA, 20 bp, Artificial Sequence
  sgRNA
accagcacccaggaacggcc

SEQ ID NO: 15502 - DNA, 20 bp, Artificial Sequence
  sgRNA
cccgtgtttggctctgggac

SEQ ID NO: 15503 - DNA, 20 bp, Artificial Sequence
  sgRNA
aatctaaagagttgtcccag

SEQ ID NO: 15504 - DNA, 20 bp, Artificial Sequence
  sgRNA
tacataactgagattaagtg

SEQ ID NO: 15505 - DNA, 20 bp, Artificial Sequence
  sgRNA
gccttgcacgccgcccattc

SEQ ID NO: 15506 - DNA, 20 bp, Artificial Sequence
  sgRNA
acagatgtcatctcttcctt

SEQ ID NO: 15507 - DNA, 20 bp, Artificial Sequence
  sgRNA
ttcctttgatttccgtgaaa

SEQ ID NO: 15508 - DNA, 20 bp, Artificial Sequence
  sgRNA
cgggcctgagcgccgttgcc

SEQ ID NO: 15509 - DNA, 20 bp, Artificial Sequence
  sgRNA
atcacgtgacggcccgcagc

SEQ ID NO: 15510 - DNA, 20 bp, Artificial Sequence
  sgRNA
ggcagcagccaagcatccat

SEQ ID NO: 15511 - DNA, 20 bp, Artificial Sequence
  sgRNA
ggaccgcagcgcggcggagg

SEQ ID NO: 15512 - DNA, 20 bp, Artificial Sequence
  sgRNA
ggagggagggcggacggcgt

SEQ ID NO: 15513 - DNA, 20 bp, Artificial Sequence
  sgRNA
gggcgggctgagccctcagg

SEQ ID NO: 15514 - DNA, 20 bp, Artificial Sequence
  sgRNA
ggtaactgacaaagccacac

SEQ ID NO: 15515 - DNA, 20 bp, Artificial Sequence
  sgRNA
gaggaagaaacaccattctg

SEQ ID NO: 15516 - DNA, 20 bp, Artificial Sequence
  sgRNA
cacaagacagtttcacagat

SEQ ID NO: 15517 - DNA, 20 bp, Artificial Sequence
  sgRNA
tgggcacagagcgagggcga

SEQ ID NO: 15518 - DNA, 20 bp, Artificial Sequence
  sgRNA
aagaggccgcctgcctggca

SEQ ID NO: 15519 - DNA, 20 bp, Artificial Sequence
  sgRNA
caggcacagcaggcgtggag

SEQ ID NO: 15520 - DNA, 20 bp, Artificial Sequence
  sgRNA
gaggtagacaagtggtctgg

SEQ ID NO: 15521 - DNA, 20 bp, Artificial Sequence
  sgRNA
agggagttaccagcgagtcg

SEQ ID NO: 15522 - DNA, 20 bp, Artificial Sequence
  sgRNA
gggcgtgaccagggagttag

SEQ ID NO: 15523 - DNA, 20 bp, Artificial Sequence
  sgRNA
ttctataccagctgttgctc

SEQ ID NO: 15524 - DNA, 20 bp, Artificial Sequence
  sgRNA
gtcctcccatctgaagaccc

SEQ ID NO: 15525 - DNA, 20 bp, Artificial Sequence
  sgRNA
aagggttgctgacagatagg

SEQ ID NO: 15526 - DNA, 20 bp, Artificial Sequence
  sgRNA
ggttagcaatcattacaaag

SEQ ID NO: 15527 - DNA, 20 bp, Artificial Sequence
  sgRNA
taagctgccttaatatctct

SEQ ID NO: 15528 - DNA, 20 bp, Artificial Sequence
  sgRNA
gattctgttatcagactccg

SEQ ID NO: 15529 - DNA, 20 bp, Artificial Sequence
  sgRNA
ggttcaaagtacagctgccg

SEQ ID NO: 15530 - DNA, 20 bp, Artificial Sequence
  sgRNA
cgataaactgaagaaggaac

SEQ ID NO: 15531 - DNA, 20 bp, Artificial Sequence
  sgRNA
gggatgacttggctaaagag

SEQ ID NO: 15532 - DNA, 20 bp, Artificial Sequence
  sgRNA
aatagacattggctcagttg

SEQ ID NO: 15533 - DNA, 20 bp, Artificial Sequence
  sgRNA
agacacatggaatatcagct

SEQ ID NO: 15534 - DNA, 20 bp, Artificial Sequence
  sgRNA
ttcttctagagagctgcaaa

SEQ ID NO: 15535 - DNA, 20 bp, Artificial Sequence
  sgRNA
gccggtggtaatggatgtgg

SEQ ID NO: 15536 - DNA, 20 bp, Artificial Sequence
  sgRNA
ctccgagccactggagcctt

SEQ ID NO: 15537 - DNA, 20 bp, Artificial Sequence
  sgRNA
gcacacctccttgcgccgcg

SEQ ID NO: 15538 - DNA, 20 bp, Artificial Sequence
  sgRNA
gtcgaagactatggtgtcac

SEQ ID NO: 15539 - DNA, 20 bp, Artificial Sequence
  sgRNA
cactgagaagaacccacctc

SEQ ID NO: 15540 - DNA, 20 bp, Artificial Sequence
  sgRNA
ggactgagaagaaatctcac

SEQ ID NO: 15541 - DNA, 20 bp, Artificial Sequence
  sgRNA
agagacagggacaggacgtg

SEQ ID NO: 15542 - DNA, 20 bp, Artificial Sequence
  sgRNA
gtatctgacaggaacctgag

SEQ ID NO: 15543 - DNA, 20 bp, Artificial Sequence
  sgRNA
gggcccatccagaccacact

SEQ ID NO: 15544 - DNA, 20 bp, Artificial Sequence
  sgRNA
ctctgcctactgtgcagccc

SEQ ID NO: 15545 - DNA, 20 bp, Artificial Sequence
  sgRNA
gggtcgagacgtcggcccga

SEQ ID NO: 15546 - DNA, 20 bp, Artificial Sequence
  sgRNA
tcgccctcctcgacctctcc

SEQ ID NO: 15547 - DNA, 20 bp, Artificial Sequence
  sgRNA
ttggctgcgcgctgagctag

SEQ ID NO: 15548 - DNA, 20 bp, Artificial Sequence
  sgRNA
cgggcacgcggcgctgtccg

SEQ ID NO: 15549 - DNA, 20 bp, Artificial Sequence
  sgRNA
agggcgccagccaatggcgg

SEQ ID NO: 15550 - DNA, 20 bp, Artificial Sequence
  sgRNA
gctcagcccaagagattgtc

SEQ ID NO: 15551 - DNA, 20 bp, Artificial Sequence
  sgRNA
gaactgagtgcgccagagag

SEQ ID NO: 15552 - DNA, 20 bp, Artificial Sequence
  sgRNA
atctttgacttctagcttgg

SEQ ID NO: 15553 - DNA, 20 bp, Artificial Sequence
  sgRNA
ggtaggtaacctggcgcaca

SEQ ID NO: 15554 - DNA, 20 bp, Artificial Sequence
  sgRNA
tggagggttaaaggttgctc

SEQ ID NO: 15555 - DNA, 20 bp, Artificial Sequence
  sgRNA
tatagatctcttggctgcag

SEQ ID NO: 15556 - DNA, 20 bp, Artificial Sequence
  sgRNA
aggaagaaggaatccggtac

SEQ ID NO: 15557 - DNA, 20 bp, Artificial Sequence
  sgRNA
gaggcggatccatgcagccc

SEQ ID NO: 15558 - DNA, 20 bp, Artificial Sequence
  sgRNA
tgaaagagcgccgaggaatt

SEQ ID NO: 15559 - DNA, 20 bp, Artificial Sequence
  sgRNA
gcgcgacgcaggccactgtc

SEQ ID NO: 15560 - DNA, 20 bp, Artificial Sequence
  sgRNA
gtgctccggaagcgatccca

SEQ ID NO: 15561 - DNA, 20 bp, Artificial Sequence
  sgRNA
gtcgagctgagcgatcgcag

SEQ ID NO: 15562 - DNA, 20 bp, Artificial Sequence
  sgRNA
gaatttggttgtaaataacg

SEQ ID NO: 15563 - DNA, 20 bp, Artificial Sequence
  sgRNA
aactttctctggatttgtac

SEQ ID NO: 15564 - DNA, 20 bp, Artificial Sequence
  sgRNA
agccctcagctggcggcgtg

SEQ ID NO: 15565 - DNA, 20 bp, Artificial Sequence
  sgRNA
cgcattcgtacttatagact

SEQ ID NO: 15566 - DNA, 20 bp, Artificial Sequence
  sgRNA
aagctgtagcaactgtttcc

SEQ ID NO: 15567 - DNA, 20 bp, Artificial Sequence
  sgRNA
aagggcctggcagtgacatc

SEQ ID NO: 15568 - DNA, 20 bp, Artificial Sequence
  sgRNA
ctctagacgtggcagagtgc

SEQ ID NO: 15569 - DNA, 20 bp, Artificial Sequence
  sgRNA
gctctctgaggactggcgac

SEQ ID NO: 15570 - DNA, 20 bp, Artificial Sequence
  sgRNA
cgaacgcggcgcccggtctg

SEQ ID NO: 15571 - DNA, 20 bp, Artificial Sequence
  sgRNA
aagctctctaggaagctcgg

SEQ ID NO: 15572 - DNA, 20 bp, Artificial Sequence
  sgRNA
ctctatggtaggccagcaaa

SEQ ID NO: 15573 - DNA, 20 bp, Artificial Sequence
  sgRNA
cgagcgccctcagctacacc

SEQ ID NO: 15574 - DNA, 20 bp, Artificial Sequence
  sgRNA
agtttagagggtctgggtgc

SEQ ID NO: 15575 - DNA, 20 bp, Artificial Sequence
  sgRNA
aagggagtgtgcggagtcta

SEQ ID NO: 15576 - DNA, 20 bp, Artificial Sequence
  sgRNA
gctgacgctgctattagtct

SEQ ID NO: 15577 - DNA, 20 bp, Artificial Sequence
  sgRNA
ggttaagggtgatggccttt

SEQ ID NO: 15578 - DNA, 20 bp, Artificial Sequence
  sgRNA
gggaaacgtggatctcggcg

SEQ ID NO: 15579 - DNA, 20 bp, Artificial Sequence
  sgRNA
ccgaccgccgcttagccttt

SEQ ID NO: 15580 - DNA, 20 bp, Artificial Sequence
  sgRNA
gagtcctgcgggcgggcgcc

SEQ ID NO: 15581 - DNA, 20 bp, Artificial Sequence
  sgRNA
cgcaggcgatcgctacgcgg

SEQ ID NO: 15582 - DNA, 20 bp, Artificial Sequence
  sgRNA
gcatggactttgcctgttgg

SEQ ID NO: 15583 - DNA, 20 bp, Artificial Sequence
  sgRNA
cagaagaccctttcccatca

SEQ ID NO: 15584 - DNA, 20 bp, Artificial Sequence
  sgRNA
taaatattgacctgtacatc

SEQ ID NO: 15585 - DNA, 20 bp, Artificial Sequence
  sgRNA
actgaacacaagctgaacgg

SEQ ID NO: 15586 - DNA, 20 bp, Artificial Sequence
  sgRNA
tttggatgtgggctggcagc

SEQ ID NO: 15587 - DNA, 20 bp, Artificial Sequence
  sgRNA
tccgtcatatcccgtcctcg

SEQ ID NO: 15588 - DNA, 20 bp, Artificial Sequence
  sgRNA
actcgcccacctttcacctt

SEQ ID NO: 15589 - DNA, 20 bp, Artificial Sequence
  sgRNA
ctcagatctagttgcatgat

SEQ ID NO: 15590 - DNA, 20 bp, Artificial Sequence
  sgRNA
acgcgaacgctatggacacg

SEQ ID NO: 15591 - DNA, 20 bp, Artificial Sequence
  sgRNA
atagagtttggttacttgaa

SEQ ID NO: 15592 - DNA, 20 bp, Artificial Sequence
  sgRNA
cgacaagccactcacggctt

SEQ ID NO: 15593 - DNA, 20 bp, Artificial Sequence
  sgRNA
ggaagaattacccgcacttc

SEQ ID NO: 15594 - DNA, 20 bp, Artificial Sequence
  sgRNA
gccgaaacccgaatctccta

SEQ ID NO: 15595 - DNA, 20 bp, Artificial Sequence
  sgRNA
ttgggctgtcagcagatctg

SEQ ID NO: 15596 - DNA, 20 bp, Artificial Sequence
  sgRNA
gctctgttaggaaggcatga

SEQ ID NO: 15597 - DNA, 20 bp, Artificial Sequence
  sgRNA
ttacagcccggctctgtgat

SEQ ID NO: 15598 - DNA, 20 bp, Artificial Sequence
  sgRNA
aaagaaaggagcatgatgat

SEQ ID NO: 15599 - DNA, 20 bp, Artificial Sequence
  sgRNA
taagaagagggaaagggttc

SEQ ID NO: 15600 - DNA, 20 bp, Artificial Sequence
  sgRNA
gagccaatcagagctggcgg

SEQ ID NO: 15601 - DNA, 20 bp, Artificial Sequence
  sgRNA
cccttgcaacctctttcgct

SEQ ID NO: 15602 - DNA, 20 bp, Artificial Sequence
  sgRNA
ctgctgctgcgaaagagagc

SEQ ID NO: 15603 - DNA, 20 bp, Artificial Sequence
  sgRNA
tcacaataggtttggaggtg

SEQ ID NO: 15604 - DNA, 20 bp, Artificial Sequence
  sgRNA
tagatttggtaaagacatga

SEQ ID NO: 15605 - DNA, 20 bp, Artificial Sequence
  sgRNA
cttgtgagccataagtccaa

SEQ ID NO: 15606 - DNA, 20 bp, Artificial Sequence
  sgRNA
ggagtctttctaggatctag

SEQ ID NO: 15607 - DNA, 20 bp, Artificial Sequence
  sgRNA
cccagcacattccttggcac

SEQ ID NO: 15608 - DNA, 20 bp, Artificial Sequence
  sgRNA
ggccactgacctggaccgat

SEQ ID NO: 15609 - DNA, 20 bp, Artificial Sequence
  sgRNA
aacgggaagtctttggtctc

SEQ ID NO: 15610 - DNA, 20 bp, Artificial Sequence
  sgRNA
tttcagcagaggcagcaacc

SEQ ID NO: 15611 - DNA, 20 bp, Artificial Sequence
  sgRNA
gttggctttccctctgcagg

SEQ ID NO: 15612 - DNA, 20 bp, Artificial Sequence
  sgRNA
aagaaccaagtattcagcca

SEQ ID NO: 15613 - DNA, 20 bp, Artificial Sequence
  sgRNA
tagaatgtctgggtggaaca

SEQ ID NO: 15614 - DNA, 20 bp, Artificial Sequence
  sgRNA
cccttgtggtgagatcacag

SEQ ID NO: 15615 - DNA, 20 bp, Artificial Sequence
  sgRNA
aacgaggcatcattcatgcc

SEQ ID NO: 15616 - DNA, 20 bp, Artificial Sequence
  sgRNA
gagatcagaccgacgtatgc

SEQ ID NO: 15617 - DNA, 20 bp, Artificial Sequence
  sgRNA
ctgaaacggaacggaatgcc

SEQ ID NO: 15618 - DNA, 20 bp, Artificial Sequence
  sgRNA
ttgtgccaggagtctcgcgg

SEQ ID NO: 15619 - DNA, 20 bp, Artificial Sequence
  sgRNA
gtctaagatatagagctgtg

SEQ ID NO: 15620 - DNA, 20 bp, Artificial Sequence
  sgRNA
gatagtcgccataacaagta

SEQ ID NO: 15621 - DNA, 20 bp, Artificial Sequence
  sgRNA
ctggagaggccatgggctgg

SEQ ID NO: 15622 - DNA, 20 bp, Artificial Sequence
  sgRNA
agagcatgcggtaggaacct

SEQ ID NO: 15623 - DNA, 20 bp, Artificial Sequence
  sgRNA
ccatgagtttgtggagaggg

SEQ ID NO: 15624 - DNA, 20 bp, Artificial Sequence
  sgRNA
tcggcaagcatgtttggaac

SEQ ID NO: 15625 - DNA, 20 bp, Artificial Sequence
  sgRNA
gctcagtatgagtaacatag

SEQ ID NO: 15626 - DNA, 20 bp, Artificial Sequence
  sgRNA
ggacctcaaataagtctgtg

SEQ ID NO: 15627 - DNA, 20 bp, Artificial Sequence
  sgRNA
gtccaaagacccgtcgcagc

SEQ ID NO: 15628 - DNA, 20 bp, Artificial Sequence
  sgRNA
gtttgatctctcggtgctag

SEQ ID NO: 15629 - DNA, 20 bp, Artificial Sequence
  sgRNA
cctggagttcccatgggtct

SEQ ID NO: 15630 - DNA, 20 bp, Artificial Sequence
  sgRNA
agtctgtgttgtatcttctc

SEQ ID NO: 15631 - DNA, 20 bp, Artificial Sequence
  sgRNA
tacacaatcctcgaagctgt

SEQ ID NO: 15632 - DNA, 20 bp, Artificial Sequence
  sgRNA
gcttgacagacccactgtgg

SEQ ID NO: 15633 - DNA, 20 bp, Artificial Sequence
  sgRNA
agtaagttatccgggaccct

SEQ ID NO: 15634 - DNA, 20 bp, Artificial Sequence
  sgRNA
aggagtatatgtttaagcag

SEQ ID NO: 15635 - DNA, 20 bp, Artificial Sequence
  sgRNA
ccaaattaacccattattgt

SEQ ID NO: 15636 - DNA, 20 bp, Artificial Sequence
  sgRNA
gcagccgcctaagctgtctt

SEQ ID NO: 15637 - DNA, 20 bp, Artificial Sequence
  sgRNA
acgcccattgggcctcccac

SEQ ID NO: 15638 - DNA, 20 bp, Artificial Sequence
  sgRNA
gcccacgcgggagggacatg

SEQ ID NO: 15639 - DNA, 20 bp, Artificial Sequence
  sgRNA
aatagtctaaagtgccgagg

SEQ ID NO: 15640 - DNA, 20 bp, Artificial Sequence
  sgRNA
gttgagtcgatgagaacaca

SEQ ID NO: 15641 - DNA, 20 bp, Artificial Sequence
  sgRNA
gaccctccgttctcatctag

SEQ ID NO: 15642 - DNA, 20 bp, Artificial Sequence
  sgRNA
ggttactgggtgcggccttg

SEQ ID NO: 15643 - DNA, 20 bp, Artificial Sequence
  sgRNA
gtcctctagacgggtgggcg

SEQ ID NO: 15644 - DNA, 20 bp, Artificial Sequence
  sgRNA
ttcgggccggacggtcctcc

SEQ ID NO: 15645 - DNA, 20 bp, Artificial Sequence
  sgRNA
ttcgcagacaggcgtgcgga

SEQ ID NO: 15646 - DNA, 20 bp, Artificial Sequence
  sgRNA
cgccgccgggcaggaaagag

SEQ ID NO: 15647 - DNA, 20 bp, Artificial Sequence
  sgRNA
gccgcccaacctgacagccc

SEQ ID NO: 15648 - DNA, 20 bp, Artificial Sequence
  sgRNA
gtccgagtcccaggtcgtgc

SEQ ID NO: 15649 - DNA, 20 bp, Artificial Sequence
  sgRNA
cagcgcccgaccgcttatat

SEQ ID NO: 15650 - DNA, 20 bp, Artificial Sequence
  sgRNA
gtctatttagaacccagccc

SEQ ID NO: 15651 - DNA, 20 bp, Artificial Sequence
  sgRNA
ggcagtgggaggtgctgagc

SEQ ID NO: 15652 - DNA, 20 bp, Artificial Sequence
  sgRNA
gattacccttcttaccctcg

SEQ ID NO: 15653 - DNA, 20 bp, Artificial Sequence
  sgRNA
gagccgtaacctgctcttgc

SEQ ID NO: 15654 - DNA, 20 bp, Artificial Sequence
  sgRNA
attactggtcccgtgacgcc

SEQ ID NO: 15655 - DNA, 20 bp, Artificial Sequence
  sgRNA
gcaactcaggtcacaatccc

SEQ ID NO: 15656 - DNA, 20 bp, Artificial Sequence
  sgRNA
aggcgtccgtaccgcttgac

SEQ ID NO: 15657 - DNA, 20 bp, Artificial Sequence
  sgRNA
tgcccgggtcgaggtcgggt

SEQ ID NO: 15658 - DNA, 20 bp, Artificial Sequence
  sgRNA
tccgctgggtccaggagcag

SEQ ID NO: 15659 - DNA, 20 bp, Artificial Sequence
  sgRNA
gagttccggccaggacctgg

SEQ ID NO: 15660 - DNA, 20 bp, Artificial Sequence
  sgRNA
tttggagacggagacaggtc

SEQ ID NO: 15661 - DNA, 20 bp, Artificial Sequence
  sgRNA
gtcgctggcagcgcggtcgg

SEQ ID NO: 15662 - DNA, 20 bp, Artificial Sequence
  sgRNA
tttcccgccattgtgagaag

SEQ ID NO: 15663 - DNA, 20 bp, Artificial Sequence
  sgRNA
cagtagtcctaaatcatcag

SEQ ID NO: 15664 - DNA, 20 bp, Artificial Sequence
  sgRNA
agtggctggtgcagaattca

SEQ ID NO: 15665 - DNA, 20 bp, Artificial Sequence
  sgRNA
tttattgtccctccaatttc

SEQ ID NO: 15666 - DNA, 20 bp, Artificial Sequence
  sgRNA
cctggagggcgtcctggcgg

SEQ ID NO: 15667 - DNA, 20 bp, Artificial Sequence
  sgRNA
acggcttccgggttggcggg

SEQ ID NO: 15668 - DNA, 20 bp, Artificial Sequence
  sgRNA
gcccacctgagccgcagact

SEQ ID NO: 15669 - DNA, 20 bp, Artificial Sequence
  sgRNA
tggtggccgcccagctgagc

SEQ ID NO: 15670 - DNA, 20 bp, Artificial Sequence
  sgRNA
gcgccagccctttaagtacg

SEQ ID NO: 15671 - DNA, 20 bp, Artificial Sequence
  sgRNA
tgcaacagcagcgagaacgc

SEQ ID NO: 15672 - DNA, 20 bp, Artificial Sequence
  sgRNA
ccgcacctgccctcctagat

SEQ ID NO: 15673 - DNA, 20 bp, Artificial Sequence
  sgRNA
tactggctggtgtcctcggg

SEQ ID NO: 15674 - DNA, 20 bp, Artificial Sequence
  sgRNA
ggcagctcggttctctggca

SEQ ID NO: 15675 - DNA, 20 bp, Artificial Sequence
  sgRNA
ggcagttagacagttctcca

SEQ ID NO: 15676 - DNA, 20 bp, Artificial Sequence
  sgRNA
tcctacaggagatgtgccga

SEQ ID NO: 15677 - DNA, 20 bp, Artificial Sequence
  sgRNA
aaagcagatgtcacgagttt

SEQ ID NO: 15678 - DNA, 20 bp, Artificial Sequence
  sgRNA
gctaatgctataatagaagg

SEQ ID NO: 15679 - DNA, 20 bp, Artificial Sequence
  sgRNA
tgagaagtagaaggcccaga

SEQ ID NO: 15680 - DNA, 20 bp, Artificial Sequence
  sgRNA
tttcgtctataatgagtgcc

SEQ ID NO: 15681 - DNA, 20 bp, Artificial Sequence
  sgRNA
attagatggctttatgagct

SEQ ID NO: 15682 - DNA, 20 bp, Artificial Sequence
  sgRNA
ggaccctgactgtgaccacg

SEQ ID NO: 15683 - DNA, 20 bp, Artificial Sequence
  sgRNA
cctccttaaatgtgctaaat

SEQ ID NO: 15684 - DNA, 20 bp, Artificial Sequence
  sgRNA
gctctttcctcttggctcgt

SEQ ID NO: 15685 - DNA, 20 bp, Artificial Sequence
  sgRNA
cgctgtttgccctctggttg

SEQ ID NO: 15686 - DNA, 20 bp, Artificial Sequence
  sgRNA
ccgggtccggcggctgatag

SEQ ID NO: 15687 - DNA, 20 bp, Artificial Sequence
  sgRNA
tttcatcctttatatgacac

SEQ ID NO: 15688 - DNA, 20 bp, Artificial Sequence
  sgRNA
ttgcccatcaggatgaggta

SEQ ID NO: 15689 - DNA, 20 bp, Artificial Sequence
  sgRNA
agtttctcccaagtctgtgc

SEQ ID NO: 15690 - DNA, 20 bp, Artificial Sequence
  sgRNA
gaaagcgtgagatcaccggg

SEQ ID NO: 15691 - DNA, 20 bp, Artificial Sequence
  sgRNA
atgtagttctcggcgtgaag

SEQ ID NO: 15692 - DNA, 20 bp, Artificial Sequence
  sgRNA
cgcgacgccgcaagacctga

SEQ ID NO: 15693 - DNA, 20 bp, Artificial Sequence
  sgRNA
gctggattccagggcgacta

SEQ ID NO: 15694 - DNA, 20 bp, Artificial Sequence
  sgRNA
ctggacaaccattagctagc

SEQ ID NO: 15695 - DNA, 20 bp, Artificial Sequence
  sgRNA
aggtcctcggttatctgcac

SEQ ID NO: 15696 - DNA, 20 bp, Artificial Sequence
  sgRNA
gactcactctcatgtaaaca

SEQ ID NO: 15697 - DNA, 20 bp, Artificial Sequence
  sgRNA
aaagaccagaactaaggttt

SEQ ID NO: 15698 - DNA, 20 bp, Artificial Sequence
  sgRNA
aaagaacctcacataagctc

SEQ ID NO: 15699 - DNA, 20 bp, Artificial Sequence
  sgRNA
tatcccagagtgctcgagtc

SEQ ID NO: 15700 - DNA, 20 bp, Artificial Sequence
  sgRNA
cccggtagtgctccattctc

SEQ ID NO: 15701 - DNA, 20 bp, Artificial Sequence
  sgRNA
ggcgggtcctgctatttgat

SEQ ID NO: 15702 - DNA, 20 bp, Artificial Sequence
  sgRNA
aatttcccactcaatcagct

SEQ ID NO: 15703 - DNA, 20 bp, Artificial Sequence
  sgRNA
cgggacttctgcgtagagaa

SEQ ID NO: 15704 - DNA, 20 bp, Artificial Sequence
  sgRNA
ggcgcggagcctgcacgccg

SEQ ID NO: 15705 - DNA, 20 bp, Artificial Sequence
  sgRNA
cccacccagaccggcgccga

SEQ ID NO: 15706 - DNA, 20 bp, Artificial Sequence
  sgRNA
gcggccctggagtccctagc

SEQ ID NO: 15707 - DNA, 20 bp, Artificial Sequence
  sgRNA
gttgtcatctaatcagctac

SEQ ID NO: 15708 - DNA, 20 bp, Artificial Sequence
  sgRNA
ctcagcgggacaaagcaaac

SEQ ID NO: 15709 - DNA, 20 bp, Artificial Sequence
  sgRNA
ggccaatgaagtcagcattc

SEQ ID NO: 15710 - DNA, 20 bp, Artificial Sequence
  sgRNA
cttcgctcagctactcttta

SEQ ID NO: 15711 - DNA, 20 bp, Artificial Sequence
  sgRNA
tccttacctaaactccaaga

SEQ ID NO: 15712 - DNA, 20 bp, Artificial Sequence
  sgRNA
gagtaaatgttcccaccagg

SEQ ID NO: 15713 - DNA, 20 bp, Artificial Sequence
  sgRNA
ttgtggcggagagttagacg

SEQ ID NO: 15714 - DNA, 20 bp, Artificial Sequence
  sgRNA
agcttcggacacgtgactcg

SEQ ID NO: 15715 - DNA, 20 bp, Artificial Sequence
  sgRNA
agtgctgacagcttccggtc

SEQ ID NO: 15716 - DNA, 20 bp, Artificial Sequence
  sgRNA
atgccggagtatccgcggct

SEQ ID NO: 15717 - DNA, 20 bp, Artificial Sequence
  sgRNA
ggtagagtagttccgctctg

SEQ ID NO: 15718 - DNA, 20 bp, Artificial Sequence
  sgRNA
agaaccacgccagcagacgg

SEQ ID NO: 15719 - DNA, 20 bp, Artificial Sequence
  sgRNA
ttgaactcaaggccactggg

SEQ ID NO: 15720 - DNA, 20 bp, Artificial Sequence
  sgRNA
ctgcgcaatcccgcccacaa

SEQ ID NO: 15721 - DNA, 20 bp, Artificial Sequence
  sgRNA
gggaaaccgctgagcacctc

SEQ ID NO: 15722 - DNA, 20 bp, Artificial Sequence
  sgRNA
tccatgggcagtcctattat

SEQ ID NO: 15723 - DNA, 20 bp, Artificial Sequence
  sgRNA
ggaaagcaacttgagagaaa

SEQ ID NO: 15724 - DNA, 20 bp, Artificial Sequence
  sgRNA
acttgcttgtgcgcaggtcc

SEQ ID NO: 15725 - DNA, 20 bp, Artificial Sequence
  sgRNA
ccgccatcttgtcattgagt

SEQ ID NO: 15726 - DNA, 20 bp, Artificial Sequence
  sgRNA
ctttaatcttgtcgtcgcac

SEQ ID NO: 15727 - DNA, 20 bp, Artificial Sequence
  sgRNA
tccacctcggtggcgacaac

SEQ ID NO: 15728 - DNA, 20 bp, Artificial Sequence
  sgRNA
tcagtgccgtaaagcacacc

SEQ ID NO: 15729 - DNA, 20 bp, Artificial Sequence
  sgRNA
atggcagaatcgcccgccgc

SEQ ID NO: 15730 - DNA, 20 bp, Artificial Sequence
  sgRNA
cgtccgcagctaaggaaccg

SEQ ID NO: 15731 - DNA, 20 bp, Artificial Sequence
  sgRNA
accatcgggccaggcctcgg

SEQ ID NO: 15732 - DNA, 20 bp, Artificial Sequence
  sgRNA
acacgcctacttctcccaca

SEQ ID NO: 15733 - DNA, 20 bp, Artificial Sequence
  sgRNA
aagccacgcccatcctcaga

SEQ ID NO: 15734 - DNA, 20 bp, Artificial Sequence
  sgRNA
tgtgaggcctcggccggaag

SEQ ID NO: 15735 - DNA, 20 bp, Artificial Sequence
  sgRNA
tcggtggcgccctggcagac

SEQ ID NO: 15736 - DNA, 20 bp, Artificial Sequence
  sgRNA
caccggaagtttatttcttc

SEQ ID NO: 15737 - DNA, 20 bp, Artificial Sequence
  sgRNA
ggaacccgccgcgtggtcgg

SEQ ID NO: 15738 - DNA, 20 bp, Artificial Sequence
  sgRNA
accacctcagccaaccagcg

SEQ ID NO: 15739 - DNA, 20 bp, Artificial Sequence
  sgRNA
cgggccagcggagtcccgtg

SEQ ID NO: 15740 - DNA, 20 bp, Artificial Sequence
  sgRNA
acagtcgggcccaaccacag

SEQ ID NO: 15741 - DNA, 20 bp, Artificial Sequence
  sgRNA
ggaggaggagacacctcagc

SEQ ID NO: 15742 - DNA, 20 bp, Artificial Sequence
  sgRNA
ggttctctaacagctgttgt

SEQ ID NO: 15743 - DNA, 20 bp, Artificial Sequence
  sgRNA
cgccagagccttcgcgccag

SEQ ID NO: 15744 - DNA, 20 bp, Artificial Sequence
  sgRNA
cgaggagttacagctggagc

SEQ ID NO: 15745 - DNA, 20 bp, Artificial Sequence
  sgRNA
cgaggagcaggctgactccg

SEQ ID NO: 15746 - DNA, 20 bp, Artificial Sequence
  sgRNA
gctattgatattgaggtctc

SEQ ID NO: 15747 - DNA, 20 bp, Artificial Sequence
  sgRNA
aaggttcagccctctatatc

SEQ ID NO: 15748 - DNA, 20 bp, Artificial Sequence
  sgRNA
tgtggttccttgatattaaa

SEQ ID NO: 15749 - DNA, 20 bp, Artificial Sequence
  sgRNA
tgcctggcgcggcctctagg

SEQ ID NO: 15750 - DNA, 20 bp, Artificial Sequence
  sgRNA
cgagtttacaaacagtcgag

SEQ ID NO: 15751 - DNA, 20 bp, Artificial Sequence
  sgRNA
gctctgccgctgagtgcacc

SEQ ID NO: 15752 - DNA, 20 bp, Artificial Sequence
  sgRNA
ggcgccaagggtaggcgaag

SEQ ID NO: 15753 - DNA, 20 bp, Artificial Sequence
  sgRNA
gcctacccatccggaatgtc

SEQ ID NO: 15754 - DNA, 20 bp, Artificial Sequence
  sgRNA
gcgagacaagctgagaaatt

SEQ ID NO: 15755 - DNA, 20 bp, Artificial Sequence
  sgRNA
ggaggacccaagctattgtg

SEQ ID NO: 15756 - DNA, 20 bp, Artificial Sequence
  sgRNA
gaacagggaaccctagaacc

SEQ ID NO: 15757 - DNA, 20 bp, Artificial Sequence
  sgRNA
agaactagccctggtgaagt

SEQ ID NO: 15758 - DNA, 20 bp, Artificial Sequence
  sgRNA
tgaatgtgaaatacccacac

SEQ ID NO: 15759 - DNA, 20 bp, Artificial Sequence
  sgRNA
ctgtgtctgggcctacactg

SEQ ID NO: 15760 - DNA, 20 bp, Artificial Sequence
  sgRNA
cagctcatggtttgagaatt

SEQ ID NO: 15761 - DNA, 20 bp, Artificial Sequence
  sgRNA
gagacttgtttgtctgggcc

SEQ ID NO: 15762 - DNA, 20 bp, Artificial Sequence
  sgRNA
aaggaaacccaggctgtgtc

SEQ ID NO: 15763 - DNA, 20 bp, Artificial Sequence
  sgRNA
taagcgacgttcctagttca

SEQ ID NO: 15764 - DNA, 20 bp, Artificial Sequence
  sgRNA
tcagcccgcacccgctccct

SEQ ID NO: 15765 - DNA, 20 bp, Artificial Sequence
  sgRNA
cagctggctgaggcacttgg

SEQ ID NO: 15766 - DNA, 20 bp, Artificial Sequence
  sgRNA
gtgcgccctgtgctcaggcg

SEQ ID NO: 15767 - DNA, 20 bp, Artificial Sequence
  sgRNA
tccgaagtcctgctggtcgc

SEQ ID NO: 15768 - DNA, 20 bp, Artificial Sequence
  sgRNA
actggagctacaagtgggta

SEQ ID NO: 15769 - DNA, 20 bp, Artificial Sequence
  sgRNA
tcaccatgccacgctaccgc

SEQ ID NO: 15770 - DNA, 20 bp, Artificial Sequence
  sgRNA
ccagacacattgatgtaggg

SEQ ID NO: 15771 - DNA, 20 bp, Artificial Sequence
  sgRNA
ttgggacatggattggacaa

SEQ ID NO: 15772 - DNA, 20 bp, Artificial Sequence
  sgRNA
agtcaaaggtcggtaaatag

SEQ ID NO: 15773 - DNA, 20 bp, Artificial Sequence
  sgRNA
ctgcgggtgggcgatgccac

SEQ ID NO: 15774 - DNA, 20 bp, Artificial Sequence
  sgRNA
cggagcagaggctcaaacct

SEQ ID NO: 15775 - DNA, 20 bp, Artificial Sequence
  sgRNA
tagggcgtcgctgtcactcc

SEQ ID NO: 15776 - DNA, 20 bp, Artificial Sequence
  sgRNA
tcaggtcaagcccggttctc

SEQ ID NO: 15777 - DNA, 20 bp, Artificial Sequence
  sgRNA
gctcgctgtgcgtcagagcg

SEQ ID NO: 15778 - DNA, 20 bp, Artificial Sequence
  sgRNA
tccaacgcgccatcagctgg

SEQ ID NO: 15779 - DNA, 20 bp, Artificial Sequence
  sgRNA
actgcagttgcacaggagag

SEQ ID NO: 15780 - DNA, 20 bp, Artificial Sequence
  sgRNA
acgcctacctgacttctcgc

SEQ ID NO: 15781 - DNA, 20 bp, Artificial Sequence
  sgRNA
ctgccagcttctccaggttt

SEQ ID NO: 15782 - DNA, 20 bp, Artificial Sequence
  sgRNA
gcaagaagcactaattatgg

SEQ ID NO: 15783 - DNA, 20 bp, Artificial Sequence
  sgRNA
gaggaggagcttcggctcag

SEQ ID NO: 15784 - DNA, 20 bp, Artificial Sequence
  sgRNA
aatactccagggcagccgtg

SEQ ID NO: 15785 - DNA, 20 bp, Artificial Sequence
  sgRNA
ctagttcttaggcagatgga

SEQ ID NO: 15786 - DNA, 20 bp, Artificial Sequence
  sgRNA
tactatggaaatcagagtac

SEQ ID NO: 15787 - DNA, 20 bp, Artificial Sequence
  sgRNA
gccctcagcttcggctgccc

SEQ ID NO: 15788 - DNA, 20 bp, Artificial Sequence
  sgRNA
aatgatcctttactgtacgt

SEQ ID NO: 15789 - DNA, 20 bp, Artificial Sequence
  sgRNA
atctagagcttatccatgta

SEQ ID NO: 15790 - DNA, 20 bp, Artificial Sequence
  sgRNA
cacaaggtagtgttgacaga

SEQ ID NO: 15791 - DNA, 20 bp, Artificial Sequence
  sgRNA
actcgcctccaaacctggac

SEQ ID NO: 15792 - DNA, 20 bp, Artificial Sequence
  sgRNA
gagtttcattcagcctttgc

SEQ ID NO: 15793 - DNA, 20 bp, Artificial Sequence
  sgRNA
ggagctggctatcacctaac

SEQ ID NO: 15794 - DNA, 20 bp, Artificial Sequence
  sgRNA
gctggaggcgggacgacgac

SEQ ID NO: 15795 - DNA, 20 bp, Artificial Sequence
  sgRNA
ggttcgctctgtttaagtct

SEQ ID NO: 15796 - DNA, 20 bp, Artificial Sequence
  sgRNA
cccagttatgggtggagcta

SEQ ID NO: 15797 - DNA, 20 bp, Artificial Sequence
  sgRNA
gagagctgcagccggctgtg

SEQ ID NO: 15798 - DNA, 20 bp, Artificial Sequence
  sgRNA
ggttcataaatgtctcacct

SEQ ID NO: 15799 - DNA, 20 bp, Artificial Sequence
  sgRNA
cagtcatgccagagtgacag

SEQ ID NO: 15800 - DNA, 20 bp, Artificial Sequence
  sgRNA
acgttgttaaccaaatcaaa

SEQ ID NO: 15801 - DNA, 20 bp, Artificial Sequence
  sgRNA
taacttatcccatttcaaac

SEQ ID NO: 15802 - DNA, 20 bp, Artificial Sequence
  sgRNA
atgtctttagaaatactgca

SEQ ID NO: 15803 - DNA, 20 bp, Artificial Sequence
  sgRNA
tgagggtttgcaccaatccg

SEQ ID NO: 15804 - DNA, 20 bp, Artificial Sequence
  sgRNA
acatttgccgggcaggcagg

SEQ ID NO: 15805 - DNA, 20 bp, Artificial Sequence
  sgRNA
tgcgttggtttggcgggttg

SEQ ID NO: 15806 - DNA, 20 bp, Artificial Sequence
  sgRNA
gaggcgtggttatatattgg

SEQ ID NO: 15807 - DNA, 20 bp, Artificial Sequence
  sgRNA
aggaggcgtggctttactcg

SEQ ID NO: 15808 - DNA, 20 bp, Artificial Sequence
  sgRNA
gaccaggagtcgagtaggcg

SEQ ID NO: 15809 - DNA, 20 bp, Artificial Sequence
  sgRNA
ttctagaaatcgtcaatatc

SEQ ID NO: 15810 - DNA, 20 bp, Artificial Sequence
  sgRNA
tccaagtacaagccctgctg

SEQ ID NO: 15811 - DNA, 20 bp, Artificial Sequence
  sgRNA
ggcttggattacccactgtt

SEQ ID NO: 15812 - DNA, 20 bp, Artificial Sequence
  sgRNA
ttaggtaggcggcattcgtg

SEQ ID NO: 15813 - DNA, 20 bp, Artificial Sequence
  sgRNA
gaggccagtcagcgccattt

SEQ ID NO: 15814 - DNA, 20 bp, Artificial Sequence
  sgRNA
gagcttcccatgatcctcac

SEQ ID NO: 15815 - DNA, 20 bp, Artificial Sequence
  sgRNA
ttcaggagctacgccaacac

SEQ ID NO: 15816 - DNA, 20 bp, Artificial Sequence
  sgRNA
gatggcggaagtgaatacga

SEQ ID NO: 15817 - DNA, 20 bp, Artificial Sequence
  sgRNA
tcactaagctcccgtggctt

SEQ ID NO: 15818 - DNA, 20 bp, Artificial Sequence
  sgRNA
tcatcctgctaattaacata

SEQ ID NO: 15819 - DNA, 20 bp, Artificial Sequence
  sgRNA
ttccagcaaagcattatcca

SEQ ID NO: 15820 - DNA, 20 bp, Artificial Sequence
  sgRNA
aaggaccgccaggcgccctg

SEQ ID NO: 15821 - DNA, 20 bp, Artificial Sequence
  sgRNA
ggagtatgggttaactaatg

SEQ ID NO: 15822 - DNA, 20 bp, Artificial Sequence
  sgRNA
agatggacccggtggagcgc

SEQ ID NO: 15823 - DNA, 20 bp, Artificial Sequence
  sgRNA
ggagcatgcgtattagccga

SEQ ID NO: 15824 - DNA, 20 bp, Artificial Sequence
  sgRNA
attgtcacaggtatgccagc

SEQ ID NO: 15825 - DNA, 20 bp, Artificial Sequence
  sgRNA
tgaactggccctcctgggaa

SEQ ID NO: 15826 - DNA, 20 bp, Artificial Sequence
  sgRNA
gaactgtttaaagacaagcg

SEQ ID NO: 15827 - DNA, 20 bp, Artificial Sequence
  sgRNA
gttccttcccacccatcggc

SEQ ID NO: 15828 - DNA, 20 bp, Artificial Sequence
  sgRNA
tctggccctagatatagcag

SEQ ID NO: 15829 - DNA, 20 bp, Artificial Sequence
  sgRNA
cagggatgtgtttactaagc

SEQ ID NO: 15830 - DNA, 20 bp, Artificial Sequence
  sgRNA
ttgtcgccgtcaggcacagc

SEQ ID NO: 15831 - DNA, 20 bp, Artificial Sequence
  sgRNA
gcagggcgaccgcccatccg

SEQ ID NO: 15832 - DNA, 20 bp, Artificial Sequence
  sgRNA
tgacgcgagcgggcttccgg

SEQ ID NO: 15833 - DNA, 20 bp, Artificial Sequence
  sgRNA
gcagatttaatccgaatgca

SEQ ID NO: 15834 - DNA, 20 bp, Artificial Sequence
  sgRNA
gcacacaacacattcagttt

SEQ ID NO: 15835 - DNA, 20 bp, Artificial Sequence
  sgRNA
ccacctacgggcggagagaa

SEQ ID NO: 15836 - DNA, 20 bp, Artificial Sequence
  sgRNA
tgttcagcctctaagtgata

SEQ ID NO: 15837 - DNA, 20 bp, Artificial Sequence
  sgRNA
ctgtagtatcctctaagatt

SEQ ID NO: 15838 - DNA, 20 bp, Artificial Sequence
  sgRNA
ggtttggtatgttctaaatt

SEQ ID NO: 15839 - DNA, 20 bp, Artificial Sequence
  sgRNA
gccggcgagggcgggtagcc

SEQ ID NO: 15840 - DNA, 20 bp, Artificial Sequence
  sgRNA
gaggaagaagagggtaggtg

SEQ ID NO: 15841 - DNA, 20 bp, Artificial Sequence
  sgRNA
gtcactggaaggaggtgccg

SEQ ID NO: 15842 - DNA, 20 bp, Artificial Sequence
  sgRNA
ggaaggccacagtctttata

SEQ ID NO: 15843 - DNA, 20 bp, Artificial Sequence
  sgRNA
ccagcctccacttgaagtcc

SEQ ID NO: 15844 - DNA, 20 bp, Artificial Sequence
  sgRNA
gggaacaatggagcccttga

SEQ ID NO: 15845 - DNA, 20 bp, Artificial Sequence
  sgRNA
aaatttgcgatctttacaga

SEQ ID NO: 15846 - DNA, 20 bp, Artificial Sequence
  sgRNA
gttgggctcatttctgtaga

SEQ ID NO: 15847 - DNA, 20 bp, Artificial Sequence
  sgRNA
ccttgagaatcgtctataaa

SEQ ID NO: 15848 - DNA, 20 bp, Artificial Sequence
  sgRNA
cttgctgaggctggcaagcc

SEQ ID NO: 15849 - DNA, 20 bp, Artificial Sequence
  sgRNA
agagtgggtggtgttataaa

SEQ ID NO: 15850 - DNA, 20 bp, Artificial Sequence
  sgRNA
cctcagttccacctttcact

SEQ ID NO: 15851 - DNA, 20 bp, Artificial Sequence
  sgRNA
caattcttggcttcaagcca

SEQ ID NO: 15852 - DNA, 20 bp, Artificial Sequence
  sgRNA
ctattggaagcattagtaaa

SEQ ID NO: 15853 - DNA, 20 bp, Artificial Sequence
  sgRNA
gagagattgaactaacacct

SEQ ID NO: 15854 - DNA, 20 bp, Artificial Sequence
  sgRNA
ggagatttgcttgtggagaa

SEQ ID NO: 15855 - DNA, 20 bp, Artificial Sequence
  sgRNA
caattctctgagccagccat

SEQ ID NO: 15856 - DNA, 20 bp, Artificial Sequence
  sgRNA
tgctgtggcttctacgtcac

SEQ ID NO: 15857 - DNA, 20 bp, Artificial Sequence
  sgRNA
ctgtaggcccagcatgtgaa

SEQ ID NO: 15858 - DNA, 20 bp, Artificial Sequence
  sgRNA
tgactgcacaatgctgctgt

SEQ ID NO: 15859 - DNA, 20 bp, Artificial Sequence
  sgRNA
agtcaatcatgacaggagct

SEQ ID NO: 15860 - DNA, 20 bp, Artificial Sequence
  sgRNA
agctctgcacgtttgtacaa

SEQ ID NO: 15861 - DNA, 20 bp, Artificial Sequence
  sgRNA
gcagcctcacgcatgcaccg

SEQ ID NO: 15862 - DNA, 20 bp, Artificial Sequence
  sgRNA
cgcactgttggtgataagag

SEQ ID NO: 15863 - DNA, 20 bp, Artificial Sequence
  sgRNA
caatagacgagcgtcgcggg

SEQ ID NO: 15864 - DNA, 20 bp, Artificial Sequence
  sgRNA
tactccttcaaagctaaatg

SEQ ID NO: 15865 - DNA, 20 bp, Artificial Sequence
  sgRNA
tagtgaagtcatcagttgct

SEQ ID NO: 15866 - DNA, 20 bp, Artificial Sequence
  sgRNA
gagtgaggaaggcagacaac

SEQ ID NO: 15867 - DNA, 20 bp, Artificial Sequence
  sgRNA
gctttctcagtgtctgaagg

SEQ ID NO: 15868 - DNA, 20 bp, Artificial Sequence
  sgRNA
gtcctcaccttggtgctctg

SEQ ID NO: 15869 - DNA, 20 bp, Artificial Sequence
  sgRNA
ctgaggttgagaaacagtga

SEQ ID NO: 15870 - DNA, 20 bp, Artificial Sequence
  sgRNA
agagagacccattacgaatg

SEQ ID NO: 15871 - DNA, 20 bp, Artificial Sequence
  sgRNA
ctgggaggccaacaactcag

SEQ ID NO: 15872 - DNA, 20 bp, Artificial Sequence
  sgRNA
ttgtgggtttcataggagag

SEQ ID NO: 15873 - DNA, 20 bp, Artificial Sequence
  sgRNA
ctgtttaactctcttccaat

SEQ ID NO: 15874 - DNA, 20 bp, Artificial Sequence
  sgRNA
tagcgtgcctgtaagacatg

SEQ ID NO: 15875 - DNA, 20 bp, Artificial Sequence
  sgRNA
ttgttgagttgtgacaagta

SEQ ID NO: 15876 - DNA, 20 bp, Artificial Sequence
  sgRNA
ccgcgcgcaaccctggtggc

SEQ ID NO: 15877 - DNA, 20 bp, Artificial Sequence
  sgRNA
gacaggccagcgtcgttcag

SEQ ID NO: 15878 - DNA, 20 bp, Artificial Sequence
  sgRNA
agtcggtttcacctgcgctc

SEQ ID NO: 15879 - DNA, 20 bp, Artificial Sequence
  sgRNA
cccacccaccagaatcctcg

SEQ ID NO: 15880 - DNA, 20 bp, Artificial Sequence
  sgRNA
gctctaatttcgttctacct

SEQ ID NO: 15881 - DNA, 20 bp, Artificial Sequence
  sgRNA
ggctgtgctagagcatctaa

SEQ ID NO: 15882 - DNA, 20 bp, Artificial Sequence
  sgRNA
cctaaagctcggttaatgcc

SEQ ID NO: 15883 - DNA, 20 bp, Artificial Sequence
  sgRNA
tagttgactagaaggttgac

SEQ ID NO: 15884 - DNA, 20 bp, Artificial Sequence
  sgRNA
atttgcatatcatcactgat

SEQ ID NO: 15885 - DNA, 20 bp, Artificial Sequence
  sgRNA
ccaagcgcgcatttggagcg

SEQ ID NO: 15886 - DNA, 20 bp, Artificial Sequence
  sgRNA
cagagcgatcagcagttgtg

SEQ ID NO: 15887 - DNA, 20 bp, Artificial Sequence
  sgRNA
taaactacaaccagttgttt

SEQ ID NO: 15888 - DNA, 20 bp, Artificial Sequence
  sgRNA
caaacaaatagcaatgagct

SEQ ID NO: 15889 - DNA, 20 bp, Artificial Sequence
  sgRNA
tacctttattctctgttctc

SEQ ID NO: 15890 - DNA, 20 bp, Artificial Sequence
  sgRNA
gttgataggagtggagaagg

SEQ ID NO: 15891 - DNA, 20 bp, Artificial Sequence
  sgRNA
ggacagtaagggcagcgagg

SEQ ID NO: 15892 - DNA, 20 bp, Artificial Sequence
  sgRNA
cagagggagtacagggcgtc

SEQ ID NO: 15893 - DNA, 20 bp, Artificial Sequence
  sgRNA
gggcgccaggaagggtgcgc

SEQ ID NO: 15894 - DNA, 20 bp, Artificial Sequence
  sgRNA
gttctatgacaggcaggcgc

SEQ ID NO: 15895 - DNA, 20 bp, Artificial Sequence
  sgRNA
cgctggtagaaaccagccaa

SEQ ID NO: 15896 - DNA, 20 bp, Artificial Sequence
  sgRNA
tgcgtgctggcccatgggcg

SEQ ID NO: 15897 - DNA, 20 bp, Artificial Sequence
  sgRNA
gaatgaaccaagtgtccgcc

SEQ ID NO: 15898 - DNA, 20 bp, Artificial Sequence
  sgRNA
tcgcccgccgccgaggagaa

SEQ ID NO: 15899 - DNA, 20 bp, Artificial Sequence
  sgRNA
gctcagggctcccgcgtacc

SEQ ID NO: 15900 - DNA, 20 bp, Artificial Sequence
  sgRNA
ggtcccgcatctacttccgg

SEQ ID NO: 15901 - DNA, 20 bp, Artificial Sequence
  sgRNA
catctcgtgcgtaagatcca

SEQ ID NO: 15902 - DNA, 20 bp, Artificial Sequence
  sgRNA
cccgttccgacagaacccag

SEQ ID NO: 15903 - DNA, 20 bp, Artificial Sequence
  sgRNA
acgtgccttcagcagtgaca

SEQ ID NO: 15904 - DNA, 20 bp, Artificial Sequence
  sgRNA
gaccctagacacccgcatag

SEQ ID NO: 15905 - DNA, 20 bp, Artificial Sequence
  sgRNA
cctccagagaaagtactttc

SEQ ID NO: 15906 - DNA, 20 bp, Artificial Sequence
  sgRNA
gcggaagcgcttgcttccat

SEQ ID NO: 15907 - DNA, 20 bp, Artificial Sequence
  sgRNA
gtcaattctagaggaaggcg

SEQ ID NO: 15908 - DNA, 20 bp, Artificial Sequence
  sgRNA
agcgcttacggaccgccctt

SEQ ID NO: 15909 - DNA, 20 bp, Artificial Sequence
  sgRNA
cgtagcttctgctatgtggc

SEQ ID NO: 15910 - DNA, 20 bp, Artificial Sequence
  sgRNA
gggaacagttagacatgaaa

SEQ ID NO: 15911 - DNA, 20 bp, Artificial Sequence
  sgRNA
acttgtgctaagaactttcc

SEQ ID NO: 15912 - DNA, 20 bp, Artificial Sequence
  sgRNA
ggtgttcagcgaggtataaa

SEQ ID NO: 15913 - DNA, 20 bp, Artificial Sequence
  sgRNA
ttgcaaacacaggagccatc

SEQ ID NO: 15914 - DNA, 20 bp, Artificial Sequence
  sgRNA
taagacaatggctgtgtgtc

SEQ ID NO: 15915 - DNA, 20 bp, Artificial Sequence
  sgRNA
tgcatagttccagagctcag

SEQ ID NO: 15916 - DNA, 20 bp, Artificial Sequence
  sgRNA
tgaatcgatataaagaggag

SEQ ID NO: 15917 - DNA, 20 bp, Artificial Sequence
  sgRNA
agacggacttaagcgacagc

SEQ ID NO: 15918 - DNA, 20 bp, Artificial Sequence
  sgRNA
ctgtggcttgctcgtcattg

SEQ ID NO: 15919 - DNA, 20 bp, Artificial Sequence
  sgRNA
gcatctgtgtgactgtgttg

SEQ ID NO: 15920 - DNA, 20 bp, Artificial Sequence
  sgRNA
gaggctatcacttgagggcg

SEQ ID NO: 15921 - DNA, 20 bp, Artificial Sequence
  sgRNA
gggaaatcttcctagggcca

SEQ ID NO: 15922 - DNA, 20 bp, Artificial Sequence
  sgRNA
cctgctgtgttgacctcaag

SEQ ID NO: 15923 - DNA, 20 bp, Artificial Sequence
  sgRNA
aatcgaggcgtactttgagg

SEQ ID NO: 15924 - DNA, 20 bp, Artificial Sequence
  sgRNA
aggcgtggaaaggcacgaag

SEQ ID NO: 15925 - DNA, 20 bp, Artificial Sequence
  sgRNA
gcgcatggccctttaatggg

SEQ ID NO: 15926 - DNA, 20 bp, Artificial Sequence
  sgRNA
tctacttatgcgtgtttccc

SEQ ID NO: 15927 - DNA, 20 bp, Artificial Sequence
  sgRNA
ttcagttgtgacatcacgcc

SEQ ID NO: 15928 - DNA, 20 bp, Artificial Sequence
  sgRNA
aaggttgaggtctcttcttc

SEQ ID NO: 15929 - DNA, 20 bp, Artificial Sequence
  sgRNA
gccttggcgtggcgcacttc

SEQ ID NO: 15930 - DNA, 20 bp, Artificial Sequence
  sgRNA
tcttactcgccggagttccc

SEQ ID NO: 15931 - DNA, 20 bp, Artificial Sequence
  sgRNA
gcagctttcacgcagtctcc

SEQ ID NO: 15932 - DNA, 20 bp, Artificial Sequence
  sgRNA
ggcccgcggagccatctgat

SEQ ID NO: 15933 - DNA, 20 bp, Artificial Sequence
  sgRNA
agttcttcagccaaagcttg

SEQ ID NO: 15934 - DNA, 20 bp, Artificial Sequence
  sgRNA
gacagtgggctgggactctg

SEQ ID NO: 15935 - DNA, 20 bp, Artificial Sequence
  sgRNA
cgtacttccgccaatttgct

SEQ ID NO: 15936 - DNA, 20 bp, Artificial Sequence
  sgRNA
gtggcgtagaactctttcgc

SEQ ID NO: 15937 - DNA, 20 bp, Artificial Sequence
  sgRNA
tcagaatcacactgtgggcg

SEQ ID NO: 15938 - DNA, 20 bp, Artificial Sequence
  sgRNA
tagatagagcatatgaggag

SEQ ID NO: 15939 - DNA, 20 bp, Artificial Sequence
  sgRNA
taggccctatctgactttca

SEQ ID NO: 15940 - DNA, 20 bp, Artificial Sequence
  sgRNA
tacttgcttaacattccaga

SEQ ID NO: 15941 - DNA, 20 bp, Artificial Sequence
  sgRNA
aagcaatgtattagttagcc

SEQ ID NO: 15942 - DNA, 20 bp, Artificial Sequence
  sgRNA
aaggtgtgtgctgccatgcc

SEQ ID NO: 15943 - DNA, 20 bp, Artificial Sequence
  sgRNA
ggcaggcagatctaagtgtg

SEQ ID NO: 15944 - DNA, 20 bp, Artificial Sequence
  sgRNA
tgactaggagcgtaaggcct

SEQ ID NO: 15945 - DNA, 20 bp, Artificial Sequence
  sgRNA
aaactcaggcaactagtgta

SEQ ID NO: 15946 - DNA, 20 bp, Artificial Sequence
  sgRNA
cgcggtacacgagccagtcg

SEQ ID NO: 15947 - DNA, 20 bp, Artificial Sequence
  sgRNA
ctcctgagatgctccacttg

SEQ ID NO: 15948 - DNA, 20 bp, Artificial Sequence
  sgRNA
gttgcggctgccaagcaatc

SEQ ID NO: 15949 - DNA, 20 bp, Artificial Sequence
  sgRNA
cctcttcgggacacctagaa

SEQ ID NO: 15950 - DNA, 20 bp, Artificial Sequence
  sgRNA
cgggagggacgacaaggatg

SEQ ID NO: 15951 - DNA, 20 bp, Artificial Sequence
  sgRNA
tcaacaacgctgagcacttc

SEQ ID NO: 15952 - DNA, 20 bp, Artificial Sequence
  sgRNA
catcgggaaggcttgagtct

SEQ ID NO: 15953 - DNA, 20 bp, Artificial Sequence
  sgRNA
ggttagtacgcgtgcgcagt

SEQ ID NO: 15954 - DNA, 20 bp, Artificial Sequence
  sgRNA
catcacgtaatgacttcaag

SEQ ID NO: 15955 - DNA, 20 bp, Artificial Sequence
  sgRNA
tgtcaactgtgttgcgccaa

SEQ ID NO: 15956 - DNA, 20 bp, Artificial Sequence
  sgRNA
cccgcgggtgacctagattg

SEQ ID NO: 15957 - DNA, 20 bp, Artificial Sequence
  sgRNA
aggatccagccgaggaccct

SEQ ID NO: 15958 - DNA, 20 bp, Artificial Sequence
  sgRNA
tgtcgaagtcggtcccaccc

SEQ ID NO: 15959 - DNA, 20 bp, Artificial Sequence
  sgRNA
agggtgcaggttcaaacatc

SEQ ID NO: 15960 - DNA, 20 bp, Artificial Sequence
  sgRNA
tggagtcctttagaagaggc

SEQ ID NO: 15961 - DNA, 20 bp, Artificial Sequence
  sgRNA
gcagccaaagcagatcgtga

SEQ ID NO: 15962 - DNA, 20 bp, Artificial Sequence
  sgRNA
taaagaaccagacctcttgg

SEQ ID NO: 15963 - DNA, 20 bp, Artificial Sequence
  sgRNA
cgcccacctacagaccggac

SEQ ID NO: 15964 - DNA, 20 bp, Artificial Sequence
  sgRNA
ggcgggaccattcggcaccg

SEQ ID NO: 15965 - DNA, 20 bp, Artificial Sequence
  sgRNA
gaccttaacccttccgaccc

SEQ ID NO: 15966 - DNA, 20 bp, Artificial Sequence
  sgRNA
cccgcctgtccgaggacgtc

SEQ ID NO: 15967 - DNA, 20 bp, Artificial Sequence
  sgRNA
cgagccttatgccctggaga

SEQ ID NO: 15968 - DNA, 20 bp, Artificial Sequence
  sgRNA
cgccaaagtctctagggatg

SEQ ID NO: 15969 - DNA, 20 bp, Artificial Sequence
  sgRNA
agagaagcttctgagtaaac

SEQ ID NO: 15970 - DNA, 20 bp, Artificial Sequence
  sgRNA
ttatatccctcactaacctg

SEQ ID NO: 15971 - DNA, 20 bp, Artificial Sequence
  sgRNA
agtgaggttcccgaaggctt

SEQ ID NO: 15972 - DNA, 20 bp, Artificial Sequence
  sgRNA
ttcgcgttgctatggtgtcc

SEQ ID NO: 15973 - DNA, 20 bp, Artificial Sequence
  sgRNA
actaggagtgacacattcat

SEQ ID NO: 15974 - DNA, 20 bp, Artificial Sequence
  sgRNA
catgcgtacttcaagagccc

SEQ ID NO: 15975 - DNA, 20 bp, Artificial Sequence
  sgRNA
ccgcccaatctcgggtgtcc

SEQ ID NO: 15976 - DNA, 20 bp, Artificial Sequence
  sgRNA
ctgccaggagcttccggcgc

SEQ ID NO: 15977 - DNA, 20 bp, Artificial Sequence
  sgRNA
gcagtttaaattcgcgtctg

SEQ ID NO: 15978 - DNA, 20 bp, Artificial Sequence
  sgRNA
gtctaagggcggaagcgtca

SEQ ID NO: 15979 - DNA, 20 bp, Artificial Sequence
  sgRNA
agcatgcgcagtcgctcttc

SEQ ID NO: 15980 - DNA, 20 bp, Artificial Sequence
  sgRNA
ccgggcacagcgcacccaac

SEQ ID NO: 15981 - DNA, 20 bp, Artificial Sequence
  sgRNA
gcagttggatcctcactcca

SEQ ID NO: 15982 - DNA, 20 bp, Artificial Sequence
  sgRNA
gccgtgcgtttgcctgtgcc

SEQ ID NO: 15983 - DNA, 20 bp, Artificial Sequence
  sgRNA
ggaaggaacgggagaactag

SEQ ID NO: 15984 - DNA, 20 bp, Artificial Sequence
  sgRNA
aaagggaggagacaaacgtt

SEQ ID NO: 15985 - DNA, 20 bp, Artificial Sequence
  sgRNA
ggccaattccttcttagctg

SEQ ID NO: 15986 - DNA, 20 bp, Artificial Sequence
  sgRNA
aacccagatgaatggcctcc

SEQ ID NO: 15987 - DNA, 20 bp, Artificial Sequence
  sgRNA
gtgcttcagtaggtgtcgcc

SEQ ID NO: 15988 - DNA, 20 bp, Artificial Sequence
  sgRNA
cttctttcttgctgcgtcac

SEQ ID NO: 15989 - DNA, 20 bp, Artificial Sequence
  sgRNA
aggcctggtggatccctcac

SEQ ID NO: 15990 - DNA, 20 bp, Artificial Sequence
  sgRNA
ctctggactctgaagtctga

SEQ ID NO: 15991 - DNA, 20 bp, Artificial Sequence
  sgRNA
cggtgtcgtctgcgctttgc

SEQ ID NO: 15992 - DNA, 20 bp, Artificial Sequence
  sgRNA
gacacctgcgttgtcaatgg

SEQ ID NO: 15993 - DNA, 20 bp, Artificial Sequence
  sgRNA
aagtagtaatgatatgacgt

SEQ ID NO: 15994 - DNA, 20 bp, Artificial Sequence
  sgRNA
ctgtcacaagccggatgagg

SEQ ID NO: 15995 - DNA, 20 bp, Artificial Sequence
  sgRNA
cacctgcgcagtacgctgcg

SEQ ID NO: 15996 - DNA, 20 bp, Artificial Sequence
  sgRNA
tccgatttaaacgtgatagt

SEQ ID NO: 15997 - DNA, 20 bp, Artificial Sequence
  sgRNA
ggaaacacgagaggaccgcg

SEQ ID NO: 15998 - DNA, 20 bp, Artificial Sequence
  sgRNA
tttcaaagagtctacctgtg

SEQ ID NO: 15999 - DNA, 20 bp, Artificial Sequence
  sgRNA
gcaatttatactgttaatgc

SEQ ID NO: 16000 - DNA, 20 bp, Artificial Sequence
  sgRNA
tccattcagtcagtgtatgg

SEQ ID NO: 16001 - DNA, 20 bp, Artificial Sequence
  sgRNA
tcatttctatgctagggctt

SEQ ID NO: 16002 - DNA, 20 bp, Artificial Sequence
  sgRNA
acaggcagtggttgaaattc

SEQ ID NO: 16003 - DNA, 20 bp, Artificial Sequence
  sgRNA
cccagcaaagaagagcatgc

SEQ ID NO: 16004 - DNA, 20 bp, Artificial Sequence
  sgRNA
gaattacgaaggtctcggcg

SEQ ID NO: 16005 - DNA, 20 bp, Artificial Sequence
  sgRNA
cgagatctcatgtttcctaa

SEQ ID NO: 16006 - DNA, 20 bp, Artificial Sequence
  sgRNA
ggaggaagctctcgtccttt

SEQ ID NO: 16007 - DNA, 20 bp, Artificial Sequence
  sgRNA
agtaaacaggagaaatttca

SEQ ID NO: 16008 - DNA, 20 bp, Artificial Sequence
  sgRNA
gtggctcacactctagtaag

SEQ ID NO: 16009 - DNA, 20 bp, Artificial Sequence
  sgRNA
ggaacgatgattggaggagg

SEQ ID NO: 16010 - DNA, 20 bp, Artificial Sequence
  sgRNA
tgtgggtcaggaaactgtaa

SEQ ID NO: 16011 - DNA, 20 bp, Artificial Sequence
  sgRNA
tcctatttaagcggcgccgc

SEQ ID NO: 16012 - DNA, 20 bp, Artificial Sequence
  sgRNA
ctagtggtgctgaaagacgc

SEQ ID NO: 16013 - DNA, 20 bp, Artificial Sequence
  sgRNA
gccatgtgatgggctacgcc

SEQ ID NO: 16014 - DNA, 20 bp, Artificial Sequence
  sgRNA
tacacacgatgggctgtgtg

SEQ ID NO: 16015 - DNA, 20 bp, Artificial Sequence
  sgRNA
cagtcttaaagcagcagcag

SEQ ID NO: 16016 - DNA, 20 bp, Artificial Sequence
  sgRNA
agtgcggcggatcacgcagt

SEQ ID NO: 16017 - DNA, 20 bp, Artificial Sequence
  sgRNA
gtgaggatctttgctgcaga

SEQ ID NO: 16018 - DNA, 20 bp, Artificial Sequence
  sgRNA
ctcactgatataaacattac

SEQ ID NO: 16019 - DNA, 20 bp, Artificial Sequence
  sgRNA
tgaggtgtggctctaggcct

SEQ ID NO: 16020 - DNA, 20 bp, Artificial Sequence
  sgRNA
ctatatatggtcaaagctgg

SEQ ID NO: 16021 - DNA, 20 bp, Artificial Sequence
  sgRNA
gtccgcagcggtagcgcgcg

SEQ ID NO: 16022 - DNA, 20 bp, Artificial Sequence
  sgRNA
cgggtctcggagccgggtct

SEQ ID NO: 16023 - DNA, 20 bp, Artificial Sequence
  sgRNA
gcgtgcgccgaacgtgtctg

SEQ ID NO: 16024 - DNA, 20 bp, Artificial Sequence
  sgRNA
gacgcgtgtgtgtttctccc

SEQ ID NO: 16025 - DNA, 20 bp, Artificial Sequence
  sgRNA
cgtgctctctctgcgctccg

SEQ ID NO: 16026 - DNA, 20 bp, Artificial Sequence
  sgRNA
gccgctggtccctgaagtcc

SEQ ID NO: 16027 - DNA, 20 bp, Artificial Sequence
  sgRNA
cgtgcctgttgagagcggga

SEQ ID NO: 16028 - DNA, 20 bp, Artificial Sequence
  sgRNA
gcgccatgagctctaggctt

SEQ ID NO: 16029 - DNA, 20 bp, Artificial Sequence
  sgRNA
gagcgggcaggccttgcgcc

SEQ ID NO: 16030 - DNA, 20 bp, Artificial Sequence
  sgRNA
cggaggctgagcgatcgctg

SEQ ID NO: 16031 - DNA, 20 bp, Artificial Sequence
  sgRNA
gtctccctggtctctcggag

SEQ ID NO: 16032 - DNA, 20 bp, Artificial Sequence
  sgRNA
actaagaggagggagaaggg

SEQ ID NO: 16033 - DNA, 20 bp, Artificial Sequence
  sgRNA
ttacgaggcaaccaagagga

SEQ ID NO: 16034 - DNA, 20 bp, Artificial Sequence
  sgRNA
aaactggaggaagtaaaggg

SEQ ID NO: 16035 - DNA, 20 bp, Artificial Sequence
  sgRNA
gacaagctggcgggagccaa

SEQ ID NO: 16036 - DNA, 20 bp, Artificial Sequence
  sgRNA
cctgtcaattagcggaagca

SEQ ID NO: 16037 - DNA, 20 bp, Artificial Sequence
  sgRNA
agcacagctactcctaggag

SEQ ID NO: 16038 - DNA, 20 bp, Artificial Sequence
  sgRNA
aggcatgtctccaccaaata

SEQ ID NO: 16039 - DNA, 20 bp, Artificial Sequence
  sgRNA
cgcagctctcatgatggtcg

SEQ ID NO: 16040 - DNA, 20 bp, Artificial Sequence
  sgRNA
gcaggccatgtcaactcacc

SEQ ID NO: 16041 - DNA, 20 bp, Artificial Sequence
  sgRNA
gcggatgcccaatcacctgt

SEQ ID NO: 16042 - DNA, 20 bp, Artificial Sequence
  sgRNA
tttaagaggcggctggaggc

SEQ ID NO: 16043 - DNA, 20 bp, Artificial Sequence
  sgRNA
cagggtgtaaggccctctgg

SEQ ID NO: 16044 - DNA, 20 bp, Artificial Sequence
  sgRNA
cctttcgggcttcggtggag

SEQ ID NO: 16045 - DNA, 20 bp, Artificial Sequence
  sgRNA
cgcagtagtcccttcggctg

SEQ ID NO: 16046 - DNA, 20 bp, Artificial Sequence
  sgRNA
cttatttgacgctgcccact

SEQ ID NO: 16047 - DNA, 20 bp, Artificial Sequence
  sgRNA
ttcttcattgcccagtagag

SEQ ID NO: 16048 - DNA, 20 bp, Artificial Sequence
  sgRNA
aggatctgactctcatctgt

SEQ ID NO: 16049 - DNA, 20 bp, Artificial Sequence
  sgRNA
ggaggaatgtgcacgaggga

SEQ ID NO: 16050 - DNA, 20 bp, Artificial Sequence
  sgRNA
cacctcagttcctacagcaa

SEQ ID NO: 16051 - DNA, 20 bp, Artificial Sequence
  sgRNA
gaacagactaacaggccacc

SEQ ID NO: 16052 - DNA, 20 bp, Artificial Sequence
  sgRNA
ggcagtgatgcaagcgtttc

SEQ ID NO: 16053 - DNA, 20 bp, Artificial Sequence
  sgRNA
actttgggagtcattcattg

SEQ ID NO: 16054 - DNA, 20 bp, Artificial Sequence
  sgRNA
gcgcgtgctgcgctgagaac

SEQ ID NO: 16055 - DNA, 20 bp, Artificial Sequence
  sgRNA
ctgcagagcttgtgtggtca

SEQ ID NO: 16056 - DNA, 20 bp, Artificial Sequence
  sgRNA
ggtattggctgcagctaaac

SEQ ID NO: 16057 - DNA, 20 bp, Artificial Sequence
  sgRNA
ggagtgggcgggaaggtggc

SEQ ID NO: 16058 - DNA, 20 bp, Artificial Sequence
  sgRNA
atgagggcctcggtgtttca

SEQ ID NO: 16059 - DNA, 20 bp, Artificial Sequence
  sgRNA
ttgagtaggtgtagccttgt

SEQ ID NO: 16060 - DNA, 20 bp, Artificial Sequence
  sgRNA
ccctctataccaggttgtga

SEQ ID NO: 16061 - DNA, 20 bp, Artificial Sequence
  sgRNA
aggtatgtcagtgtggatgt

SEQ ID NO: 16062 - DNA, 20 bp, Artificial Sequence
  sgRNA
actagcctgaaatgactgag

SEQ ID NO: 16063 - DNA, 20 bp, Artificial Sequence
  sgRNA
ttcctcagaggctgccagtg

SEQ ID NO: 16064 - DNA, 20 bp, Artificial Sequence
  sgRNA
cccagtgacttcacgtgggt

SEQ ID NO: 16065 - DNA, 20 bp, Artificial Sequence
  sgRNA
catgcgcaccgcggtccgcc

SEQ ID NO: 16066 - DNA, 20 bp, Artificial Sequence
  sgRNA
gggcagctaaggtgacatta

SEQ ID NO: 16067 - DNA, 20 bp, Artificial Sequence
  sgRNA
gactaagcaggagaggttga

SEQ ID NO: 16068 - DNA, 20 bp, Artificial Sequence
  sgRNA
cggctgctccctgctgactg

SEQ ID NO: 16069 - DNA, 20 bp, Artificial Sequence
  sgRNA
gccgggaagtgggtcaactg

SEQ ID NO: 16070 - DNA, 20 bp, Artificial Sequence
  sgRNA
cgcaggcctacaggcaagcg

SEQ ID NO: 16071 - DNA, 20 bp, Artificial Sequence
  sgRNA
cagagcgagggaagaggagc

SEQ ID NO: 16072 - DNA, 20 bp, Artificial Sequence
  sgRNA
ggcgggtagaagcaaagccc

SEQ ID NO: 16073 - DNA, 20 bp, Artificial Sequence
  sgRNA
gagccacctgctgttctacc

SEQ ID NO: 16074 - DNA, 20 bp, Artificial Sequence
  sgRNA
tctctggcctttacagcagc

SEQ ID NO: 16075 - DNA, 20 bp, Artificial Sequence
  sgRNA
atgctgcagtaataatcgca

SEQ ID NO: 16076 - DNA, 20 bp, Artificial Sequence
  sgRNA
ggagcttgggcgaagctttg

SEQ ID NO: 16077 - DNA, 20 bp, Artificial Sequence
  sgRNA
taagtggctacatgggatag

SEQ ID NO: 16078 - DNA, 20 bp, Artificial Sequence
  sgRNA
tacaatcaactgacggctac

SEQ ID NO: 16079 - DNA, 20 bp, Artificial Sequence
  sgRNA
tagagaaatgtttcccacag

SEQ ID NO: 16080 - DNA, 20 bp, Artificial Sequence
  sgRNA
agaagacgctcttgcctcat

SEQ ID NO: 16081 - DNA, 20 bp, Artificial Sequence
  sgRNA
gggcggaacagactaaagac

SEQ ID NO: 16082 - DNA, 20 bp, Artificial Sequence
  sgRNA
gggcagtcgtcaaccttgtg

SEQ ID NO: 16083 - DNA, 20 bp, Artificial Sequence
  sgRNA
tcagtgcaatctgtcactgt

SEQ ID NO: 16084 - DNA, 20 bp, Artificial Sequence
  sgRNA
tgccaaactcctcaggtctg

SEQ ID NO: 16085 - DNA, 20 bp, Artificial Sequence
  sgRNA
tggaccgagcagttagaatg

SEQ ID NO: 16086 - DNA, 20 bp, Artificial Sequence
  sgRNA
tcacccatctgagtccttca

SEQ ID NO: 16087 - DNA, 20 bp, Artificial Sequence
  sgRNA
ggatccctggctgggcggac

SEQ ID NO: 16088 - DNA, 20 bp, Artificial Sequence
  sgRNA
aaagaagcaccgcccgctac

SEQ ID NO: 16089 - DNA, 20 bp, Artificial Sequence
  sgRNA
aggaaatgtttgcgcttcaa

SEQ ID NO: 16090 - DNA, 20 bp, Artificial Sequence
  sgRNA
gccacggacagctgacgacc

SEQ ID NO: 16091 - DNA, 20 bp, Artificial Sequence
  sgRNA
cccactccctctttgatcga

SEQ ID NO: 16092 - DNA, 20 bp, Artificial Sequence
  sgRNA
acagggagagagcccagcat

SEQ ID NO: 16093 - DNA, 20 bp, Artificial Sequence
  sgRNA
gtctagccaacccaactctg

SEQ ID NO: 16094 - DNA, 20 bp, Artificial Sequence
  sgRNA
tgagcatcccgagccgagcc

SEQ ID NO: 16095 - DNA, 20 bp, Artificial Sequence
  sgRNA
tgagagcctgcccaccgctc

SEQ ID NO: 16096 - DNA, 20 bp, Artificial Sequence
  sgRNA
aggcccaattcctctacctt

SEQ ID NO: 16097 - DNA, 20 bp, Artificial Sequence
  sgRNA
taactgtccaattaggaacg

SEQ ID NO: 16098 - DNA, 20 bp, Artificial Sequence
  sgRNA
cggattcctgagcccgcgcc

SEQ ID NO: 16099 - DNA, 20 bp, Artificial Sequence
  sgRNA
aactctggctgggcgtccgc

SEQ ID NO: 16100 - DNA, 20 bp, Artificial Sequence
  sgRNA
cggcgcctccgcccgccctt

SEQ ID NO: 16101 - DNA, 20 bp, Artificial Sequence
  sgRNA
acatgatgacaaaccctgcc

SEQ ID NO: 16102 - DNA, 20 bp, Artificial Sequence
  sgRNA
gagagtcacgtgatgcgacc

SEQ ID NO: 16103 - DNA, 20 bp, Artificial Sequence
  sgRNA
acgtggccgcggtgctcacg

SEQ ID NO: 16104 - DNA, 20 bp, Artificial Sequence
  sgRNA
ccagtcccatttatgaagcg

SEQ ID NO: 16105 - DNA, 20 bp, Artificial Sequence
  sgRNA
gggtaccgcgcagcaaagtt

SEQ ID NO: 16106 - DNA, 20 bp, Artificial Sequence
  sgRNA
aaggctcattaacacgtgat

SEQ ID NO: 16107 - DNA, 20 bp, Artificial Sequence
  sgRNA
tgcagttgattactgagctg

SEQ ID NO: 16108 - DNA, 20 bp, Artificial Sequence
  sgRNA
acgggccgcaggcgcgtgca

SEQ ID NO: 16109 - DNA, 20 bp, Artificial Sequence
  sgRNA
tgtagtccgagggtgtaaag

SEQ ID NO: 16110 - DNA, 20 bp, Artificial Sequence
  sgRNA
ctctatacccaggattcttc

SEQ ID NO: 16111 - DNA, 20 bp, Artificial Sequence
  sgRNA
gagagagagagagaacagtc

SEQ ID NO: 16112 - DNA, 20 bp, Artificial Sequence
  sgRNA
tctcttgggaagttaactaa

SEQ ID NO: 16113 - DNA, 20 bp, Artificial Sequence
  sgRNA
gcccgcactgcataaagaac

SEQ ID NO: 16114 - DNA, 20 bp, Artificial Sequence
  sgRNA
agtggtattgtttaccacaa

SEQ ID NO: 16115 - DNA, 20 bp, Artificial Sequence
  sgRNA
gatgacgtcaccgccgactg

SEQ ID NO: 16116 - DNA, 20 bp, Artificial Sequence
  sgRNA
aagtggaatcccaaagagca

SEQ ID NO: 16117 - DNA, 20 bp, Artificial Sequence
  sgRNA
ttactgtgagggattaccaa

SEQ ID NO: 16118 - DNA, 20 bp, Artificial Sequence
  sgRNA
gttcgattcgagacggcctc

SEQ ID NO: 16119 - DNA, 20 bp, Artificial Sequence
  sgRNA
gcattgtacttgcaaggtgg

SEQ ID NO: 16120 - DNA, 20 bp, Artificial Sequence
  sgRNA
taggagtccgtggcgagagg

SEQ ID NO: 16121 - DNA, 20 bp, Artificial Sequence
  sgRNA
gttgctgcaggacgcagtcg

SEQ ID NO: 16122 - DNA, 20 bp, Artificial Sequence
  sgRNA
gaagcctgagagcgaggctg

SEQ ID NO: 16123 - DNA, 20 bp, Artificial Sequence
  sgRNA
ggatgtacgtgcaaagatat

SEQ ID NO: 16124 - DNA, 20 bp, Artificial Sequence
  sgRNA
accatgcctcagtgacaccg

SEQ ID NO: 16125 - DNA, 20 bp, Artificial Sequence
  sgRNA
ccaaatcattgattgttcca

SEQ ID NO: 16126 - DNA, 20 bp, Artificial Sequence
  sgRNA
gtgactcacaggatcctagc

SEQ ID NO: 16127 - DNA, 20 bp, Artificial Sequence
  sgRNA
ggtgcccacgtgactgacga

SEQ ID NO: 16128 - DNA, 20 bp, Artificial Sequence
  sgRNA
agtgaagacactaattgcta

SEQ ID NO: 16129 - DNA, 20 bp, Artificial Sequence
  sgRNA
gaggactaggcgtgcatctc

SEQ ID NO: 16130 - DNA, 20 bp, Artificial Sequence
  sgRNA
aggtagacagggaacttact

SEQ ID NO: 16131 - DNA, 20 bp, Artificial Sequence
  sgRNA
aggtgtgagttgccttgttt

SEQ ID NO: 16132 - DNA, 20 bp, Artificial Sequence
  sgRNA
gagacagagcagttatgctg

SEQ ID NO: 16133 - DNA, 20 bp, Artificial Sequence
  sgRNA
aaacagcccgagcgtggcag

SEQ ID NO: 16134 - DNA, 20 bp, Artificial Sequence
  sgRNA
gaatgagaaagatctggttg

SEQ ID NO: 16135 - DNA, 20 bp, Artificial Sequence
  sgRNA
aggctaggccgtggtttcct

SEQ ID NO: 16136 - DNA, 20 bp, Artificial Sequence
  sgRNA
cagacgtacgtaagatgtgc

SEQ ID NO: 16137 - DNA, 20 bp, Artificial Sequence
  sgRNA
agaatgcatgagcgtgagag

SEQ ID NO: 16138 - DNA, 20 bp, Artificial Sequence
  sgRNA
aaagggcaggtaggcggagc

SEQ ID NO: 16139 - DNA, 20 bp, Artificial Sequence
  sgRNA
gcctgagtgttacttgccag

SEQ ID NO: 16140 - DNA, 20 bp, Artificial Sequence
  sgRNA
gggtcatacccaagttagat

SEQ ID NO: 16141 - DNA, 20 bp, Artificial Sequence
  sgRNA
aagtgactgactgggtagtc

SEQ ID NO: 16142 - DNA, 20 bp, Artificial Sequence
  sgRNA
cgcgcgttcagagcgccaag

SEQ ID NO: 16143 - DNA, 20 bp, Artificial Sequence
  sgRNA
actgcttcggttacagtgat

SEQ ID NO: 16144 - DNA, 20 bp, Artificial Sequence
  sgRNA
ctgttctctgcagtgtagta

SEQ ID NO: 16145 - DNA, 20 bp, Artificial Sequence
  sgRNA
gagacagcgtgctgtgggcg

SEQ ID NO: 16146 - DNA, 20 bp, Artificial Sequence
  sgRNA
gaatatgggcgggaacatcg

SEQ ID NO: 16147 - DNA, 20 bp, Artificial Sequence
  sgRNA
gacacactgagcagaggcta

SEQ ID NO: 16148 - DNA, 20 bp, Artificial Sequence
  sgRNA
ccctcagctcgaggttggca

SEQ ID NO: 16149 - DNA, 20 bp, Artificial Sequence
  sgRNA
gaaacaggacctgacctgcg

SEQ ID NO: 16150 - DNA, 20 bp, Artificial Sequence
  sgRNA
acatcaccggtgcctcagcg

SEQ ID NO: 16151 - DNA, 20 bp, Artificial Sequence
  sgRNA
agaacctggccgagaatgtg

SEQ ID NO: 16152 - DNA, 20 bp, Artificial Sequence
  sgRNA
gcttctcaagcatgcaggag

SEQ ID NO: 16153 - DNA, 20 bp, Artificial Sequence
  sgRNA
gcgccaggccaatcagaagt

SEQ ID NO: 16154 - DNA, 20 bp, Artificial Sequence
  sgRNA
gcgcagctgcttgaggaggg

SEQ ID NO: 16155 - DNA, 20 bp, Artificial Sequence
  sgRNA
tgagcgggaggcggagccgg

SEQ ID NO: 16156 - DNA, 20 bp, Artificial Sequence
  sgRNA
ggaagtaagcggccgtggcg

SEQ ID NO: 16157 - DNA, 20 bp, Artificial Sequence
  sgRNA
tggtgggagttgcaagccgc

SEQ ID NO: 16158 - DNA, 20 bp, Artificial Sequence
  sgRNA
ccgactaagtagcagctcaa

SEQ ID NO: 16159 - DNA, 20 bp, Artificial Sequence
  sgRNA
ctgagctagggcttccaccc

SEQ ID NO: 16160 - DNA, 20 bp, Artificial Sequence
  sgRNA
acgcggccgcggccacaacc

SEQ ID NO: 16161 - DNA, 20 bp, Artificial Sequence
  sgRNA
tgagcgcagtgtcccggaga

SEQ ID NO: 16162 - DNA, 20 bp, Artificial Sequence
  sgRNA
ccgcgagccagccagacgca

SEQ ID NO: 16163 - DNA, 20 bp, Artificial Sequence
  sgRNA
gagcgagcgcagcgcagcag

SEQ ID NO: 16164 - DNA, 20 bp, Artificial Sequence
  sgRNA
tctccgcggacgagacagcg

SEQ ID NO: 16165 - DNA, 20 bp, Artificial Sequence
  sgRNA
gagaagacgaagacagggcc

SEQ ID NO: 16166 - DNA, 20 bp, Artificial Sequence
  sgRNA
gcaaggctgagcgcggccga

SEQ ID NO: 16167 - DNA, 20 bp, Artificial Sequence
  sgRNA
ctgtagctgccaggcatggg

SEQ ID NO: 16168 - DNA, 20 bp, Artificial Sequence
  sgRNA
agcgacaggaggccactgcg

SEQ ID NO: 16169 - DNA, 20 bp, Artificial Sequence
  sgRNA
gagcttagtggcacttaaca

SEQ ID NO: 16170 - DNA, 20 bp, Artificial Sequence
  sgRNA
agacagcacatgcccaactg

SEQ ID NO: 16171 - DNA, 20 bp, Artificial Sequence
  sgRNA
ctttaaacagaatgttacct

SEQ ID NO: 16172 - DNA, 20 bp, Artificial Sequence
  sgRNA
accggcctctacacagtcac

SEQ ID NO: 16173 - DNA, 20 bp, Artificial Sequence
  sgRNA
taagtagaccaatgagaacg

SEQ ID NO: 16174 - DNA, 20 bp, Artificial Sequence
  sgRNA
cagacgctaatacggtgggc

SEQ ID NO: 16175 - DNA, 20 bp, Artificial Sequence
  sgRNA
cggacgcgtatttgtacgtt

SEQ ID NO: 16176 - DNA, 20 bp, Artificial Sequence
  sgRNA
ggagggaggctctctggatg

SEQ ID NO: 16177 - DNA, 20 bp, Artificial Sequence
  sgRNA
gggaggagggaaacgacaga

SEQ ID NO: 16178 - DNA, 20 bp, Artificial Sequence
  sgRNA
cccgctcagccggaaccacc

SEQ ID NO: 16179 - DNA, 20 bp, Artificial Sequence
  sgRNA
aggacgccaaatggttacta

SEQ ID NO: 16180 - DNA, 20 bp, Artificial Sequence
  sgRNA
agcactaccggacagctcag

SEQ ID NO: 16181 - DNA, 20 bp, Artificial Sequence
  sgRNA
tagggagttccagtgcctcc

SEQ ID NO: 16182 - DNA, 20 bp, Artificial Sequence
  sgRNA
gttgggagactagagcgtcc

SEQ ID NO: 16183 - DNA, 20 bp, Artificial Sequence
  sgRNA
acgagcgtagtaaccgtgca

SEQ ID NO: 16184 - DNA, 20 bp, Artificial Sequence
  sgRNA
ggccaggttcagatgaaaca

SEQ ID NO: 16185 - DNA, 20 bp, Artificial Sequence
  sgRNA
cgaggtccctatcacgcgcg

SEQ ID NO: 16186 - DNA, 20 bp, Artificial Sequence
  sgRNA
aacgagggtgtggcgaggcg

SEQ ID NO: 16187 - DNA, 20 bp, Artificial Sequence
  sgRNA
atcaaattgtagcctcgccc

SEQ ID NO: 16188 - DNA, 20 bp, Artificial Sequence
  sgRNA
ctctaaagggttaaggccta

SEQ ID NO: 16189 - DNA, 20 bp, Artificial Sequence
  sgRNA
gtattcatactcccgccggc

SEQ ID NO: 16190 - DNA, 20 bp, Artificial Sequence
  sgRNA
gcataaactgttccctctta

SEQ ID NO: 16191 - DNA, 20 bp, Artificial Sequence
  sgRNA
gtgagaaatcagcgctcgga

SEQ ID NO: 16192 - DNA, 20 bp, Artificial Sequence
  sgRNA
agggcggtgcaaacactagt

SEQ ID NO: 16193 - DNA, 20 bp, Artificial Sequence
  sgRNA
ttctactggcttgtagagtt

SEQ ID NO: 16194 - DNA, 20 bp, Artificial Sequence
  sgRNA
ttggtggaaggagtggagac

SEQ ID NO: 16195 - DNA, 20 bp, Artificial Sequence
  sgRNA
gtgactcagctagtcactca

SEQ ID NO: 16196 - DNA, 20 bp, Artificial Sequence
  sgRNA
ggagggtgtgtctcctggag

SEQ ID NO: 16197 - DNA, 20 bp, Artificial Sequence
  sgRNA
ttgcaggctctgggtcctgc

SEQ ID NO: 16198 - DNA, 20 bp, Artificial Sequence
  sgRNA
ccgacctgagtggcctaaga

SEQ ID NO: 16199 - DNA, 20 bp, Artificial Sequence
  sgRNA
taatcacccagtaattgctt

SEQ ID NO: 16200 - DNA, 20 bp, Artificial Sequence
  sgRNA
acactcctaggcagtgaagt

SEQ ID NO: 16201 - DNA, 20 bp, Artificial Sequence
  sgRNA
agctcttactatcttacttc

SEQ ID NO: 16202 - DNA, 20 bp, Artificial Sequence
  sgRNA
gtggccacgcctctcctcag

SEQ ID NO: 16203 - DNA, 20 bp, Artificial Sequence
  sgRNA
tgtatggttgccttatctcg

SEQ ID NO: 16204 - DNA, 20 bp, Artificial Sequence
  sgRNA
gcacgccgctgctgctcagc

SEQ ID NO: 16205 - DNA, 20 bp, Artificial Sequence
  sgRNA
aaatagggcagccgcggcag

SEQ ID NO: 16206 - DNA, 20 bp, Artificial Sequence
  sgRNA
gctgctctacacctgccgcg

SEQ ID NO: 16207 - DNA, 20 bp, Artificial Sequence
  sgRNA
tggcggcgattgggcaggcg

SEQ ID NO: 16208 - DNA, 20 bp, Artificial Sequence
  sgRNA
cgttggacagtaggtgggag

SEQ ID NO: 16209 - DNA, 20 bp, Artificial Sequence
  sgRNA
tcagaagagaatacaagtcg

SEQ ID NO: 16210 - DNA, 20 bp, Artificial Sequence
  sgRNA
tttgtcgtggcaggatcatg

SEQ ID NO: 16211 - DNA, 20 bp, Artificial Sequence
  sgRNA
gggcgttggcgaggagactg

SEQ ID NO: 16212 - DNA, 20 bp, Artificial Sequence
  sgRNA
ctcggactgtgatggctgag

SEQ ID NO: 16213 - DNA, 20 bp, Artificial Sequence
  sgRNA
gcgggcagctagcgttccca

SEQ ID NO: 16214 - DNA, 20 bp, Artificial Sequence
  sgRNA
aagctcttgctccctagttc

SEQ ID NO: 16215 - DNA, 20 bp, Artificial Sequence
  sgRNA
agctctgagttctcttcatg

SEQ ID NO: 16216 - DNA, 20 bp, Artificial Sequence
  sgRNA
ttggttaaattggcctctcc

SEQ ID NO: 16217 - DNA, 20 bp, Artificial Sequence
  sgRNA
tagaatgtggtacaggcgac

SEQ ID NO: 16218 - DNA, 20 bp, Artificial Sequence
  sgRNA
cttgagtgggttgggagtgg

SEQ ID NO: 16219 - DNA, 20 bp, Artificial Sequence
  sgRNA
ctggctacgccgaggaggcg

SEQ ID NO: 16220 - DNA, 20 bp, Artificial Sequence
  sgRNA
ctccgtgggcgggcacctga

SEQ ID NO: 16221 - DNA, 20 bp, Artificial Sequence
  sgRNA
gtcgcctggacacggctctg

SEQ ID NO: 16222 - DNA, 20 bp, Artificial Sequence
  sgRNA
ctcgggtccttgccctattc

SEQ ID NO: 16223 - DNA, 20 bp, Artificial Sequence
  sgRNA
gtaactcgggcgggtctgcc

SEQ ID NO: 16224 - DNA, 20 bp, Artificial Sequence
  sgRNA
gactaacactgaagccaccc

SEQ ID NO: 16225 - DNA, 20 bp, Artificial Sequence
  sgRNA
actctggtgcacgtttagcc

SEQ ID NO: 16226 - DNA, 20 bp, Artificial Sequence
  sgRNA
ccacttagagacccaaagaa

SEQ ID NO: 16227 - DNA, 20 bp, Artificial Sequence
  sgRNA
tctgagacacatgcagtaag

SEQ ID NO: 16228 - DNA, 20 bp, Artificial Sequence
  sgRNA
acttggcgtcacagcgcaaa

SEQ ID NO: 16229 - DNA, 20 bp, Artificial Sequence
  sgRNA
tagcttcagcgcctgtattt

SEQ ID NO: 16230 - DNA, 20 bp, Artificial Sequence
  sgRNA
caatgaagcagagaggtcct

SEQ ID NO: 16231 - DNA, 20 bp, Artificial Sequence
  sgRNA
tttgctttgatgaagaggag

SEQ ID NO: 16232 - DNA, 20 bp, Artificial Sequence
  sgRNA
tgaggttgagtatcactcgg

SEQ ID NO: 16233 - DNA, 20 bp, Artificial Sequence
  sgRNA
ctgaaacaacatatagtatc

SEQ ID NO: 16234 - DNA, 20 bp, Artificial Sequence
  sgRNA
cagcatgctctgctcctgga

SEQ ID NO: 16235 - DNA, 20 bp, Artificial Sequence
  sgRNA
aagcttcctttataaggata

SEQ ID NO: 16236 - DNA, 20 bp, Artificial Sequence
  sgRNA
cactgggtcctccctatccc

SEQ ID NO: 16237 - DNA, 20 bp, Artificial Sequence
  sgRNA
gctcctattggctgtgtaac

SEQ ID NO: 16238 - DNA, 20 bp, Artificial Sequence
  sgRNA
atcttctcgcgagacttaaa

SEQ ID NO: 16239 - DNA, 20 bp, Artificial Sequence
  sgRNA
agtagtgtcccagggtttag

SEQ ID NO: 16240 - DNA, 20 bp, Artificial Sequence
  sgRNA
ggcttctttcggaacttaga

SEQ ID NO: 16241 - DNA, 20 bp, Artificial Sequence
  sgRNA
ccaggtgagtactattgcct

SEQ ID NO: 16242 - DNA, 20 bp, Artificial Sequence
  sgRNA
gcttcctcctgcatcacagc

SEQ ID NO: 16243 - DNA, 20 bp, Artificial Sequence
  sgRNA
ggactttaggcgctcgaggc

SEQ ID NO: 16244 - DNA, 20 bp, Artificial Sequence
  sgRNA
cctcaggtaacccgggaaac

SEQ ID NO: 16245 - DNA, 20 bp, Artificial Sequence
  sgRNA
agattctccacgcatcacgt

SEQ ID NO: 16246 - DNA, 20 bp, Artificial Sequence
  sgRNA
ggagcgcagcccgggcacag

SEQ ID NO: 16247 - DNA, 20 bp, Artificial Sequence
  sgRNA
ccaatcaaggcacgatgatg

SEQ ID NO: 16248 - DNA, 20 bp, Artificial Sequence
  sgRNA
tcatcgattggtgctatctg

SEQ ID NO: 16249 - DNA, 20 bp, Artificial Sequence
  sgRNA
tctaggcgatcaagcccaga

SEQ ID NO: 16250 - DNA, 20 bp, Artificial Sequence
  sgRNA
agacctgctcctctgtacag

SEQ ID NO: 16251 - DNA, 20 bp, Artificial Sequence
  sgRNA
agagaagctgatgccgaccg

SEQ ID NO: 16252 - DNA, 20 bp, Artificial Sequence
  sgRNA
gctgttgagagtcacatgaa

SEQ ID NO: 16253 - DNA, 20 bp, Artificial Sequence
  sgRNA
gtagcaaccataggttctaa

SEQ ID NO: 16254 - DNA, 20 bp, Artificial Sequence
  sgRNA
cattctacaactgaagacag

SEQ ID NO: 16255 - DNA, 20 bp, Artificial Sequence
  sgRNA
gtactatgtctcaagaagaa

SEQ ID NO: 16256 - DNA, 20 bp, Artificial Sequence
  sgRNA
aatcacctgttagctgattg

SEQ ID NO: 16257 - DNA, 20 bp, Artificial Sequence
  sgRNA
atgtacagaaatcacatagc

SEQ ID NO: 16258 - DNA, 20 bp, Artificial Sequence
  sgRNA
ctacatttcccagaacgaga

SEQ ID NO: 16259 - DNA, 20 bp, Artificial Sequence
  sgRNA
gaagcaaacttagctgctaa

SEQ ID NO: 16260 - DNA, 20 bp, Artificial Sequence
  sgRNA
tcggcggaagttcatcggtc

SEQ ID NO: 16261 - DNA, 20 bp, Artificial Sequence
  sgRNA
tcaacatacaaacaagcacc

SEQ ID NO: 16262 - DNA, 20 bp, Artificial Sequence
  sgRNA
aaggaggaagtatggtaggt

SEQ ID NO: 16263 - DNA, 20 bp, Artificial Sequence
  sgRNA
tagggattctaggataagca

SEQ ID NO: 16264 - DNA, 20 bp, Artificial Sequence
  sgRNA
ggtacccgggtgtccaagtc

SEQ ID NO: 16265 - DNA, 20 bp, Artificial Sequence
  sgRNA
ctcgcgggcgcccatcaaac

SEQ ID NO: 16266 - DNA, 20 bp, Artificial Sequence
  sgRNA
atgagtaccgatcgcaaagc

SEQ ID NO: 16267 - DNA, 20 bp, Artificial Sequence
  sgRNA
ttaacggttaaatgttagtg

SEQ ID NO: 16268 - DNA, 20 bp, Artificial Sequence
  sgRNA
cacatccatcgttctttcta

SEQ ID NO: 16269 - DNA, 20 bp, Artificial Sequence
  sgRNA
cggccagaatatttgcatat

SEQ ID NO: 16270 - DNA, 20 bp, Artificial Sequence
  sgRNA
tgacaggtatgggtcagacc

SEQ ID NO: 16271 - DNA, 20 bp, Artificial Sequence
  sgRNA
aatactagataaagtcactg

SEQ ID NO: 16272 - DNA, 20 bp, Artificial Sequence
  sgRNA
tagaaagacttgctccaccc

SEQ ID NO: 16273 - DNA, 20 bp, Artificial Sequence
  sgRNA
acaaacacttgtaggaaatc

SEQ ID NO: 16274 - DNA, 20 bp, Artificial Sequence
  sgRNA
acaaccgtgcttgtacgagc

SEQ ID NO: 16275 - DNA, 20 bp, Artificial Sequence
  sgRNA
ccaagagcttaaccctttgc

SEQ ID NO: 16276 - DNA, 20 bp, Artificial Sequence
  sgRNA
gctgcctcgggcgaagctgg

SEQ ID NO: 16277 - DNA, 20 bp, Artificial Sequence
  sgRNA
agctaggctcggctctccct

SEQ ID NO: 16278 - DNA, 20 bp, Artificial Sequence
  sgRNA
gaactgagtggctgcactgt

SEQ ID NO: 16279 - DNA, 20 bp, Artificial Sequence
  sgRNA
aaagctgactctgacagcaa

SEQ ID NO: 16280 - DNA, 20 bp, Artificial Sequence
  sgRNA
atactccagctcataacatt

SEQ ID NO: 16281 - DNA, 20 bp, Artificial Sequence
  sgRNA
cagtatatgccagaatacat

SEQ ID NO: 16282 - DNA, 20 bp, Artificial Sequence
  sgRNA
cccggagcactctcggtctg

SEQ ID NO: 16283 - DNA, 20 bp, Artificial Sequence
  sgRNA
gtcgctgtgctccttgtgat

SEQ ID NO: 16284 - DNA, 20 bp, Artificial Sequence
  sgRNA
gggcaaagctagctccggat

SEQ ID NO: 16285 - DNA, 20 bp, Artificial Sequence
  sgRNA
tgtaggcggcgggatctaga

SEQ ID NO: 16286 - DNA, 20 bp, Artificial Sequence
  sgRNA
aacatggagagagtgttaga

SEQ ID NO: 16287 - DNA, 20 bp, Artificial Sequence
  sgRNA
gaaaggaaactgtgtttaaa

SEQ ID NO: 16288 - DNA, 20 bp, Artificial Sequence
  sgRNA
aacaatcacagatgaagtca

SEQ ID NO: 16289 - DNA, 20 bp, Artificial Sequence
  sgRNA
ggcatccgggaaagaggtag

SEQ ID NO: 16290 - DNA, 20 bp, Artificial Sequence
  sgRNA
ccatttacccaccagttcta

SEQ ID NO: 16291 - DNA, 20 bp, Artificial Sequence
  sgRNA
cgcctcttccaagtttctat

SEQ ID NO: 16292 - DNA, 20 bp, Artificial Sequence
  sgRNA
gattaattcagaagaaagtg

SEQ ID NO: 16293 - DNA, 20 bp, Artificial Sequence
  sgRNA
ctctgtgtttacttccagga

SEQ ID NO: 16294 - DNA, 20 bp, Artificial Sequence
  sgRNA
atcatatcacatgtccgtcc

SEQ ID NO: 16295 - DNA, 20 bp, Artificial Sequence
  sgRNA
gacaagttgtgccctgtgtt

SEQ ID NO: 16296 - DNA, 20 bp, Artificial Sequence
  sgRNA
ggcttgtacagagaagagtt

SEQ ID NO: 16297 - DNA, 20 bp, Artificial Sequence
  sgRNA
tcgtcagacaagaagattcc

SEQ ID NO: 16298 - DNA, 20 bp, Artificial Sequence
  sgRNA
tgggcttcataggacagaag

SEQ ID NO: 16299 - DNA, 20 bp, Artificial Sequence
  sgRNA
atacacagtacccattaccc

SEQ ID NO: 16300 - DNA, 20 bp, Artificial Sequence
  sgRNA
gtttcacagctgaatgatgc

SEQ ID NO: 16301 - DNA, 20 bp, Artificial Sequence
  sgRNA
aagagtttctcagtaagtct

SEQ ID NO: 16302 - DNA, 20 bp, Artificial Sequence
  sgRNA
tttgtcatatatctgacgct

SEQ ID NO: 16303 - DNA, 20 bp, Artificial Sequence
  sgRNA
tgaagagttggagcacagaa

SEQ ID NO: 16304 - DNA, 20 bp, Artificial Sequence
  sgRNA
ggcgcaggtgtattgcacca

SEQ ID NO: 16305 - DNA, 20 bp, Artificial Sequence
  sgRNA
tcccggagtctggctgcgtt

SEQ ID NO: 16306 - DNA, 20 bp, Artificial Sequence
  sgRNA
gggtggcagagaaggcagta

SEQ ID NO: 16307 - DNA, 20 bp, Artificial Sequence
  sgRNA
gtggccacgcctctcctcag

SEQ ID NO: 16308 - DNA, 20 bp, Artificial Sequence
  sgRNA
tgtatggttgccttatctcg

SEQ ID NO: 16309 - DNA, 20 bp, Artificial Sequence
  sgRNA
gcacgccgctgctgctcagc

SEQ ID NO: 16310 - DNA, 20 bp, Artificial Sequence
  sgRNA
cctgagttcccgtgattcac

SEQ ID NO: 16311 - DNA, 20 bp, Artificial Sequence
  sgRNA
ttccgctgggaccgagggaa

SEQ ID NO: 16312 - DNA, 20 bp, Artificial Sequence
  sgRNA
ccagaaagtttcccagcgcc

SEQ ID NO: 16313 - DNA, 20 bp, Artificial Sequence
  sgRNA
caagcaagtcatgatgaaac

SEQ ID NO: 16314 - DNA, 20 bp, Artificial Sequence
  sgRNA
cggtgatgatatctgagaca

SEQ ID NO: 16315 - DNA, 20 bp, Artificial Sequence
  sgRNA
gggtggaaccatagaggaag

SEQ ID NO: 16316 - DNA, 20 bp, Artificial Sequence
  sgRNA
aggcgggcatagggtgggtg

SEQ ID NO: 16317 - DNA, 20 bp, Artificial Sequence
  sgRNA
tggtggtgatggagaaactc

SEQ ID NO: 16318 - DNA, 20 bp, Artificial Sequence
  sgRNA
gagctgatgtggagatggtg

SEQ ID NO: 16319 - DNA, 20 bp, Artificial Sequence
  sgRNA
tccagagaagtcagggaggt

SEQ ID NO: 16320 - DNA, 20 bp, Artificial Sequence
  sgRNA
ggtgtggaggaggccattcc

SEQ ID NO: 16321 - DNA, 20 bp, Artificial Sequence
  sgRNA
ggtaccaagaagctgacttt

SEQ ID NO: 16322 - DNA, 20 bp, Artificial Sequence
  sgRNA
ggttctaaggaacaagctga

SEQ ID NO: 16323 - DNA, 20 bp, Artificial Sequence
  sgRNA
ggcttgggaatcgatttccc

SEQ ID NO: 16324 - DNA, 20 bp, Artificial Sequence
  sgRNA
gagggcaactatatgtaata

SEQ ID NO: 16325 - DNA, 20 bp, Artificial Sequence
  sgRNA
acatgctgatactgagctga

SEQ ID NO: 16326 - DNA, 20 bp, Artificial Sequence
  sgRNA
tataggtactataatgagca

SEQ ID NO: 16327 - DNA, 20 bp, Artificial Sequence
  sgRNA
ataaatcaatatgacggaag

SEQ ID NO: 16328 - DNA, 20 bp, Artificial Sequence
  sgRNA
taggtgtgtttgactgattg

SEQ ID NO: 16329 - DNA, 20 bp, Artificial Sequence
  sgRNA
ttaacagtttgactaatccg

SEQ ID NO: 16330 - DNA, 20 bp, Artificial Sequence
  sgRNA
gtgcctgagtatatgcactc

SEQ ID NO: 16331 - DNA, 20 bp, Artificial Sequence
  sgRNA
ggagtccaagaaggtcaaag

SEQ ID NO: 16332 - DNA, 20 bp, Artificial Sequence
  sgRNA
tttctggtgtctgttcagtt

SEQ ID NO: 16333 - DNA, 20 bp, Artificial Sequence
  sgRNA
attacaagccacttaggaaa

SEQ ID NO: 16334 - DNA, 20 bp, Artificial Sequence
  sgRNA
ggctttgtcctcaggaggca

SEQ ID NO: 16335 - DNA, 20 bp, Artificial Sequence
  sgRNA
gggcggatcttctgcaacat

SEQ ID NO: 16336 - DNA, 20 bp, Artificial Sequence
  sgRNA
gctgacaaatgttcctccag

SEQ ID NO: 16337 - DNA, 20 bp, Artificial Sequence
  sgRNA
attctcgaggatccggaagc

SEQ ID NO: 16338 - DNA, 20 bp, Artificial Sequence
  sgRNA
gggaatctgtctgagaacac

SEQ ID NO: 16339 - DNA, 20 bp, Artificial Sequence
  sgRNA
aagcctatttattcccatca

SEQ ID NO: 16340 - DNA, 20 bp, Artificial Sequence
  sgRNA
gcttgtgtagaacagaggtg

SEQ ID NO: 16341 - DNA, 20 bp, Artificial Sequence
  sgRNA
tgaacagactggatgatttc

SEQ ID NO: 16342 - DNA, 20 bp, Artificial Sequence
  sgRNA
gaccttaacccttccgaccc

SEQ ID NO: 16343 - DNA, 20 bp, Artificial Sequence
  sgRNA
cccgcctgtccgaggacgtc

SEQ ID NO: 16344 - DNA, 20 bp, Artificial Sequence
  sgRNA
cgagccttatgccctggaga

SEQ ID NO: 16345 - DNA, 20 bp, Artificial Sequence
  sgRNA
aaattcataggcaccagcct

SEQ ID NO: 16346 - DNA, 20 bp, Artificial Sequence
  sgRNA
gaagagtgtctgtttaaggg

SEQ ID NO: 16347 - DNA, 20 bp, Artificial Sequence
  sgRNA
tggaagaatcgctcactcgg

SEQ ID NO: 16348 - DNA, 20 bp, Artificial Sequence
  sgRNA
tcaaggaggatcgatgttcc

SEQ ID NO: 16349 - DNA, 20 bp, Artificial Sequence
  sgRNA
ggcactctggatcttatccc

SEQ ID NO: 16350 - DNA, 20 bp, Artificial Sequence
  sgRNA
tctttataaagcatacatcg

SEQ ID NO: 16351 - DNA, 20 bp, Artificial Sequence
  sgRNA
cagtttacaactcgtcagac

SEQ ID NO: 16352 - DNA, 20 bp, Artificial Sequence
  sgRNA
aggagggaggagcccttggg

SEQ ID NO: 16353 - DNA, 20 bp, Artificial Sequence
  sgRNA
catggacaagctgtgctctg

SEQ ID NO: 16354 - DNA, 20 bp, Artificial Sequence
  sgRNA
agccacactagttcacccat

SEQ ID NO: 16355 - DNA, 20 bp, Artificial Sequence
  sgRNA
aggacagactgggtgatttc

SEQ ID NO: 16356 - DNA, 20 bp, Artificial Sequence
  sgRNA
ggtttgtatttagaacagta

SEQ ID NO: 16357 - DNA, 20 bp, Artificial Sequence
  sgRNA
gaaggatttgtgagagcaag

SEQ ID NO: 16358 - DNA, 20 bp, Artificial Sequence
  sgRNA
ttaaatcaaatcaggagacc

SEQ ID NO: 16359 - DNA, 20 bp, Artificial Sequence
  sgRNA
attcacactagcagcatctt

SEQ ID NO: 16360 - DNA, 20 bp, Artificial Sequence
  sgRNA
ttcggttggcattcggctaa

SEQ ID NO: 16361 - DNA, 20 bp, Artificial Sequence
  sgRNA
tcatctgggagatgagcctc

SEQ ID NO: 16362 - DNA, 20 bp, Artificial Sequence
  sgRNA
agctggccgtgcagagagga

SEQ ID NO: 16363 - DNA, 20 bp, Artificial Sequence
  sgRNA
actatcaattatgtatggga

SEQ ID NO: 16364 - DNA, 20 bp, Artificial Sequence
  sgRNA
tctaacaagttaggaagaac

SEQ ID NO: 16365 - DNA, 20 bp, Artificial Sequence
  sgRNA
gcagtctattcataatgaag

SEQ ID NO: 16366 - DNA, 20 bp, Artificial Sequence
  sgRNA
attggaggtgccaactccgt

SEQ ID NO: 16367 - DNA, 20 bp, Artificial Sequence
  sgRNA
tgcctaccagtctatcccgt

SEQ ID NO: 16368 - DNA, 20 bp, Artificial Sequence
  sgRNA
tgataagtcgaggtgctgat

SEQ ID NO: 16369 - DNA, 20 bp, Artificial Sequence
  sgRNA
gtcagagcatggtgctgagg

SEQ ID NO: 16370 - DNA, 20 bp, Artificial Sequence
  sgRNA
atggcagagggtctactgcc

SEQ ID NO: 16371 - DNA, 20 bp, Artificial Sequence
  sgRNA
tgatatatgaccatgtcatg

SEQ ID NO: 16372 - DNA, 20 bp, Artificial Sequence
  sgRNA
accgccttccggaaaggcgg

SEQ ID NO: 16373 - DNA, 20 bp, Artificial Sequence
  sgRNA
ggtcgcatctcgatgacgga

SEQ ID NO: 16374 - DNA, 20 bp, Artificial Sequence
  sgRNA
cactaggcgacacagccatc

SEQ ID NO: 16375 - DNA, 20 bp, Artificial Sequence
  sgRNA
tctcctgagaaatgtatgca

SEQ ID NO: 16376 - DNA, 20 bp, Artificial Sequence
  sgRNA
ggttgcatcctttggacaca

SEQ ID NO: 16377 - DNA, 20 bp, Artificial Sequence
  sgRNA
agactcacttctgaaaggag

SEQ ID NO: 16378 - DNA, 20 bp, Artificial Sequence
  sgRNA
gcgaccatagagttccagca

SEQ ID NO: 16379 - DNA, 20 bp, Artificial Sequence
  sgRNA
ggctagagaggaagtgcgga

SEQ ID NO: 16380 - DNA, 20 bp, Artificial Sequence
  sgRNA
gagagacatagagggaggga

SEQ ID NO: 16381 - DNA, 20 bp, Artificial Sequence
  sgRNA
gcgcgcgcgagggagaggag

SEQ ID NO: 16382 - DNA, 20 bp, Artificial Sequence
  sgRNA
ctgaataatgagcaaccaga

SEQ ID NO: 16383 - DNA, 20 bp, Artificial Sequence
  sgRNA
gctaatagccagagctttat

SEQ ID NO: 16384 - DNA, 20 bp, Artificial Sequence
  sgRNA
ttctattggtggcctgcctc

SEQ ID NO: 16385 - DNA, 20 bp, Artificial Sequence
  sgRNA
aaagtacaaagctctttagg

SEQ ID NO: 16386 - DNA, 20 bp, Artificial Sequence
  sgRNA
tggacagataggatgattta

SEQ ID NO: 16387 - DNA, 20 bp, Artificial Sequence
  sgRNA
gttgtgtagaagactcttag

SEQ ID NO: 16388 - DNA, 20 bp, Artificial Sequence
  sgRNA
tatcttgcagaaccagctcc

SEQ ID NO: 16389 - DNA, 20 bp, Artificial Sequence
  sgRNA
agagccaaagggttaggaac

SEQ ID NO: 16390 - DNA, 20 bp, Artificial Sequence
  sgRNA
gaagagtcacgtttcggaga

SEQ ID NO: 16391 - DNA, 20 bp, Artificial Sequence
  sgRNA
gcggtccctcaatgacgcac

SEQ ID NO: 16392 - DNA, 20 bp, Artificial Sequence
  sgRNA
agaggaagatggaactgttt

SEQ ID NO: 16393 - DNA, 20 bp, Artificial Sequence
  sgRNA
ggatttgtaaccttgcaccc

SEQ ID NO: 16394 - DNA, 20 bp, Artificial Sequence
  sgRNA
gttctatcagagcctcctca

SEQ ID NO: 16395 - DNA, 20 bp, Artificial Sequence
  sgRNA
gagctaaggaaggccagctg

SEQ ID NO: 16396 - DNA, 20 bp, Artificial Sequence
  sgRNA
caggagaagctgaggcaatc

SEQ ID NO: 16397 - DNA, 20 bp, Artificial Sequence
  sgRNA
tgagtaggcagatgtgacac

SEQ ID NO: 16398 - DNA, 20 bp, Artificial Sequence
  sgRNA
gcagctctgttcttgaatga

SEQ ID NO: 16399 - DNA, 20 bp, Artificial Sequence
  sgRNA
tttatgcaatgttaagtgag

SEQ ID NO: 16400 - DNA, 20 bp, Artificial Sequence
  sgRNA
gacttgccttggtgtgactc

SEQ ID NO: 16401 - DNA, 20 bp, Artificial Sequence
  sgRNA
ataagcatttggactcctta

SEQ ID NO: 16402 - DNA, 20 bp, Artificial Sequence
  sgRNA
tcaaagcagcttacatttct

SEQ ID NO: 16403 - DNA, 20 bp, Artificial Sequence
  sgRNA
tgagcttagaaatagttatg

SEQ ID NO: 16404 - DNA, 20 bp, Artificial Sequence
  sgRNA
ctcctaaatgtgacttccaa

SEQ ID NO: 16405 - DNA, 20 bp, Artificial Sequence
  sgRNA
gaacgaccggcgcacgggcc

SEQ ID NO: 16406 - DNA, 20 bp, Artificial Sequence
  sgRNA
gctgcgggaagccgtgacgc

SEQ ID NO: 16407 - DNA, 20 bp, Artificial Sequence
  sgRNA
gcttaagactccattgattt

SEQ ID NO: 16408 - DNA, 20 bp, Artificial Sequence
  sgRNA
cggttgtgtttatgagggat

SEQ ID NO: 16409 - DNA, 20 bp, Artificial Sequence
  sgRNA
gagggagagagtccatccat

SEQ ID NO: 16410 - DNA, 20 bp, Artificial Sequence
  sgRNA
gctttcgcttggtactatac

SEQ ID NO: 16411 - DNA, 20 bp, Artificial Sequence
  sgRNA
accttatacctggctctggg

SEQ ID NO: 16412 - DNA, 20 bp, Artificial Sequence
  sgRNA
aagtgattcttcggacatca

SEQ ID NO: 16413 - DNA, 20 bp, Artificial Sequence
  sgRNA
cgtctgtgaatgtatcagtt

SEQ ID NO: 16414 - DNA, 20 bp, Artificial Sequence
  sgRNA
aataccagatgcagtcacta

SEQ ID NO: 16415 - DNA, 20 bp, Artificial Sequence
  sgRNA
tggcaagacttgacttatcc

SEQ ID NO: 16416 - DNA, 20 bp, Artificial Sequence
  sgRNA
ggtgtggcacgccataatgc

SEQ ID NO: 16417 - DNA, 20 bp, Artificial Sequence
  sgRNA
aaagttaacagagcacagct

SEQ ID NO: 16418 - DNA, 20 bp, Artificial Sequence
  sgRNA
aattctagactaggcaggtc

SEQ ID NO: 16419 - DNA, 20 bp, Artificial Sequence
  sgRNA
agtaaatctgagccacgcca

SEQ ID NO: 16420 - DNA, 20 bp, Artificial Sequence
  sgRNA
tttctggtgctaacttgcct

SEQ ID NO: 16421 - DNA, 20 bp, Artificial Sequence
  sgRNA
gctagattgactttcataaa

SEQ ID NO: 16422 - DNA, 20 bp, Artificial Sequence
  sgRNA
ggaggaactctgtcggccgc

SEQ ID NO: 16423 - DNA, 20 bp, Artificial Sequence
  sgRNA
ctgaaagctgttcgggcacc

SEQ ID NO: 16424 - DNA, 20 bp, Artificial Sequence
  sgRNA
ggccaagttcttcttcagag

SEQ ID NO: 16425 - DNA, 20 bp, Artificial Sequence
  sgRNA
gaactgatggacaccgagtg

SEQ ID NO: 16426 - DNA, 20 bp, Artificial Sequence
  sgRNA
acactcaagagttcttgacc

SEQ ID NO: 16427 - DNA, 20 bp, Artificial Sequence
  sgRNA
acttgaggagtccgtgacgc

SEQ ID NO: 16428 - DNA, 20 bp, Artificial Sequence
  sgRNA
gtctgtcctatggcagggag

SEQ ID NO: 16429 - DNA, 20 bp, Artificial Sequence
  sgRNA
ggagcgagaggaggagcagg

SEQ ID NO: 16430 - DNA, 20 bp, Artificial Sequence
  sgRNA
aggaggaggagaagaaggca

SEQ ID NO: 16431 - DNA, 20 bp, Artificial Sequence
  sgRNA
tcattgccaaagatccttca

SEQ ID NO: 16432 - DNA, 20 bp, Artificial Sequence
  sgRNA
ccagtgattggaccacatca

SEQ ID NO: 16433 - DNA, 20 bp, Artificial Sequence
  sgRNA
ggtcctcctggtaatatata

SEQ ID NO: 16434 - DNA, 20 bp, Artificial Sequence
  sgRNA
ggtaaagccagcagaggtgg

SEQ ID NO: 16435 - DNA, 20 bp, Artificial Sequence
  sgRNA
ggccgagagttggcgaatga

SEQ ID NO: 16436 - DNA, 20 bp, Artificial Sequence
  sgRNA
gaggagcttcctggtcttcc

SEQ ID NO: 16437 - DNA, 20 bp, Artificial Sequence
  sgRNA
cgggaaattgcaacagtact

SEQ ID NO: 16438 - DNA, 20 bp, Artificial Sequence
  sgRNA
cgggagttacgggaaagcgc

SEQ ID NO: 16439 - DNA, 20 bp, Artificial Sequence
  sgRNA
ttggcactcctgggacccac

SEQ ID NO: 16440 - DNA, 20 bp, Artificial Sequence
  sgRNA
cagtagattgaatcttgtgc

SEQ ID NO: 16441 - DNA, 20 bp, Artificial Sequence
  sgRNA
ttgtgctggtggcgggtagg

SEQ ID NO: 16442 - DNA, 20 bp, Artificial Sequence
  sgRNA
ggttaagacactcagagtct

SEQ ID NO: 16443 - DNA, 20 bp, Artificial Sequence
  sgRNA
gcccggaggcggcgcctgcg

SEQ ID NO: 16444 - DNA, 20 bp, Artificial Sequence
  sgRNA
cgcgcgtgagtcggagcctc

SEQ ID NO: 16445 - DNA, 20 bp, Artificial Sequence
  sgRNA
gacggcggagaaggctgcgg

SEQ ID NO: 16446 - DNA, 20 bp, Artificial Sequence
  sgRNA
ttgttcataggtgttggctt

SEQ ID NO: 16447 - DNA, 20 bp, Artificial Sequence
  sgRNA
aagtgtcaaggtccaaccaa

SEQ ID NO: 16448 - DNA, 20 bp, Artificial Sequence
  sgRNA
gaattacaatgactctccat

SEQ ID NO: 16449 - DNA, 20 bp, Artificial Sequence
  sgRNA
tctattactcgtggctgatc

SEQ ID NO: 16450 - DNA, 20 bp, Artificial Sequence
  sgRNA
tgaggctggaatcgtggtga

SEQ ID NO: 16451 - DNA, 20 bp, Artificial Sequence
  sgRNA
gctctgcagcaacacccgcg

SEQ ID NO: 16452 - DNA, 20 bp, Artificial Sequence
  sgRNA
ggtgtgccgcccgggagccc

SEQ ID NO: 16453 - DNA, 20 bp, Artificial Sequence
  sgRNA
agcaggctggtggcggtccc

SEQ ID NO: 16454 - DNA, 20 bp, Artificial Sequence
  sgRNA
tctgtcctaataaggaaagt

SEQ ID NO: 16455 - DNA, 20 bp, Artificial Sequence
  sgRNA
ggaagctctcacatccaagc

SEQ ID NO: 16456 - DNA, 20 bp, Artificial Sequence
  sgRNA
agacgtgctctgaagactac

SEQ ID NO: 16457 - DNA, 20 bp, Artificial Sequence
  sgRNA
cctaccttattaacttagtg

SEQ ID NO: 16458 - DNA, 20 bp, Artificial Sequence
  sgRNA
tctaagtacctgctctcaac

SEQ ID NO: 16459 - DNA, 20 bp, Artificial Sequence
  sgRNA
agtcccggaagtggctgtca

SEQ ID NO: 16460 - DNA, 20 bp, Artificial Sequence
  sgRNA
ggtctgaggcctgaaggcgg

SEQ ID NO: 16461 - DNA, 20 bp, Artificial Sequence
  sgRNA
agagaagcctgaatgtgaaa

SEQ ID NO: 16462 - DNA, 20 bp, Artificial Sequence
  sgRNA
aggagagacggaagggaagg

SEQ ID NO: 16463 - DNA, 20 bp, Artificial Sequence
  sgRNA
aagggagaagagaaggtggg

SEQ ID NO: 16464 - DNA, 20 bp, Artificial Sequence
  sgRNA
gtgtgatctgttggtgagcc

SEQ ID NO: 16465 - DNA, 20 bp, Artificial Sequence
  sgRNA
ggatgttctgagaggctcag

SEQ ID NO: 16466 - DNA, 20 bp, Artificial Sequence
  sgRNA
tggaaacaggatcctgcaag

SEQ ID NO: 16467 - DNA, 20 bp, Artificial Sequence
  sgRNA
aaccgtatggcgcggctcct

SEQ ID NO: 16468 - DNA, 20 bp, Artificial Sequence
  sgRNA
gtgacgcacttcctattgcg

SEQ ID NO: 16469 - DNA, 20 bp, Artificial Sequence
  sgRNA
gtcctctgaaagacagtagt

SEQ ID NO: 16470 - DNA, 20 bp, Artificial Sequence
  sgRNA
attgggcacgtcttgaggct

SEQ ID NO: 16471 - DNA, 20 bp, Artificial Sequence
  sgRNA
gacacacaaacggagggtag

SEQ ID NO: 16472 - DNA, 20 bp, Artificial Sequence
  sgRNA
aattaactctacgaagagct

SEQ ID NO: 16473 - DNA, 20 bp, Artificial Sequence
  sgRNA
gacggcgaagcccgcacacc

SEQ ID NO: 16474 - DNA, 20 bp, Artificial Sequence
  sgRNA
gcgtttccgcggcggacgcc

SEQ ID NO: 16475 - DNA, 20 bp, Artificial Sequence
  sgRNA
ctgaaagagagataaagctg

SEQ ID NO: 16476 - DNA, 20 bp, Artificial Sequence
  sgRNA
ggaggaaataggagggaggg

SEQ ID NO: 16477 - DNA, 20 bp, Artificial Sequence
  sgRNA
tcacttacctccttctcact

SEQ ID NO: 16478 - DNA, 20 bp, Artificial Sequence
  sgRNA
gtgcgggtactttccgacgc

SEQ ID NO: 16479 - DNA, 20 bp, Artificial Sequence
  sgRNA
tgcttagcctttggcgtctc

SEQ ID NO: 16480 - DNA, 20 bp, Artificial Sequence
  sgRNA
aagctagcgtgagggacagc

SEQ ID NO: 16481 - DNA, 20 bp, Artificial Sequence
  sgRNA
agcagcaggatttagaggga

SEQ ID NO: 16482 - DNA, 20 bp, Artificial Sequence
  sgRNA
agaaagccaagagttgggtg

SEQ ID NO: 16483 - DNA, 20 bp, Artificial Sequence
  sgRNA
aaaggtcagatctgtactcc

SEQ ID NO: 16484 - DNA, 20 bp, Artificial Sequence
  sgRNA
tccgggtgcgcgctcggccc

SEQ ID NO: 16485 - DNA, 20 bp, Artificial Sequence
  sgRNA
gaatggcgtggagcagcgag

SEQ ID NO: 16486 - DNA, 20 bp, Artificial Sequence
  sgRNA
ccctccctcccattgtcacc

SEQ ID NO: 16487 - DNA, 20 bp, Artificial Sequence
  sgRNA
gtgctaacctgtgatcactg

SEQ ID NO: 16488 - DNA, 20 bp, Artificial Sequence
  sgRNA
gatttcactatgccttggcc

SEQ ID NO: 16489 - DNA, 20 bp, Artificial Sequence
  sgRNA
tacctgattggttatcaccc

SEQ ID NO: 16490 - DNA, 20 bp, Artificial Sequence
  sgRNA
acatggctggccttcaccca

SEQ ID NO: 16491 - DNA, 20 bp, Artificial Sequence
  sgRNA
cattcctgcggaaccgtctc

SEQ ID NO: 16492 - DNA, 20 bp, Artificial Sequence
  sgRNA
ccatctttggtgtggcgctt

SEQ ID NO: 16493 - DNA, 20 bp, Artificial Sequence
  sgRNA
agataacactcacctataaa

SEQ ID NO: 16494 - DNA, 20 bp, Artificial Sequence
  sgRNA
agataagcccagagaagtac

SEQ ID NO: 16495 - DNA, 20 bp, Artificial Sequence
  sgRNA
accttggaacgctcagcctc

SEQ ID NO: 16496 - DNA, 20 bp, Artificial Sequence
  sgRNA
ggagaagtactcaagggtct

SEQ ID NO: 16497 - DNA, 20 bp, Artificial Sequence
  sgRNA
atgtggctcagtagctgaaa

SEQ ID NO: 16498 - DNA, 20 bp, Artificial Sequence
  sgRNA
ccggagccggaccttgcttc

SEQ ID NO: 16499 - DNA, 20 bp, Artificial Sequence
  sgRNA
gcgttgctttagttgatatg

SEQ ID NO: 16500 - DNA, 20 bp, Artificial Sequence
  sgRNA
tttccggcagtgccgcaagt

SEQ ID NO: 16501 - DNA, 20 bp, Artificial Sequence
  sgRNA
ccggcgcgtgtacgactagc

SEQ ID NO: 16502 - DNA, 20 bp, Artificial Sequence
  sgRNA
acctgagccatgccaaggaa

SEQ ID NO: 16503 - DNA, 20 bp, Artificial Sequence
  sgRNA
acacagtagcattggcttcc

SEQ ID NO: 16504 - DNA, 20 bp, Artificial Sequence
  sgRNA
attatgcagtgtaaatgagc

SEQ ID NO: 16505 - DNA, 20 bp, Artificial Sequence
  sgRNA
tagagaactgttgcaagttg

SEQ ID NO: 16506 - DNA, 20 bp, Artificial Sequence
  sgRNA
tgatgagtggagtctcaatc

SEQ ID NO: 16507 - DNA, 20 bp, Artificial Sequence
  sgRNA
tgttccgagcaccgggtccc

SEQ ID NO: 16508 - DNA, 20 bp, Artificial Sequence
  sgRNA
ttggaattggaaatgcagcg

SEQ ID NO: 16509 - DNA, 20 bp, Artificial Sequence
  sgRNA
gcgaccgcggcctcacaaca

SEQ ID NO: 16510 - DNA, 20 bp, Artificial Sequence
  sgRNA
gaagtgggtggagatcaata

SEQ ID NO: 16511 - DNA, 20 bp, Artificial Sequence
  sgRNA
aaactccagctaaactcgga

SEQ ID NO: 16512 - DNA, 20 bp, Artificial Sequence
  sgRNA
ttgagcgaggcactgactag

SEQ ID NO: 16513 - DNA, 20 bp, Artificial Sequence
  sgRNA
gaaacaaacatcatttaccc

SEQ ID NO: 16514 - DNA, 20 bp, Artificial Sequence
  sgRNA
aaccggacgagtttctactt

SEQ ID NO: 16515 - DNA, 20 bp, Artificial Sequence
  sgRNA
cgttacaatcaagctctttc

SEQ ID NO: 16516 - DNA, 20 bp, Artificial Sequence
  sgRNA
gataggtggacggtcgcgcg

SEQ ID NO: 16517 - DNA, 20 bp, Artificial Sequence
  sgRNA
cccttgctgcgtccggcagg

SEQ ID NO: 16518 - DNA, 20 bp, Artificial Sequence
  sgRNA
atgaaggcgatttaaagtct

SEQ ID NO: 16519 - DNA, 20 bp, Artificial Sequence
  sgRNA
ctgagccagtgcacagtgaa

SEQ ID NO: 16520 - DNA, 20 bp, Artificial Sequence
  sgRNA
aggtctcacacttgtgtcat

SEQ ID NO: 16521 - DNA, 20 bp, Artificial Sequence
  sgRNA
gagcagagtccgcaccacct

SEQ ID NO: 16522 - DNA, 20 bp, Artificial Sequence
  sgRNA
agcacctgggaatgtggtgg

SEQ ID NO: 16523 - DNA, 20 bp, Artificial Sequence
  sgRNA
tatatgcctggcccagggag

SEQ ID NO: 16524 - DNA, 20 bp, Artificial Sequence
  sgRNA
tattaggaggtgtggcctgt

SEQ ID NO: 16525 - DNA, 20 bp, Artificial Sequence
  sgRNA
agtccatcggttggacactg

SEQ ID NO: 16526 - DNA, 20 bp, Artificial Sequence
  sgRNA
tctctctggtcctaaatcaa

SEQ ID NO: 16527 - DNA, 20 bp, Artificial Sequence
  sgRNA
accaatgtcaccacagttat

SEQ ID NO: 16528 - DNA, 20 bp, Artificial Sequence
  sgRNA
gcacttcctgtagttggagc

SEQ ID NO: 16529 - DNA, 20 bp, Artificial Sequence
  sgRNA
agccctggcgaaggcactac

SEQ ID NO: 16530 - DNA, 20 bp, Artificial Sequence
  sgRNA
gtacatctattacgttcgtc

SEQ ID NO: 16531 - DNA, 20 bp, Artificial Sequence
  sgRNA
aactagatatgatgatacag

SEQ ID NO: 16532 - DNA, 20 bp, Artificial Sequence
  sgRNA
tcttctctcctttgttctga

SEQ ID NO: 16533 - DNA, 20 bp, Artificial Sequence
  sgRNA
atgctataaacaccctgaca

SEQ ID NO: 16534 - DNA, 20 bp, Artificial Sequence
  sgRNA
acgcggcttcagacgtctgc

SEQ ID NO: 16535 - DNA, 20 bp, Artificial Sequence
  sgRNA
ctctcgctcctccggctttc

SEQ ID NO: 16536 - DNA, 20 bp, Artificial Sequence
  sgRNA
agaagcgggtatcactgcgt

SEQ ID NO: 16537 - DNA, 20 bp, Artificial Sequence
  sgRNA
gactttataaccagcgcccg

SEQ ID NO: 16538 - DNA, 20 bp, Artificial Sequence
  sgRNA
tctgaggccttcaggctgct

SEQ ID NO: 16539 - DNA, 20 bp, Artificial Sequence
  sgRNA
tttagcagttctcagccaat

SEQ ID NO: 16540 - DNA, 20 bp, Artificial Sequence
  sgRNA
gccgtgcgctgatttgctcg

SEQ ID NO: 16541 - DNA, 20 bp, Artificial Sequence
  sgRNA
cgcctgggctcggatcgaca

SEQ ID NO: 16542 - DNA, 20 bp, Artificial Sequence
  sgRNA
gtgctcagtggctggttggc

SEQ ID NO: 16543 - DNA, 20 bp, Artificial Sequence
  sgRNA
atttagttccaggcggcgca

SEQ ID NO: 16544 - DNA, 20 bp, Artificial Sequence
  sgRNA
aaatatgtaacctcaggacc

SEQ ID NO: 16545 - DNA, 20 bp, Artificial Sequence
  sgRNA
taaggcaagtactggcaagc

SEQ ID NO: 16546 - DNA, 20 bp, Artificial Sequence
  sgRNA
tggctcacccagaccttgtc

SEQ ID NO: 16547 - DNA, 20 bp, Artificial Sequence
  sgRNA
tcaaagaacaatttcctcca

SEQ ID NO: 16548 - DNA, 20 bp, Artificial Sequence
  sgRNA
tctggagcctaaccacagca

SEQ ID NO: 16549 - DNA, 20 bp, Artificial Sequence
  sgRNA
taagtttctcaatcactgtc

SEQ ID NO: 16550 - DNA, 20 bp, Artificial Sequence
  sgRNA
atttcaatatcatcaaaggc

SEQ ID NO: 16551 - DNA, 20 bp, Artificial Sequence
  sgRNA
tgggctagacagcgagtagc

SEQ ID NO: 16552 - DNA, 20 bp, Artificial Sequence
  sgRNA
cctgcagagattccatagcc

SEQ ID NO: 16553 - DNA, 20 bp, Artificial Sequence
  sgRNA
agctgtactgaaatgtcaga

SEQ ID NO: 16554 - DNA, 20 bp, Artificial Sequence
  sgRNA
tcatcagagagcgccaccgc

SEQ ID NO: 16555 - DNA, 20 bp, Artificial Sequence
  sgRNA
aaagatactcctgtctgctc

SEQ ID NO: 16556 - DNA, 20 bp, Artificial Sequence
  sgRNA
gcccgcgcgaatcgcttctc

SEQ ID NO: 16557 - DNA, 20 bp, Artificial Sequence
  sgRNA
acacagcacagcatacccag

SEQ ID NO: 16558 - DNA, 20 bp, Artificial Sequence
  sgRNA
tgtgccacatacagaacgta

SEQ ID NO: 16559 - DNA, 20 bp, Artificial Sequence
  sgRNA
tttctccatagctattgacc

SEQ ID NO: 16560 - DNA, 20 bp, Artificial Sequence
  sgRNA
tcgcgtggaacgtggcgcac

SEQ ID NO: 16561 - DNA, 20 bp, Artificial Sequence
  sgRNA
gaccgcggcggaggcacatg

SEQ ID NO: 16562 - DNA, 20 bp, Artificial Sequence
  sgRNA
aaataagcgcagacctacgg

SEQ ID NO: 16563 - DNA, 20 bp, Artificial Sequence
  sgRNA
gagaggccacctagctcaag

SEQ ID NO: 16564 - DNA, 20 bp, Artificial Sequence
  sgRNA
gctgtgatgacctcactctg

SEQ ID NO: 16565 - DNA, 20 bp, Artificial Sequence
  sgRNA
ggcagcacagagaatggaaa

SEQ ID NO: 16566 - DNA, 20 bp, Artificial Sequence
  sgRNA
aaatgctcaatgtttaactg

SEQ ID NO: 16567 - DNA, 20 bp, Artificial Sequence
  sgRNA
tcctgctaaatttgccgcca

SEQ ID NO: 16568 - DNA, 20 bp, Artificial Sequence
  sgRNA
ttatctaatccctagaaagc

SEQ ID NO: 16569 - DNA, 20 bp, Artificial Sequence
  sgRNA
tgtgacacagaaacagctgg

SEQ ID NO: 16570 - DNA, 20 bp, Artificial Sequence
  sgRNA
tggttcttgcttggtgtctc

SEQ ID NO: 16571 - DNA, 20 bp, Artificial Sequence
  sgRNA
ttagagtgagatgtgtagca

SEQ ID NO: 16572 - DNA, 20 bp, Artificial Sequence
  sgRNA
ctcagttcacatagctgccc

SEQ ID NO: 16573 - DNA, 20 bp, Artificial Sequence
  sgRNA
ttattcactccgggcatccc

SEQ ID NO: 16574 - DNA, 20 bp, Artificial Sequence
  sgRNA
gtttactctagcgctctacc

SEQ ID NO: 16575 - DNA, 20 bp, Artificial Sequence
  sgRNA
gatgacaccagtctcttcag

SEQ ID NO: 16576 - DNA, 20 bp, Artificial Sequence
  sgRNA
ctggagccttgaacttgtta

SEQ ID NO: 16577 - DNA, 20 bp, Artificial Sequence
  sgRNA
tctttgtctaagaatgtgct

SEQ ID NO: 16578 - DNA, 20 bp, Artificial Sequence
  sgRNA
gagtctgttgcgcacgccca

SEQ ID NO: 16579 - DNA, 20 bp, Artificial Sequence
  sgRNA
gcgtggcaagctggagcacg

SEQ ID NO: 16580 - DNA, 20 bp, Artificial Sequence
  sgRNA
ctttgcagcattcttcaaac

SEQ ID NO: 16581 - DNA, 20 bp, Artificial Sequence
  sgRNA
gtacacgcgaggtgcgggtg

SEQ ID NO: 16582 - DNA, 20 bp, Artificial Sequence
  sgRNA
cggtcgtcttaagccaacga

SEQ ID NO: 16583 - DNA, 20 bp, Artificial Sequence
  sgRNA
gtggaatgacagcttgtgat

SEQ ID NO: 16584 - DNA, 20 bp, Artificial Sequence
  sgRNA
gccctttgggcgcgcactcc

SEQ ID NO: 16585 - DNA, 20 bp, Artificial Sequence
  sgRNA
acaaccttcgctctcgacca

SEQ ID NO: 16586 - DNA, 20 bp, Artificial Sequence
  sgRNA
tctaggtctcctctttctgt

SEQ ID NO: 16587 - DNA, 20 bp, Artificial Sequence
  sgRNA
tttctctgggtcgggtagga

SEQ ID NO: 16588 - DNA, 20 bp, Artificial Sequence
  sgRNA
ggcgttaggtcgccgtcctc

SEQ ID NO: 16589 - DNA, 20 bp, Artificial Sequence
  sgRNA
tacacatgcgccctgcggcc

SEQ ID NO: 16590 - DNA, 20 bp, Artificial Sequence
  sgRNA
cgggctctcggcggtggagg

SEQ ID NO: 16591 - DNA, 20 bp, Artificial Sequence
  sgRNA
accgtggcggagccaggctg

SEQ ID NO: 16592 - DNA, 20 bp, Artificial Sequence
  sgRNA
gcgacggtggcagcttagcg

SEQ ID NO: 16593 - DNA, 20 bp, Artificial Sequence
  sgRNA
tctgaatatgagcaagtggg

SEQ ID NO: 16594 - DNA, 20 bp, Artificial Sequence
  sgRNA
attatataaagggtcatagc

SEQ ID NO: 16595 - DNA, 20 bp, Artificial Sequence
  sgRNA
agaggcctactttggcttgg

SEQ ID NO: 16596 - DNA, 20 bp, Artificial Sequence
  sgRNA
aacgcaggatcaggagggag

SEQ ID NO: 16597 - DNA, 20 bp, Artificial Sequence
  sgRNA
tgccagttcccggcaacgcg

SEQ ID NO: 16598 - DNA, 20 bp, Artificial Sequence
  sgRNA
gatccaactttgctcggagg

SEQ ID NO: 16599 - DNA, 20 bp, Artificial Sequence
  sgRNA
gcaaactgtgtgtgcagcaa

SEQ ID NO: 16600 - DNA, 20 bp, Artificial Sequence
  sgRNA
atcctcctgagtcttgcatt

SEQ ID NO: 16601 - DNA, 20 bp, Artificial Sequence
  sgRNA
ggttgaggtctgatgagaaa

SEQ ID NO: 16602 - DNA, 20 bp, Artificial Sequence
  sgRNA
attcaccacaagcacagcaa

SEQ ID NO: 16603 - DNA, 20 bp, Artificial Sequence
  sgRNA
tccttggctgggtccagtga

SEQ ID NO: 16604 - DNA, 20 bp, Artificial Sequence
  sgRNA
gtactgggttctttagctcc

SEQ ID NO: 16605 - DNA, 20 bp, Artificial Sequence
  sgRNA
ggacaattaatgacggttta

SEQ ID NO: 16606 - DNA, 20 bp, Artificial Sequence
  sgRNA
cacatggtctcggccgaatt

SEQ ID NO: 16607 - DNA, 20 bp, Artificial Sequence
  sgRNA
ttctttattctgagtgacaa

SEQ ID NO: 16608 - DNA, 20 bp, Artificial Sequence
  sgRNA
gaaagcgaaaccctcaggcc

SEQ ID NO: 16609 - DNA, 20 bp, Artificial Sequence
  sgRNA
ttcattcccggaagagatgc

SEQ ID NO: 16610 - DNA, 20 bp, Artificial Sequence
  sgRNA
agaggcgtgtcctcagggcg

SEQ ID NO: 16611 - DNA, 20 bp, Artificial Sequence
  sgRNA
ttacaaggacatctaggaca

SEQ ID NO: 16612 - DNA, 20 bp, Artificial Sequence
  sgRNA
actgagctggcttctttcac

SEQ ID NO: 16613 - DNA, 20 bp, Artificial Sequence
  sgRNA
tttcttctgtcaaactgcct

SEQ ID NO: 16614 - DNA, 20 bp, Artificial Sequence
  sgRNA
tgtgtatttacacatgagct

SEQ ID NO: 16615 - DNA, 20 bp, Artificial Sequence
  sgRNA
ggcagatcttcccacaagcc

SEQ ID NO: 16616 - DNA, 20 bp, Artificial Sequence
  sgRNA
agttgaaggactgatttaag

SEQ ID NO: 16617 - DNA, 20 bp, Artificial Sequence
  sgRNA
gatcatgtctctgtagtctt

SEQ ID NO: 16618 - DNA, 20 bp, Artificial Sequence
  sgRNA
ataatccaaagtttacagac

SEQ ID NO: 16619 - DNA, 20 bp, Artificial Sequence
  sgRNA
gaaatcaattgggaagttca

SEQ ID NO: 16620 - DNA, 20 bp, Artificial Sequence
  sgRNA
cttcattgtacggagaggcc

SEQ ID NO: 16621 - DNA, 20 bp, Artificial Sequence
  sgRNA
ggtgatttgacgccctctag

SEQ ID NO: 16622 - DNA, 20 bp, Artificial Sequence
  sgRNA
aggcgcagaccatttaggac

SEQ ID NO: 16623 - DNA, 20 bp, Artificial Sequence
  sgRNA
gaggctatcacttgagggcg

SEQ ID NO: 16624 - DNA, 20 bp, Artificial Sequence
  sgRNA
gggaaatcttcctagggcca

SEQ ID NO: 16625 - DNA, 20 bp, Artificial Sequence
  sgRNA
cctgctgtgttgacctcaag

SEQ ID NO: 16626 - DNA, 20 bp, Artificial Sequence
  sgRNA
tgggcgtcctccactgacag

SEQ ID NO: 16627 - DNA, 20 bp, Artificial Sequence
  sgRNA
agctgttgcagcattggaga

SEQ ID NO: 16628 - DNA, 20 bp, Artificial Sequence
  sgRNA
ggaggctgctctctctgctg

SEQ ID NO: 16629 - DNA, 20 bp, Artificial Sequence
  sgRNA
atcactagaataacaaagct

SEQ ID NO: 16630 - DNA, 20 bp, Artificial Sequence
  sgRNA
ccatcgtcctagagcggagc

SEQ ID NO: 16631 - DNA, 20 bp, Artificial Sequence
  sgRNA
ctttcaacttagacccagtc

SEQ ID NO: 16632 - DNA, 20 bp, Artificial Sequence
  sgRNA
aagctctctaggaagctcgg

SEQ ID NO: 16633 - DNA, 20 bp, Artificial Sequence
  sgRNA
ctctatggtaggccagcaaa

SEQ ID NO: 16634 - DNA, 20 bp, Artificial Sequence
  sgRNA
cgagcgccctcagctacacc

SEQ ID NO: 16635 - DNA, 20 bp, Artificial Sequence
  sgRNA
ggatccaggatggcgtgccc

SEQ ID NO: 16636 - DNA, 20 bp, Artificial Sequence
  sgRNA
tgcgcacacacaccgtggcc

SEQ ID NO: 16637 - DNA, 20 bp, Artificial Sequence
  sgRNA
gcgccctctcttcagcacgc

SEQ ID NO: 16638 - DNA, 20 bp, Artificial Sequence
  sgRNA
tagatagcgaacccgctgag

SEQ ID NO: 16639 - DNA, 20 bp, Artificial Sequence
  sgRNA
tccctgcctgctgaggtttc

SEQ ID NO: 16640 - DNA, 20 bp, Artificial Sequence
  sgRNA
tgcgtgcgtgacagagacgg

SEQ ID NO: 16641 - DNA, 20 bp, Artificial Sequence
  sgRNA
gtatggacacgcgttctgtt

SEQ ID NO: 16642 - DNA, 20 bp, Artificial Sequence
  sgRNA
gctggagtctttgacacaac

SEQ ID NO: 16643 - DNA, 20 bp, Artificial Sequence
  sgRNA
cgatgggcgggactcacgca

SEQ ID NO: 16644 - DNA, 20 bp, Artificial Sequence
  sgRNA
actcatagtcagtgtgggtg

SEQ ID NO: 16645 - DNA, 20 bp, Artificial Sequence
  sgRNA
ttcttctattacaggtggcc

SEQ ID NO: 16646 - DNA, 20 bp, Artificial Sequence
  sgRNA
aaagagtgtcacttgctgga

SEQ ID NO: 16647 - DNA, 20 bp, Artificial Sequence
  sgRNA
gggatgtctataaatgtgcc

SEQ ID NO: 16648 - DNA, 20 bp, Artificial Sequence
  sgRNA
tggagttaggtaacagtcac

SEQ ID NO: 16649 - DNA, 20 bp, Artificial Sequence
  sgRNA
agccgctacgggtagcggcc

SEQ ID NO: 16650 - DNA, 20 bp, Artificial Sequence
  sgRNA
aagaacaaaggtggataagc

SEQ ID NO: 16651 - DNA, 20 bp, Artificial Sequence
  sgRNA
gcgcgacgctgagatgtcac

SEQ ID NO: 16652 - DNA, 20 bp, Artificial Sequence
  sgRNA
gagtgtcacgtgatggtgtc

SEQ ID NO: 16653 - DNA, 20 bp, Artificial Sequence
  sgRNA
gtctacggagaagggcgggc

SEQ ID NO: 16654 - DNA, 20 bp, Artificial Sequence
  sgRNA
tcgctagatctctaggctgt

SEQ ID NO: 16655 - DNA, 20 bp, Artificial Sequence
  sgRNA
gtataaatttcagcacccag

SEQ ID NO: 16656 - DNA, 20 bp, Artificial Sequence
  sgRNA
actcttggatggatggctgt

SEQ ID NO: 16657 - DNA, 20 bp, Artificial Sequence
  sgRNA
gccgcagtcacagcgggagc

SEQ ID NO: 16658 - DNA, 20 bp, Artificial Sequence
  sgRNA
cctgtgattggcggtcagcg

SEQ ID NO: 16659 - DNA, 20 bp, Artificial Sequence
  sgRNA
gatcgccggtgcgcccgagc

SEQ ID NO: 16660 - DNA, 20 bp, Artificial Sequence
  sgRNA
agacgctaagggtggaagaa

SEQ ID NO: 16661 - DNA, 20 bp, Artificial Sequence
  sgRNA
gcgccgccgcggtcacgtga

SEQ ID NO: 16662 - DNA, 20 bp, Artificial Sequence
  sgRNA
ggcgctgggcgtggccacgc

SEQ ID NO: 16663 - DNA, 20 bp, Artificial Sequence
  sgRNA
aggaacctctgccattgatc

SEQ ID NO: 16664 - DNA, 20 bp, Artificial Sequence
  sgRNA
cttacttcactgtattacat

SEQ ID NO: 16665 - DNA, 20 bp, Artificial Sequence
  sgRNA
cgtttccacattcaaatttc

SEQ ID NO: 16666 - DNA, 20 bp, Artificial Sequence
  sgRNA
gagatcagggccattcttgc

SEQ ID NO: 16667 - DNA, 20 bp, Artificial Sequence
  sgRNA
agtgtgcaccacgcgctgat

SEQ ID NO: 16668 - DNA, 20 bp, Artificial Sequence
  sgRNA
tctagagcccttgccgggcg

SEQ ID NO: 16669 - DNA, 20 bp, Artificial Sequence
  sgRNA
atattgtgtctcaagaagaa

SEQ ID NO: 16670 - DNA, 20 bp, Artificial Sequence
  sgRNA
tgtataggatacacatagcc

SEQ ID NO: 16671 - DNA, 20 bp, Artificial Sequence
  sgRNA
tgagctaacaggtgatgttt

SEQ ID NO: 16672 - DNA, 20 bp, Artificial Sequence
  sgRNA
agagagaagggcaccatccc

SEQ ID NO: 16673 - DNA, 20 bp, Artificial Sequence
  sgRNA
acaactcccaggcggcatcg

SEQ ID NO: 16674 - DNA, 20 bp, Artificial Sequence
  sgRNA
tgtgctttgtgggagttccc

SEQ ID NO: 16675 - DNA, 20 bp, Artificial Sequence
  sgRNA
gtccggaggacgtcacactg

SEQ ID NO: 16676 - DNA, 20 bp, Artificial Sequence
  sgRNA
tcctatgaccgtaaacgcca

SEQ ID NO: 16677 - DNA, 20 bp, Artificial Sequence
  sgRNA
gtggagcaagaacgaaaggc

SEQ ID NO: 16678 - DNA, 20 bp, Artificial Sequence
  sgRNA
gtttctttatagacggagaa

SEQ ID NO: 16679 - DNA, 20 bp, Artificial Sequence
  sgRNA
ggcttacaggtaattagagg

SEQ ID NO: 16680 - DNA, 20 bp, Artificial Sequence
  sgRNA
ggccctaaatacacaagtgc

SEQ ID NO: 16681 - DNA, 20 bp, Artificial Sequence
  sgRNA
ctctcttgcaacccaacgtt

SEQ ID NO: 16682 - DNA, 20 bp, Artificial Sequence
  sgRNA
tggcatacacctgacttctc

SEQ ID NO: 16683 - DNA, 20 bp, Artificial Sequence
  sgRNA
cttccaagcttcagggctcc

SEQ ID NO: 16684 - DNA, 20 bp, Artificial Sequence
  sgRNA
ttgacaaatgtcaggtggag

SEQ ID NO: 16685 - DNA, 20 bp, Artificial Sequence
  sgRNA
cacttacacactgcccaaac

SEQ ID NO: 16686 - DNA, 20 bp, Artificial Sequence
  sgRNA
acagggatatagcctgtaca

SEQ ID NO: 16687 - DNA, 20 bp, Artificial Sequence
  sgRNA
gggcgggatcagcaggaccg

SEQ ID NO: 16688 - DNA, 20 bp, Artificial Sequence
  sgRNA
atccggagggtgtagtgggc

SEQ ID NO: 16689 - DNA, 20 bp, Artificial Sequence
  sgRNA
cccgctcgcggccagaggga

SEQ ID NO: 16690 - DNA, 20 bp, Artificial Sequence
  sgRNA
ggaggaaatgtcagaggcaa

SEQ ID NO: 16691 - DNA, 20 bp, Artificial Sequence
  sgRNA
tctgcctcttagtcagtggg

SEQ ID NO: 16692 - DNA, 20 bp, Artificial Sequence
  sgRNA
tatgatggctgagatgggtg

SEQ ID NO: 16693 - DNA, 20 bp, Artificial Sequence
  sgRNA
atccttggtttgtggaggtg

SEQ ID NO: 16694 - DNA, 20 bp, Artificial Sequence
  sgRNA
accgaaccttcctgcctgga

SEQ ID NO: 16695 - DNA, 20 bp, Artificial Sequence
  sgRNA
gtgggaccaggaaggtctgg

SEQ ID NO: 16696 - DNA, 20 bp, Artificial Sequence
  sgRNA
ccaataagcaggtcggaaag

SEQ ID NO: 16697 - DNA, 20 bp, Artificial Sequence
  sgRNA
cgtgggtcgcgatgcatgcc

SEQ ID NO: 16698 - DNA, 20 bp, Artificial Sequence
  sgRNA
gggcgttccagagctcctat

SEQ ID NO: 16699 - DNA, 20 bp, Artificial Sequence
  sgRNA
tcgccgtcgaggagtacttc

SEQ ID NO: 16700 - DNA, 20 bp, Artificial Sequence
  sgRNA
gggtcaagcatcctctaggg

SEQ ID NO: 16701 - DNA, 20 bp, Artificial Sequence
  sgRNA
ggtggcttcctgagaggtaa

SEQ ID NO: 16702 - DNA, 20 bp, Artificial Sequence
  sgRNA
ggctgcctgccttctcggcg

SEQ ID NO: 16703 - DNA, 20 bp, Artificial Sequence
  sgRNA
ggactaccagcaagcctgtg

SEQ ID NO: 16704 - DNA, 20 bp, Artificial Sequence
  sgRNA
tcgcaggctcagatagcgcg

SEQ ID NO: 16705 - DNA, 20 bp, Artificial Sequence
  sgRNA
actgcagttgcacaggagag

SEQ ID NO: 16706 - DNA, 20 bp, Artificial Sequence
  sgRNA
acgcctacctgacttctcgc

SEQ ID NO: 16707 - DNA, 20 bp, Artificial Sequence
  sgRNA
ctgccagcttctccaggttt

SEQ ID NO: 16708 - DNA, 20 bp, Artificial Sequence
  sgRNA
ctctggtctgaatcgaaact

SEQ ID NO: 16709 - DNA, 20 bp, Artificial Sequence
  sgRNA
gactgagcaacccatcctaa

SEQ ID NO: 16710 - DNA, 20 bp, Artificial Sequence
  sgRNA
gtttgagtttcatttcggat

SEQ ID NO: 16711 - DNA, 20 bp, Artificial Sequence
  sgRNA
tgcctgctcttgtgtcactg

SEQ ID NO: 16712 - DNA, 20 bp, Artificial Sequence
  sgRNA
gagctctcagtcaactttcc

SEQ ID NO: 16713 - DNA, 20 bp, Artificial Sequence
  sgRNA
gtgttggatagttcatgtca

SEQ ID NO: 16714 - DNA, 20 bp, Artificial Sequence
  sgRNA
ctgtctggactgagaacatc

SEQ ID NO: 16715 - DNA, 20 bp, Artificial Sequence
  sgRNA
gagctcccaggaggtcccag

SEQ ID NO: 16716 - DNA, 20 bp, Artificial Sequence
  sgRNA
gtacggaacagctttatagc

SEQ ID NO: 16717 - DNA, 20 bp, Artificial Sequence
  sgRNA
catcagatagcaccaaccca

SEQ ID NO: 16718 - DNA, 20 bp, Artificial Sequence
  sgRNA
cttgcctttcggacctcatt

SEQ ID NO: 16719 - DNA, 20 bp, Artificial Sequence
  sgRNA
cttcgacggatttagtttcc

SEQ ID NO: 16720 - DNA, 20 bp, Artificial Sequence
  sgRNA
gttggtcgttacccaatcgc

SEQ ID NO: 16721 - DNA, 20 bp, Artificial Sequence
  sgRNA
gggccacggagcaaagcctc

SEQ ID NO: 16722 - DNA, 20 bp, Artificial Sequence
  sgRNA
cggcggcgaggagctgttga

SEQ ID NO: 16723 - DNA, 20 bp, Artificial Sequence
  sgRNA
attatctggcctgttgcgca

SEQ ID NO: 16724 - DNA, 20 bp, Artificial Sequence
  sgRNA
aaatccaggccagcggaccc

SEQ ID NO: 16725 - DNA, 20 bp, Artificial Sequence
  sgRNA
gaaactccagtgctttccat

SEQ ID NO: 16726 - DNA, 20 bp, Artificial Sequence
  sgRNA
gcgcgagggaagaaggagcc

SEQ ID NO: 16727 - DNA, 20 bp, Artificial Sequence
  sgRNA
tcagactctgctctccttcc

SEQ ID NO: 16728 - DNA, 20 bp, Artificial Sequence
  sgRNA
tggcggaaattagagggacg

SEQ ID NO: 16729 - DNA, 20 bp, Artificial Sequence
  sgRNA
acaattcccatggtcaacta

SEQ ID NO: 16730 - DNA, 20 bp, Artificial Sequence
  sgRNA
agtgagctaaatgttaggta

SEQ ID NO: 16731 - DNA, 20 bp, Artificial Sequence
  sgRNA
taacttccgctgcaggtggg

SEQ ID NO: 16732 - DNA, 20 bp, Artificial Sequence
  sgRNA
gttcatgaccctcccatccc

SEQ ID NO: 16733 - DNA, 20 bp, Artificial Sequence
  sgRNA
ctccatggcacttccgctcg

SEQ ID NO: 16734 - DNA, 20 bp, Artificial Sequence
  sgRNA
cgtttgttcagctagcttac

SEQ ID NO: 16735 - DNA, 20 bp, Artificial Sequence
  sgRNA
tctcgtgtgtgtgaccacgt

SEQ ID NO: 16736 - DNA, 20 bp, Artificial Sequence
  sgRNA
aacggaatcagcttaccacc

SEQ ID NO: 16737 - DNA, 20 bp, Artificial Sequence
  sgRNA
ggcaggacactgctaccctc

SEQ ID NO: 16738 - DNA, 20 bp, Artificial Sequence
  sgRNA
ctgtccctacattgttctcc

SEQ ID NO: 16739 - DNA, 20 bp, Artificial Sequence
  sgRNA
cacaataaaggaactttgcc

SEQ ID NO: 16740 - DNA, 20 bp, Artificial Sequence
  sgRNA
tctgtgtggctgacgtggca

SEQ ID NO: 16741 - DNA, 20 bp, Artificial Sequence
  sgRNA
aagtacagtggagctacagc

SEQ ID NO: 16742 - DNA, 20 bp, Artificial Sequence
  sgRNA
tttgggacagtcccactaaa

SEQ ID NO: 16743 - DNA, 20 bp, Artificial Sequence
  sgRNA
taagtggctacatgggatag

SEQ ID NO: 16744 - DNA, 20 bp, Artificial Sequence
  sgRNA
tacaatcaactgacggctac

SEQ ID NO: 16745 - DNA, 20 bp, Artificial Sequence
  sgRNA
tagagaaatgtttcccacag

SEQ ID NO: 16746 - DNA, 20 bp, Artificial Sequence
  sgRNA
ctgtcttatgctaaagaagg

SEQ ID NO: 16747 - DNA, 20 bp, Artificial Sequence
  sgRNA
cacaggaagtggtgacttgt

SEQ ID NO: 16748 - DNA, 20 bp, Artificial Sequence
  sgRNA
gagagcagcggttcaacagc

SEQ ID NO: 16749 - DNA, 20 bp, Artificial Sequence
  sgRNA
agctgtttgcggcgacgatc

SEQ ID NO: 16750 - DNA, 20 bp, Artificial Sequence
  sgRNA
aatctagtgcgcatgctctt

SEQ ID NO: 16751 - DNA, 20 bp, Artificial Sequence
  sgRNA
ccttccgattgggcggcggt

SEQ ID NO: 16752 - DNA, 20 bp, Artificial Sequence
  sgRNA
ctctggcgccttcacgggcc

SEQ ID NO: 16753 - DNA, 20 bp, Artificial Sequence
  sgRNA
gcaccgcgcaagtgcgttcc

SEQ ID NO: 16754 - DNA, 20 bp, Artificial Sequence
  sgRNA
agctgtctcggcgggcgcgc

SEQ ID NO: 16755 - DNA, 20 bp, Artificial Sequence
  sgRNA
tctgaatatgagcaagtggt

SEQ ID NO: 16756 - DNA, 20 bp, Artificial Sequence
  sgRNA
ataaagggtcatacaggtag

SEQ ID NO: 16757 - DNA, 20 bp, Artificial Sequence
  sgRNA
tttggatcagatctgtactc

SEQ ID NO: 16758 - DNA, 20 bp, Artificial Sequence
  sgRNA
aggacactgctggacccgtg

SEQ ID NO: 16759 - DNA, 20 bp, Artificial Sequence
  sgRNA
ggattagcatgtgcagaatc

SEQ ID NO: 16760 - DNA, 20 bp, Artificial Sequence
  sgRNA
actagatgggccgggtgcaa

SEQ ID NO: 16761 - DNA, 20 bp, Artificial Sequence
  sgRNA
cacacggacagaggcacaac

SEQ ID NO: 16762 - DNA, 20 bp, Artificial Sequence
  sgRNA
tctgccaagttgaaggtgag

SEQ ID NO: 16763 - DNA, 20 bp, Artificial Sequence
  sgRNA
aaacaggaaagctattggtt

SEQ ID NO: 16764 - DNA, 20 bp, Artificial Sequence
  sgRNA
cgatgtttccggctctgcca

SEQ ID NO: 16765 - DNA, 20 bp, Artificial Sequence
  sgRNA
accttcccgatgaccttgag

SEQ ID NO: 16766 - DNA, 20 bp, Artificial Sequence
  sgRNA
cacgcaaccctagcgacgat

SEQ ID NO: 16767 - DNA, 20 bp, Artificial Sequence
  sgRNA
gggtctcccgcagactcagt

SEQ ID NO: 16768 - DNA, 20 bp, Artificial Sequence
  sgRNA
ccgagagtgccacgtctagc

SEQ ID NO: 16769 - DNA, 20 bp, Artificial Sequence
  sgRNA
gggtagcggaatccagaggc

SEQ ID NO: 16770 - DNA, 20 bp, Artificial Sequence
  sgRNA
agaacatacatttggaaaca

SEQ ID NO: 16771 - DNA, 20 bp, Artificial Sequence
  sgRNA
cccgcgggtgacctagattg

SEQ ID NO: 16772 - DNA, 20 bp, Artificial Sequence
  sgRNA
aggatccagccgaggaccct

SEQ ID NO: 16773 - DNA, 20 bp, Artificial Sequence
  sgRNA
tgtcgaagtcggtcccaccc

SEQ ID NO: 16774 - DNA, 20 bp, Artificial Sequence
  sgRNA
gagcgctcagacggaaggtg

SEQ ID NO: 16775 - DNA, 20 bp, Artificial Sequence
  sgRNA
ccgaggctcccggctcaggt

SEQ ID NO: 16776 - DNA, 20 bp, Artificial Sequence
  sgRNA
gctgcgaagggatgagggcg

SEQ ID NO: 16777 - DNA, 20 bp, Artificial Sequence
  sgRNA
gggcgagcgcagtgatgggc

SEQ ID NO: 16778 - DNA, 20 bp, Artificial Sequence
  sgRNA
caggattcggcgcgctctag

SEQ ID NO: 16779 - DNA, 20 bp, Artificial Sequence
  sgRNA
accggcgcgcgctgggtagc

SEQ ID NO: 16780 - DNA, 20 bp, Artificial Sequence
  sgRNA
agctcgtacttggttacttc

SEQ ID NO: 16781 - DNA, 20 bp, Artificial Sequence
  sgRNA
gacctccgggattcctagag

SEQ ID NO: 16782 - DNA, 20 bp, Artificial Sequence
  sgRNA
gattggtcagctccacaagg

SEQ ID NO: 16783 - DNA, 20 bp, Artificial Sequence
  sgRNA
ctctattagagctgggtaag

SEQ ID NO: 16784 - DNA, 20 bp, Artificial Sequence
  sgRNA
cagccattaagcgactgctg

SEQ ID NO: 16785 - DNA, 20 bp, Artificial Sequence
  sgRNA
cgagttagtggttagcacct

SEQ ID NO: 16786 - DNA, 20 bp, Artificial Sequence
  sgRNA
ttcgtcaagcagagccattt

SEQ ID NO: 16787 - DNA, 20 bp, Artificial Sequence
  sgRNA
agggcaacgctacctcctac

SEQ ID NO: 16788 - DNA, 20 bp, Artificial Sequence
  sgRNA
cctccgccgcttctcgactg

SEQ ID NO: 16789 - DNA, 20 bp, Artificial Sequence
  sgRNA
tagataaaccatttcactcc

SEQ ID NO: 16790 - DNA, 20 bp, Artificial Sequence
  sgRNA
gaggtaaagcttagaagacc

SEQ ID NO: 16791 - DNA, 20 bp, Artificial Sequence
  sgRNA
tcaactttaggtgtcaaccc

SEQ ID NO: 16792 - DNA, 20 bp, Artificial Sequence
  sgRNA
tttgggagctcgctcaccgg

SEQ ID NO: 16793 - DNA, 20 bp, Artificial Sequence
  sgRNA
caattcccagaatgcgtcag

SEQ ID NO: 16794 - DNA, 20 bp, Artificial Sequence
  sgRNA
atggaggctttagtagtctg

SEQ ID NO: 16795 - DNA, 20 bp, Artificial Sequence
  sgRNA
cgctgagagagagacaaact

SEQ ID NO: 16796 - DNA, 20 bp, Artificial Sequence
  sgRNA
agattagtctaaacaagaga

SEQ ID NO: 16797 - DNA, 20 bp, Artificial Sequence
  sgRNA
gaaggcggagcgtggtactg

SEQ ID NO: 16798 - DNA, 20 bp, Artificial Sequence
  sgRNA
gaaggaacagcaatttggtt

SEQ ID NO: 16799 - DNA, 20 bp, Artificial Sequence
  sgRNA
acaggatgcaatgctctcag

SEQ ID NO: 16800 - DNA, 20 bp, Artificial Sequence
  sgRNA
gcaaggtccttagggccttg

SEQ ID NO: 16801 - DNA, 20 bp, Artificial Sequence
  sgRNA
aaagggagggttcagcggaa

SEQ ID NO: 16802 - DNA, 20 bp, Artificial Sequence
  sgRNA
ggtgaatggagactcaatga

SEQ ID NO: 16803 - DNA, 20 bp, Artificial Sequence
  sgRNA
agcctcaattattgaaccag

SEQ ID NO: 16804 - DNA, 20 bp, Artificial Sequence
  sgRNA
acgcgaaaccggataaggac

SEQ ID NO: 16805 - DNA, 20 bp, Artificial Sequence
  sgRNA
caacagggctccaccgcttc

SEQ ID NO: 16806 - DNA, 20 bp, Artificial Sequence
  sgRNA
tctaatcatagtgagcatgc

SEQ ID NO: 16807 - DNA, 20 bp, Artificial Sequence
  sgRNA
acacagattatataatagcc

SEQ ID NO: 16808 - DNA, 20 bp, Artificial Sequence
  sgRNA
taaagctaacttaagctaac

SEQ ID NO: 16809 - DNA, 20 bp, Artificial Sequence
  sgRNA
aggatggctttggctttcaa

SEQ ID NO: 16810 - DNA, 20 bp, Artificial Sequence
  sgRNA
cagcccacaatggaagtgag

SEQ ID NO: 16811 - DNA, 20 bp, Artificial Sequence
  sgRNA
aactttccagagtctgaatg

SEQ ID NO: 16812 - DNA, 20 bp, Artificial Sequence
  sgRNA
ggagggaggatcctccgccg

SEQ ID NO: 16813 - DNA, 20 bp, Artificial Sequence
  sgRNA
atggagacgacgtctctaat

SEQ ID NO: 16814 - DNA, 20 bp, Artificial Sequence
  sgRNA
ggttaaaggcagtcccacac

SEQ ID NO: 16815 - DNA, 20 bp, Artificial Sequence
  sgRNA
cacattaccagaaatgtcct

SEQ ID NO: 16816 - DNA, 20 bp, Artificial Sequence
  sgRNA
ttatccagaaccgtcgattg

SEQ ID NO: 16817 - DNA, 20 bp, Artificial Sequence
  sgRNA
ctcacctcagcttattctca

SEQ ID NO: 16818 - DNA, 20 bp, Artificial Sequence
  sgRNA
ctgcgattgcccagcgctcc

SEQ ID NO: 16819 - DNA, 20 bp, Artificial Sequence
  sgRNA
gaggagctggtgagagtcac

SEQ ID NO: 16820 - DNA, 20 bp, Artificial Sequence
  sgRNA
cgctgggaggaccgggcggg

SEQ ID NO: 16821 - DNA, 20 bp, Artificial Sequence
  sgRNA
ggctggaatatcgtgcggcg

SEQ ID NO: 16822 - DNA, 20 bp, Artificial Sequence
  sgRNA
gcgtgaacaggaactccgcc

SEQ ID NO: 16823 - DNA, 20 bp, Artificial Sequence
  sgRNA
ggtgcggcgacgcagtgcgc

SEQ ID NO: 16824 - DNA, 20 bp, Artificial Sequence
  sgRNA
ggataggaaagagatttact

SEQ ID NO: 16825 - DNA, 20 bp, Artificial Sequence
  sgRNA
ttcaggccaggtcaagggat

SEQ ID NO: 16826 - DNA, 20 bp, Artificial Sequence
  sgRNA
tctcttagtgacccgacttc

SEQ ID NO: 16827 - DNA, 20 bp, Artificial Sequence
  sgRNA
gtttcaaagacagggcatga

SEQ ID NO: 16828 - DNA, 20 bp, Artificial Sequence
  sgRNA
taaagtggaaagtacgttag

SEQ ID NO: 16829 - DNA, 20 bp, Artificial Sequence
  sgRNA
tcaagagttcttcacggtga

SEQ ID NO: 16830 - DNA, 20 bp, Artificial Sequence
  sgRNA
ctattggctgcgccctcagg

SEQ ID NO: 16831 - DNA, 20 bp, Artificial Sequence
  sgRNA
ggaagcagaggtggtgacgg

SEQ ID NO: 16832 - DNA, 20 bp, Artificial Sequence
  sgRNA
cccttgcgctgcgaaggagg

SEQ ID NO: 16833 - DNA, 20 bp, Artificial Sequence
  sgRNA
ccttcccaagccgggcgacc

SEQ ID NO: 16834 - DNA, 20 bp, Artificial Sequence
  sgRNA
gcgcatgctcagttactctt

SEQ ID NO: 16835 - DNA, 20 bp, Artificial Sequence
  sgRNA
gacgcaatcacgctcacgag

SEQ ID NO: 16836 - DNA, 20 bp, Artificial Sequence
  sgRNA
gtcgttatgacaaccgcgtc

SEQ ID NO: 16837 - DNA, 20 bp, Artificial Sequence
  sgRNA
actgaccaattaacgtgaaa

SEQ ID NO: 16838 - DNA, 20 bp, Artificial Sequence
  sgRNA
ccaatagaagctccgggaga

SEQ ID NO: 16839 - DNA, 20 bp, Artificial Sequence
  sgRNA
gcgggaggaaggatgcaccg

SEQ ID NO: 16840 - DNA, 20 bp, Artificial Sequence
  sgRNA
tacctcccacggacgccgcg

SEQ ID NO: 16841 - DNA, 20 bp, Artificial Sequence
  sgRNA
agggcgtcctcgcggattcg

SEQ ID NO: 16842 - DNA, 20 bp, Artificial Sequence
  sgRNA
cggtagcgtgaagccacatc

SEQ ID NO: 16843 - DNA, 20 bp, Artificial Sequence
  sgRNA
acgtacacaaccaccagatc

SEQ ID NO: 16844 - DNA, 20 bp, Artificial Sequence
  sgRNA
tcgcgtccctcagttgagaa

SEQ ID NO: 16845 - DNA, 20 bp, Artificial Sequence
  sgRNA
gatgtcacccaaagggtggg

SEQ ID NO: 16846 - DNA, 20 bp, Artificial Sequence
  sgRNA
atggatgtagtgcacagaag

SEQ ID NO: 16847 - DNA, 20 bp, Artificial Sequence
  sgRNA
tctgggctctggcaagggag

SEQ ID NO: 16848 - DNA, 20 bp, Artificial Sequence
  sgRNA
ttggtttagctgctcaactt

SEQ ID NO: 16849 - DNA, 20 bp, Artificial Sequence
  sgRNA
catgttgtgcgagtcctctt

SEQ ID NO: 16850 - DNA, 20 bp, Artificial Sequence
  sgRNA
ggtgagggtagcgattcagg

SEQ ID NO: 16851 - DNA, 20 bp, Artificial Sequence
  sgRNA
ttctttggaccggaagcagg

SEQ ID NO: 16852 - DNA, 20 bp, Artificial Sequence
  sgRNA
ggcagcatctggactgcagc

SEQ ID NO: 16853 - DNA, 20 bp, Artificial Sequence
  sgRNA
agagccgagagagatgcttg

SEQ ID NO: 16854 - DNA, 20 bp, Artificial Sequence
  sgRNA
cgcaagcgtaaactacgatt

SEQ ID NO: 16855 - DNA, 20 bp, Artificial Sequence
  sgRNA
gaagggcgaggcccactgat

SEQ ID NO: 16856 - DNA, 20 bp, Artificial Sequence
  sgRNA
accaatggcagcgagcgtgg

SEQ ID NO: 16857 - DNA, 20 bp, Artificial Sequence
  sgRNA
aagtcactcaagcccaagcc

SEQ ID NO: 16858 - DNA, 20 bp, Artificial Sequence
  sgRNA
atattctctgatgacacagc

SEQ ID NO: 16859 - DNA, 20 bp, Artificial Sequence
  sgRNA
ggcctccaggtctccaactg

SEQ ID NO: 16860 - DNA, 20 bp, Artificial Sequence
  sgRNA
gtactgctccctaagctcta

SEQ ID NO: 16861 - DNA, 20 bp, Artificial Sequence
  sgRNA
cttgctcccagcagaactgg

SEQ ID NO: 16862 - DNA, 20 bp, Artificial Sequence
  sgRNA
acatgaaactaatacggaaa

SEQ ID NO: 16863 - DNA, 20 bp, Artificial Sequence
  sgRNA
cagttagagggcgcttcgtc

SEQ ID NO: 16864 - DNA, 20 bp, Artificial Sequence
  sgRNA
ggaatggactcccgtgtttg

SEQ ID NO: 16865 - DNA, 20 bp, Artificial Sequence
  sgRNA
ggcttaccgcctagtctgac

SEQ ID NO: 16866 - DNA, 20 bp, Artificial Sequence
  sgRNA
gtgtagaagggatatctgtc

SEQ ID NO: 16867 - DNA, 20 bp, Artificial Sequence
  sgRNA
cagcaccttcttgtaccctt

SEQ ID NO: 16868 - DNA, 20 bp, Artificial Sequence
  sgRNA
actctcttgcttaaccgcac

SEQ ID NO: 16869 - DNA, 20 bp, Artificial Sequence
  sgRNA
ggacactgccgaggattgta

SEQ ID NO: 16870 - DNA, 20 bp, Artificial Sequence
  sgRNA
cggactccggagctgtacac

SEQ ID NO: 16871 - DNA, 20 bp, Artificial Sequence
  sgRNA
gccggacattcgagagcggc

SEQ ID NO: 16872 - DNA, 20 bp, Artificial Sequence
  sgRNA
aaatattcagggtagagaag

SEQ ID NO: 16873 - DNA, 20 bp, Artificial Sequence
  sgRNA
ctctcatggtgtttgcaaag

SEQ ID NO: 16874 - DNA, 20 bp, Artificial Sequence
  sgRNA
ttccaccagagcaagcagga

SEQ ID NO: 16875 - DNA, 20 bp, Artificial Sequence
  sgRNA
caagactaaacgtccctgcc

SEQ ID NO: 16876 - DNA, 20 bp, Artificial Sequence
  sgRNA
aggcataaagacttaaatgc

SEQ ID NO: 16877 - DNA, 20 bp, Artificial Sequence
  sgRNA
tacttgaaagcatgcgtctg

SEQ ID NO: 16878 - DNA, 20 bp, Artificial Sequence
  sgRNA
tagaacccgcttctcgggag

SEQ ID NO: 16879 - DNA, 20 bp, Artificial Sequence
  sgRNA
tgggcgtgcctgaacgtgca

SEQ ID NO: 16880 - DNA, 20 bp, Artificial Sequence
  sgRNA
agaagggaccacagcttgtg

SEQ ID NO: 16881 - DNA, 20 bp, Artificial Sequence
  sgRNA
aacagggaggcgctaggacc

SEQ ID NO: 16882 - DNA, 20 bp, Artificial Sequence
  sgRNA
gggagtcatttatgcggagc

SEQ ID NO: 16883 - DNA, 20 bp, Artificial Sequence
  sgRNA
cctgctgtaaactccagggt

SEQ ID NO: 16884 - DNA, 20 bp, Artificial Sequence
  sgRNA
agtctgtgttgtatcttctc

SEQ ID NO: 16885 - DNA, 20 bp, Artificial Sequence
  sgRNA
tacacaatcctcgaagctgt

SEQ ID NO: 16886 - DNA, 20 bp, Artificial Sequence
  sgRNA
gcttgacagacccactgtgg

SEQ ID NO: 16887 - DNA, 20 bp, Artificial Sequence
  sgRNA
tgtagagagtgataagggtt

SEQ ID NO: 16888 - DNA, 20 bp, Artificial Sequence
  sgRNA
acacaatgagttccacattg

SEQ ID NO: 16889 - DNA, 20 bp, Artificial Sequence
  sgRNA
tctttaaatgcctgcatcaa

SEQ ID NO: 16890 - DNA, 20 bp, Artificial Sequence
  sgRNA
tggaccacccattatcactc

SEQ ID NO: 16891 - DNA, 20 bp, Artificial Sequence
  sgRNA
ccgtctcaaatatgcacaag

SEQ ID NO: 16892 - DNA, 20 bp, Artificial Sequence
  sgRNA
actgacccgagtgggtaaga

SEQ ID NO: 16893 - DNA, 20 bp, Artificial Sequence
  sgRNA
gtactggtcaagttcttaat

SEQ ID NO: 16894 - DNA, 20 bp, Artificial Sequence
  sgRNA
ttagtatggactcaactggt

SEQ ID NO: 16895 - DNA, 20 bp, Artificial Sequence
  sgRNA
agttcagaattgcatgagca

SEQ ID NO: 16896 - DNA, 20 bp, Artificial Sequence
  sgRNA
cacataatttgtagtctctc

SEQ ID NO: 16897 - DNA, 20 bp, Artificial Sequence
  sgRNA
tcttcacaactttggaaagg

SEQ ID NO: 16898 - DNA, 20 bp, Artificial Sequence
  sgRNA
taggccacttcaggtgacag

SEQ ID NO: 16899 - DNA, 20 bp, Artificial Sequence
  sgRNA
ctgggattggactaggcact

SEQ ID NO: 16900 - DNA, 20 bp, Artificial Sequence
  sgRNA
gaaaccgaagacacaatcct

SEQ ID NO: 16901 - DNA, 20 bp, Artificial Sequence
  sgRNA
tagacgtcggtggagacgtt

SEQ ID NO: 16902 - DNA, 20 bp, Artificial Sequence
  sgRNA
accgaagctttgccattccg

SEQ ID NO: 16903 - DNA, 20 bp, Artificial Sequence
  sgRNA
gtcgtttccgctcccgggag

SEQ ID NO: 16904 - DNA, 20 bp, Artificial Sequence
  sgRNA
cagaagagcgacctaccaaa

SEQ ID NO: 16905 - DNA, 20 bp, Artificial Sequence
  sgRNA
ggagccctgaagatctgcca

SEQ ID NO: 16906 - DNA, 20 bp, Artificial Sequence
  sgRNA
cgggtcacctgacgcgcaca

SEQ ID NO: 16907 - DNA, 20 bp, Artificial Sequence
  sgRNA
atataacttagcttgcaatc

SEQ ID NO: 16908 - DNA, 20 bp, Artificial Sequence
  sgRNA
gagcccaagtccctgtgtgg

SEQ ID NO: 16909 - DNA, 20 bp, Artificial Sequence
  sgRNA
cagaggccaacctgtcctct

SEQ ID NO: 16910 - DNA, 20 bp, Artificial Sequence
  sgRNA
gcatggcaaccgctctctga

SEQ ID NO: 16911 - DNA, 20 bp, Artificial Sequence
  sgRNA
tcaggtcaagcccggttctc

SEQ ID NO: 16912 - DNA, 20 bp, Artificial Sequence
  sgRNA
gctcgctgtgcgtcagagcg

SEQ ID NO: 16913 - DNA, 20 bp, Artificial Sequence
  sgRNA
tccaacgcgccatcagctgg

SEQ ID NO: 16914 - DNA, 20 bp, Artificial Sequence
  sgRNA
taccaattcaaattgaggac

SEQ ID NO: 16915 - DNA, 20 bp, Artificial Sequence
  sgRNA
tccggatgtaaagtctctaa

SEQ ID NO: 16916 - DNA, 20 bp, Artificial Sequence
  sgRNA
tctggttggtcagtagtact

SEQ ID NO: 16917 - DNA, 20 bp, Artificial Sequence
  sgRNA
gcctcccatctgaaagttaa

SEQ ID NO: 16918 - DNA, 20 bp, Artificial Sequence
  sgRNA
cgtgctccgcaatgttgtgg

SEQ ID NO: 16919 - DNA, 20 bp, Artificial Sequence
  sgRNA
gcaagacattaattgtcttc

SEQ ID NO: 16920 - DNA, 20 bp, Artificial Sequence
  sgRNA
agtaagttatccgggaccct

SEQ ID NO: 16921 - DNA, 20 bp, Artificial Sequence
  sgRNA
aggagtatatgtttaagcag

SEQ ID NO: 16922 - DNA, 20 bp, Artificial Sequence
  sgRNA
ccaaattaacccattattgt

SEQ ID NO: 16923 - DNA, 20 bp, Artificial Sequence
  sgRNA
ctgtggagggcgaaaggacg

SEQ ID NO: 16924 - DNA, 20 bp, Artificial Sequence
  sgRNA
ggcgcagaccgtgtcttacc

SEQ ID NO: 16925 - DNA, 20 bp, Artificial Sequence
  sgRNA
gctgggctatgacggcagag

SEQ ID NO: 16926 - DNA, 20 bp, Artificial Sequence
  sgRNA
ggaaagacccaggaccgctg

SEQ ID NO: 16927 - DNA, 20 bp, Artificial Sequence
  sgRNA
tcagtgctggatgtgccatg

SEQ ID NO: 16928 - DNA, 20 bp, Artificial Sequence
  sgRNA
gagtgaagtgtggccacgtg

SEQ ID NO: 16929 - DNA, 20 bp, Artificial Sequence
  sgRNA
gtgggtcttgccttaacgat

SEQ ID NO: 16930 - DNA, 20 bp, Artificial Sequence
  sgRNA
atgcgtgttacgcccgcctc

SEQ ID NO: 16931 - DNA, 20 bp, Artificial Sequence
  sgRNA
gctgtatcctaacaaacctg

SEQ ID NO: 16932 - DNA, 20 bp, Artificial Sequence
  sgRNA
tgtgcatcccagaatcgatt

SEQ ID NO: 16933 - DNA, 20 bp, Artificial Sequence
  sgRNA
ggaccgcgccttcccttgac

SEQ ID NO: 16934 - DNA, 20 bp, Artificial Sequence
  sgRNA
gcgatcttatcacccggtcc

SEQ ID NO: 16935 - DNA, 20 bp, Artificial Sequence
  sgRNA
agtgggccgctcgcccgctc

SEQ ID NO: 16936 - DNA, 20 bp, Artificial Sequence
  sgRNA
gggcagagagcagacgcccg

SEQ ID NO: 16937 - DNA, 20 bp, Artificial Sequence
  sgRNA
cgtgtgcggcggaggatcca

SEQ ID NO: 16938 - DNA, 20 bp, Artificial Sequence
  sgRNA
tcccacggtccttcgcgccc

SEQ ID NO: 16939 - DNA, 20 bp, Artificial Sequence
  sgRNA
cgtgacttccgcgtaacctg

SEQ ID NO: 16940 - DNA, 20 bp, Artificial Sequence
  sgRNA
actttaggtggagaccgaaa

SEQ ID NO: 16941 - DNA, 20 bp, Artificial Sequence
  sgRNA
aagggttgctgacagatagg

SEQ ID NO: 16942 - DNA, 20 bp, Artificial Sequence
  sgRNA
ttctataccagctgttgctc

SEQ ID NO: 16943 - DNA, 20 bp, Artificial Sequence
  sgRNA
gacagtttgatatgagctcc

SEQ ID NO: 16944 - DNA, 20 bp, Artificial Sequence
  sgRNA
aaacacaagcgagactgata

SEQ ID NO: 16945 - DNA, 20 bp, Artificial Sequence
  sgRNA
ttctgcccattctgtaagta

SEQ ID NO: 16946 - DNA, 20 bp, Artificial Sequence
  sgRNA
gcaaagggaagtacagtgat

SEQ ID NO: 16947 - DNA, 20 bp, Artificial Sequence
  sgRNA
gatgaggcaacagtggtaaa

SEQ ID NO: 16948 - DNA, 20 bp, Artificial Sequence
  sgRNA
gtatgcaaatttgtgagaaa

SEQ ID NO: 16949 - DNA, 20 bp, Artificial Sequence
  sgRNA
tctctctgctcctaaaccaa

SEQ ID NO: 16950 - DNA, 20 bp, Artificial Sequence
  sgRNA
agttcatcgattgggcactg

SEQ ID NO: 16951 - DNA, 20 bp, Artificial Sequence
  sgRNA
acagtgttgcatgcagcttc

SEQ ID NO: 16952 - DNA, 20 bp, Artificial Sequence
  sgRNA
ttgtctcaagtgtcttgtct

SEQ ID NO: 16953 - DNA, 20 bp, Artificial Sequence
  sgRNA
gacaacatggcacaagctca

SEQ ID NO: 16954 - DNA, 20 bp, Artificial Sequence
  sgRNA
gaaacaatagctcctaatag

SEQ ID NO: 16955 - DNA, 20 bp, Artificial Sequence
  sgRNA
gtggttctgccgcaatggca

SEQ ID NO: 16956 - DNA, 20 bp, Artificial Sequence
  sgRNA
atgaactattatagctcaag

SEQ ID NO: 16957 - DNA, 20 bp, Artificial Sequence
  sgRNA
gccaacacgcggcgttcccg

SEQ ID NO: 16958 - DNA, 20 bp, Artificial Sequence
  sgRNA
gcagcggcgggtcggtagag

SEQ ID NO: 16959 - DNA, 20 bp, Artificial Sequence
  sgRNA
cccgtcgcggctctagttcc

SEQ ID NO: 16960 - DNA, 20 bp, Artificial Sequence
  sgRNA
ccagctggtcaacagcattt

SEQ ID NO: 16961 - DNA, 20 bp, Artificial Sequence
  sgRNA
ggtaaatggatttgacaggc

SEQ ID NO: 16962 - DNA, 20 bp, Artificial Sequence
  sgRNA
aacttccaaatctcctgtaa

SEQ ID NO: 16963 - DNA, 20 bp, Artificial Sequence
  sgRNA
ccatgcagggcacaaagacc

SEQ ID NO: 16964 - DNA, 20 bp, Artificial Sequence
  sgRNA
cagccttgcggttcagtgct

SEQ ID NO: 16965 - DNA, 20 bp, Artificial Sequence
  sgRNA
tagaggctgaggagttcctc

SEQ ID NO: 16966 - DNA, 20 bp, Artificial Sequence
  sgRNA
tcgtggcctcgggtgccagg

SEQ ID NO: 16967 - DNA, 20 bp, Artificial Sequence
  sgRNA
ggccttgtggccacgtccac

SEQ ID NO: 16968 - DNA, 20 bp, Artificial Sequence
  sgRNA
gggcttggcagagggcctga

SEQ ID NO: 16969 - DNA, 20 bp, Artificial Sequence
  sgRNA
cagacgcgagagctgggcgg

SEQ ID NO: 16970 - DNA, 20 bp, Artificial Sequence
  sgRNA
gtcgggacgtgtgcttcact

SEQ ID NO: 16971 - DNA, 20 bp, Artificial Sequence
  sgRNA
cgagcacgacaagagcgcct

SEQ ID NO: 16972 - DNA, 20 bp, Artificial Sequence
  sgRNA
tgcttgaggctaacagggcg

SEQ ID NO: 16973 - DNA, 20 bp, Artificial Sequence
  sgRNA
gcctggactggccttgggag

SEQ ID NO: 16974 - DNA, 20 bp, Artificial Sequence
  sgRNA
tacaagtcccagtaagccct

SEQ ID NO: 16975 - DNA, 20 bp, Artificial Sequence
  sgRNA
acggacgccctgtggtttgc

SEQ ID NO: 16976 - DNA, 20 bp, Artificial Sequence
  sgRNA
tccattaggtggcgcaggtg

SEQ ID NO: 16977 - DNA, 20 bp, Artificial Sequence
  sgRNA
ggtacagtcaacaggtgcgt

SEQ ID NO: 16978 - DNA, 20 bp, Artificial Sequence
  sgRNA
tgcaacattaactgtgtcta

SEQ ID NO: 16979 - DNA, 20 bp, Artificial Sequence
  sgRNA
aacctcagtaattctagaca

SEQ ID NO: 16980 - DNA, 20 bp, Artificial Sequence
  sgRNA
aggatacaggagacattaca

SEQ ID NO: 16981 - DNA, 20 bp, Artificial Sequence
  sgRNA
cactcgtattcattgtccaa

SEQ ID NO: 16982 - DNA, 20 bp, Artificial Sequence
  sgRNA
ttgataaggcaacaacttaa

SEQ ID NO: 16983 - DNA, 20 bp, Artificial Sequence
  sgRNA
acaacagcaacaacaacttt

SEQ ID NO: 16984 - DNA, 20 bp, Artificial Sequence
  sgRNA
atgtcatggagctaggtacc

SEQ ID NO: 16985 - DNA, 20 bp, Artificial Sequence
  sgRNA
gggtcagatttgacgtcaca

SEQ ID NO: 16986 - DNA, 20 bp, Artificial Sequence
  sgRNA
cagggacccttcatcttata

SEQ ID NO: 16987 - DNA, 20 bp, Artificial Sequence
  sgRNA
gaggtgccggtggtcacgtg

SEQ ID NO: 16988 - DNA, 20 bp, Artificial Sequence
  sgRNA
gcaaccggtcccgaagcacc

SEQ ID NO: 16989 - DNA, 20 bp, Artificial Sequence
  sgRNA
tcacgacctgagttctcgcg

SEQ ID NO: 16990 - DNA, 20 bp, Artificial Sequence
  sgRNA
gtcctcggtccgccgggtcc

SEQ ID NO: 16991 - DNA, 20 bp, Artificial Sequence
  sgRNA
cgcccgggactgtccgcgag

SEQ ID NO: 16992 - DNA, 20 bp, Artificial Sequence
  sgRNA
gaggtctcagggcgcagatg

SEQ ID NO: 16993 - DNA, 20 bp, Artificial Sequence
  sgRNA
aatcgagtcacgggattatt

SEQ ID NO: 16994 - DNA, 20 bp, Artificial Sequence
  sgRNA
gtgaagtttacgaggaggga

SEQ ID NO: 16995 - DNA, 20 bp, Artificial Sequence
  sgRNA
gagccatttctctggaatgg

SEQ ID NO: 16996 - DNA, 20 bp, Artificial Sequence
  sgRNA
ggcaacagtggtaagaggag

SEQ ID NO: 16997 - DNA, 20 bp, Artificial Sequence
  sgRNA
atcatatgacctgtggcaaa

SEQ ID NO: 16998 - DNA, 20 bp, Artificial Sequence
  sgRNA
gaaatacaactgaaatgatg

SEQ ID NO: 16999 - DNA, 20 bp, Artificial Sequence
  sgRNA
actcggcagacacgttgagg

SEQ ID NO: 17000 - DNA, 20 bp, Artificial Sequence
  sgRNA
tctgataacaggaataggag

SEQ ID NO: 17001 - DNA, 20 bp, Artificial Sequence
  sgRNA
atatttctaaggcctaagtc

SEQ ID NO: 17002 - DNA, 20 bp, Artificial Sequence
  sgRNA
gcatggaaattcatcagaca

SEQ ID NO: 17003 - DNA, 20 bp, Artificial Sequence
  sgRNA
cgtggtggagaacacaagtt

SEQ ID NO: 17004 - DNA, 20 bp, Artificial Sequence
  sgRNA
acaccggagacacactctgt

SEQ ID NO: 17005 - DNA, 20 bp, Artificial Sequence
  sgRNA
gcatggctaactttcagaaa

SEQ ID NO: 17006 - DNA, 20 bp, Artificial Sequence
  sgRNA
tatatcaacttcctgtcaaa

SEQ ID NO: 17007 - DNA, 20 bp, Artificial Sequence
  sgRNA
ggcagtgacaacagctagga

SEQ ID NO: 17008 - DNA, 20 bp, Artificial Sequence
  sgRNA
ctaccggttcggtgcggcct

SEQ ID NO: 17009 - DNA, 20 bp, Artificial Sequence
  sgRNA
agtagagttgtgttggtctc

SEQ ID NO: 17010 - DNA, 20 bp, Artificial Sequence
  sgRNA
aaatgcggctggtctgtgcg

SEQ ID NO: 17011 - DNA, 20 bp, Artificial Sequence
  sgRNA
tgcttctgtttctaacccga

SEQ ID NO: 17012 - DNA, 20 bp, Artificial Sequence
  sgRNA
tttgaattgacccttaagtc

SEQ ID NO: 17013 - DNA, 20 bp, Artificial Sequence
  sgRNA
tgacattaagtactcagtgt

SEQ ID NO: 17014 - DNA, 20 bp, Artificial Sequence
  sgRNA
ctccaatgctgggttaaacc

SEQ ID NO: 17015 - DNA, 20 bp, Artificial Sequence
  sgRNA
ggagaagcgtcatcagtatc

SEQ ID NO: 17016 - DNA, 20 bp, Artificial Sequence
  sgRNA
agaggaagaatgagcccagg

SEQ ID NO: 17017 - DNA, 20 bp, Artificial Sequence
  sgRNA
cattctctttccaaatatag

SEQ ID NO: 17018 - DNA, 20 bp, Artificial Sequence
  sgRNA
tgacaccacaggctgagaac

SEQ ID NO: 17019 - DNA, 20 bp, Artificial Sequence
  sgRNA
ctccctgtggtggaggctcg

SEQ ID NO: 17020 - DNA, 20 bp, Artificial Sequence
  sgRNA
gagcaatacagcaggagtcg

SEQ ID NO: 17021 - DNA, 20 bp, Artificial Sequence
  sgRNA
ctgctcacagcaggtagaac

SEQ ID NO: 17022 - DNA, 20 bp, Artificial Sequence
  sgRNA
tatatggagccatcagcatc

SEQ ID NO: 17023 - DNA, 20 bp, Artificial Sequence
  sgRNA
gctaataacactcctatttg

SEQ ID NO: 17024 - DNA, 20 bp, Artificial Sequence
  sgRNA
ccttcttaatggtatacttg

SEQ ID NO: 17025 - DNA, 20 bp, Artificial Sequence
  sgRNA
ggtgaatggagacacaatga

SEQ ID NO: 17026 - DNA, 20 bp, Artificial Sequence
  sgRNA
tgactttaactgggagggtg

SEQ ID NO: 17027 - DNA, 20 bp, Artificial Sequence
  sgRNA
aaagggaggattcagctaaa

SEQ ID NO: 17028 - DNA, 20 bp, Artificial Sequence
  sgRNA
tcgtcgacagtgtgcgtgtg

SEQ ID NO: 17029 - DNA, 20 bp, Artificial Sequence
  sgRNA
tgccgcactgtggtttcctg

SEQ ID NO: 17030 - DNA, 20 bp, Artificial Sequence
  sgRNA
caccgctgtggttcacacgg

SEQ ID NO: 17031 - DNA, 20 bp, Artificial Sequence
  sgRNA
aggtttagggtctatggact

SEQ ID NO: 17032 - DNA, 20 bp, Artificial Sequence
  sgRNA
gcgcttaccgcctcttatgc

SEQ ID NO: 17033 - DNA, 20 bp, Artificial Sequence
  sgRNA
aggagagtctgtgcagatcc

SEQ ID NO: 17034 - DNA, 20 bp, Artificial Sequence
  sgRNA
tgcatctggcatcaaggcac

SEQ ID NO: 17035 - DNA, 20 bp, Artificial Sequence
  sgRNA
gggaagtatatctgttaatt

SEQ ID NO: 17036 - DNA, 20 bp, Artificial Sequence
  sgRNA
tggtgaagactcagcacagc

SEQ ID NO: 17037 - DNA, 20 bp, Artificial Sequence
  sgRNA
gcttgttgctcccgagaagg

SEQ ID NO: 17038 - DNA, 20 bp, Artificial Sequence
  sgRNA
cccgagctagagacgccgtc

SEQ ID NO: 17039 - DNA, 20 bp, Artificial Sequence
  sgRNA
gggacagggaggcctcccgg

SEQ ID NO: 17040 - DNA, 20 bp, Artificial Sequence
  sgRNA
agcgagcgttccgagagcga

SEQ ID NO: 17041 - DNA, 20 bp, Artificial Sequence
  sgRNA
aggatccagatagcgcgaga

SEQ ID NO: 17042 - DNA, 20 bp, Artificial Sequence
  sgRNA
ggtacgaggctcatcccgcg

SEQ ID NO: 17043 - DNA, 20 bp, Artificial Sequence
  sgRNA
cacaaggaaacctccaggcc

SEQ ID NO: 17044 - DNA, 20 bp, Artificial Sequence
  sgRNA
gccaggccagggtgggaccc

SEQ ID NO: 17045 - DNA, 20 bp, Artificial Sequence
  sgRNA
ttggtctgctggcgactcac

SEQ ID NO: 17046 - DNA, 20 bp, Artificial Sequence
  sgRNA
tgcgtggaatcccgcagtaa

SEQ ID NO: 17047 - DNA, 20 bp, Artificial Sequence
  sgRNA
ctgtgccgctgagccactcg

SEQ ID NO: 17048 - DNA, 20 bp, Artificial Sequence
  sgRNA
ccaacctgccaagaaacagg

SEQ ID NO: 17049 - DNA, 20 bp, Artificial Sequence
  sgRNA
gcggactccagtggccctcc

SEQ ID NO: 17050 - DNA, 20 bp, Artificial Sequence
  sgRNA
cgccggtcctgcccaacttg

SEQ ID NO: 17051 - DNA, 20 bp, Artificial Sequence
  sgRNA
gggaggcgctgaagtgggta

SEQ ID NO: 17052 - DNA, 20 bp, Artificial Sequence
  sgRNA
aaagaggtactgaagttcat

SEQ ID NO: 17053 - DNA, 20 bp, Artificial Sequence
  sgRNA
gaagacacactcctgcagag

SEQ ID NO: 17054 - DNA, 20 bp, Artificial Sequence
  sgRNA
tttgctttgttgacaaggag

SEQ ID NO: 17055 - DNA, 20 bp, Artificial Sequence
  sgRNA
cacctaccagtctgcggtaa

SEQ ID NO: 17056 - DNA, 20 bp, Artificial Sequence
  sgRNA
tctcaggagcgttatctccg

SEQ ID NO: 17057 - DNA, 20 bp, Artificial Sequence
  sgRNA
caggctcttcacctgcccat

SEQ ID NO: 17058 - DNA, 20 bp, Artificial Sequence
  sgRNA
ccttctttaactgccctgtt

SEQ ID NO: 17059 - DNA, 20 bp, Artificial Sequence
  sgRNA
gcatggagaggctcagacac

SEQ ID NO: 17060 - DNA, 20 bp, Artificial Sequence
  sgRNA
tccaagatgtgtactgggag

SEQ ID NO: 17061 - DNA, 20 bp, Artificial Sequence
  sgRNA
cccgcgccgctcagcagttc

SEQ ID NO: 17062 - DNA, 20 bp, Artificial Sequence
  sgRNA
tggcgggaacacccaaaccc

SEQ ID NO: 17063 - DNA, 20 bp, Artificial Sequence
  sgRNA
gtctccagggcgccacctcg

SEQ ID NO: 17064 - DNA, 20 bp, Artificial Sequence
  sgRNA
ggatgggaaagaggttatga

SEQ ID NO: 17065 - DNA, 20 bp, Artificial Sequence
  sgRNA
caggaagtgtagtgcacttt

SEQ ID NO: 17066 - DNA, 20 bp, Artificial Sequence
  sgRNA
cttacagcgccttaattgcc

SEQ ID NO: 17067 - DNA, 20 bp, Artificial Sequence
  sgRNA
agcggcgcctgtgaggtcag

SEQ ID NO: 17068 - DNA, 20 bp, Artificial Sequence
  sgRNA
tctcgagcgcatataagcct

SEQ ID NO: 17069 - DNA, 20 bp, Artificial Sequence
  sgRNA
ccgcccgctttccggaaacc

SEQ ID NO: 17070 - DNA, 20 bp, Artificial Sequence
  sgRNA
tcggaacagaaggcgctgcg

SEQ ID NO: 17071 - DNA, 20 bp, Artificial Sequence
  sgRNA
acgacacagggaccgaggtt

SEQ ID NO: 17072 - DNA, 20 bp, Artificial Sequence
  sgRNA
ctcatcgctggagagcacgc

SEQ ID NO: 17073 - DNA, 20 bp, Artificial Sequence
  sgRNA
agaggaaatgatcggccgaa

SEQ ID NO: 17074 - DNA, 20 bp, Artificial Sequence
  sgRNA
ggcgtgggtctcagcattat

SEQ ID NO: 17075 - DNA, 20 bp, Artificial Sequence
  sgRNA
taggaagtcagagcccattg

SEQ ID NO: 17076 - DNA, 20 bp, Artificial Sequence
  sgRNA
gccggctgttaagactcctg

SEQ ID NO: 17077 - DNA, 20 bp, Artificial Sequence
  sgRNA
ccgccaccacgcctttatga

SEQ ID NO: 17078 - DNA, 20 bp, Artificial Sequence
  sgRNA
ctttgcagaatagtgcgcca

SEQ ID NO: 17079 - DNA, 20 bp, Artificial Sequence
  sgRNA
tggacagactggatgatttc

SEQ ID NO: 17080 - DNA, 20 bp, Artificial Sequence
  sgRNA
ggagggaggagaccttggtg

SEQ ID NO: 17081 - DNA, 20 bp, Artificial Sequence
  sgRNA
ggcttgtgtagaacagaggt

SEQ ID NO: 17082 - DNA, 20 bp, Artificial Sequence
  sgRNA
atctgcagtcggacttgcat

SEQ ID NO: 17083 - DNA, 20 bp, Artificial Sequence
  sgRNA
tcagtttcgcttctgtgaac

SEQ ID NO: 17084 - DNA, 20 bp, Artificial Sequence
  sgRNA
gactatgatttgcgaggagg

SEQ ID NO: 17085 - DNA, 20 bp, Artificial Sequence
  sgRNA
ggcgcgccatgcaaatgaga

SEQ ID NO: 17086 - DNA, 20 bp, Artificial Sequence
  sgRNA
cactgggagccggcagagtt

SEQ ID NO: 17087 - DNA, 20 bp, Artificial Sequence
  sgRNA
tgaaagcagcctgagcgcgg

SEQ ID NO: 17088 - DNA, 20 bp, Artificial Sequence
  sgRNA
ggtgttgtgccgtctgcgcc

SEQ ID NO: 17089 - DNA, 20 bp, Artificial Sequence
  sgRNA
gccacccgaccgctccctcg

SEQ ID NO: 17090 - DNA, 20 bp, Artificial Sequence
  sgRNA
gggcgtggacgcgcgtgtgc

SEQ ID NO: 17091 - DNA, 20 bp, Artificial Sequence
  sgRNA
gctgcgatatgaatttcttc

SEQ ID NO: 17092 - DNA, 20 bp, Artificial Sequence
  sgRNA
ctccttatcaaatagggatc

SEQ ID NO: 17093 - DNA, 20 bp, Artificial Sequence
  sgRNA
agtcaaagttcagcaggaaa

SEQ ID NO: 17094 - DNA, 20 bp, Artificial Sequence
  sgRNA
ctgcaaggatcagcttgtca

SEQ ID NO: 17095 - DNA, 20 bp, Artificial Sequence
  sgRNA
ggctgggaggagacacctat

SEQ ID NO: 17096 - DNA, 20 bp, Artificial Sequence
  sgRNA
tccactctgaacgaacctgt

SEQ ID NO: 17097 - DNA, 20 bp, Artificial Sequence
  sgRNA
ttgacttcatgcatggcact

SEQ ID NO: 17098 - DNA, 20 bp, Artificial Sequence
  sgRNA
tatctggtcaggaatcatta

SEQ ID NO: 17099 - DNA, 20 bp, Artificial Sequence
  sgRNA
tttctctgttcattcctatg

SEQ ID NO: 17100 - DNA, 20 bp, Artificial Sequence
  sgRNA
gggtgagatctgtcggagag

SEQ ID NO: 17101 - DNA, 20 bp, Artificial Sequence
  sgRNA
agccagcaggcctcagcatc

SEQ ID NO: 17102 - DNA, 20 bp, Artificial Sequence
  sgRNA
ttcataatgaagctgtgggc

SEQ ID NO: 17103 - DNA, 20 bp, Artificial Sequence
  sgRNA
gggttgtcaagagcaacggg

SEQ ID NO: 17104 - DNA, 20 bp, Artificial Sequence
  sgRNA
catgcttgttgtaaagtcgg

SEQ ID NO: 17105 - DNA, 20 bp, Artificial Sequence
  sgRNA
agccagtaggcacatagcag

SEQ ID NO: 17106 - DNA, 20 bp, Artificial Sequence
  sgRNA
agccaatcaaattaggagtt

SEQ ID NO: 17107 - DNA, 20 bp, Artificial Sequence
  sgRNA
gttaggaacctctagccagt

SEQ ID NO: 17108 - DNA, 20 bp, Artificial Sequence
  sgRNA
tttggcgtactgcttccggc

SEQ ID NO: 17109 - DNA, 20 bp, Artificial Sequence
  sgRNA
aagtgtttgcggctataggc

SEQ ID NO: 17110 - DNA, 20 bp, Artificial Sequence
  sgRNA
cctaaagttccgccacacac

SEQ ID NO: 17111 - DNA, 20 bp, Artificial Sequence
  sgRNA
acactgtgtacaggctcccg

SEQ ID NO: 17112 - DNA, 20 bp, Artificial Sequence
  sgRNA
attggctacgctcgggatgg

SEQ ID NO: 17113 - DNA, 20 bp, Artificial Sequence
  sgRNA
gaataagtgagccacactac

SEQ ID NO: 17114 - DNA, 20 bp, Artificial Sequence
  sgRNA
tcaaggtgacattgtttccc

SEQ ID NO: 17115 - DNA, 20 bp, Artificial Sequence
  sgRNA
gaacaggatgtgttcttcaa

SEQ ID NO: 17116 - DNA, 20 bp, Artificial Sequence
  sgRNA
taattcatcttgtctggctg

SEQ ID NO: 17117 - DNA, 20 bp, Artificial Sequence
  sgRNA
agggtcactacagttgggca

SEQ ID NO: 17118 - DNA, 20 bp, Artificial Sequence
  sgRNA
cccagcttagggctgttaga

SEQ ID NO: 17119 - DNA, 20 bp, Artificial Sequence
  sgRNA
aagaggccttatatagtagg

SEQ ID NO: 17120 - DNA, 20 bp, Artificial Sequence
  sgRNA
tagcatagtgtaccctgacc

SEQ ID NO: 17121 - DNA, 20 bp, Artificial Sequence
  sgRNA
aaatcaagatgctttcagcc

SEQ ID NO: 17122 - DNA, 20 bp, Artificial Sequence
  sgRNA
accatagaatattcatcaca

SEQ ID NO: 17123 - DNA, 20 bp, Artificial Sequence
  sgRNA
tgaggttcaggcccttagag

SEQ ID NO: 17124 - DNA, 20 bp, Artificial Sequence
  sgRNA
aacttagagtcacggaggcg

SEQ ID NO: 17125 - DNA, 20 bp, Artificial Sequence
  sgRNA
gaacttccggcttctcacta

SEQ ID NO: 17126 - DNA, 20 bp, Artificial Sequence
  sgRNA
tcaggactcactattccctc

SEQ ID NO: 17127 - DNA, 20 bp, Artificial Sequence
  sgRNA
ggcagatggtgccagcttcc

SEQ ID NO: 17128 - DNA, 20 bp, Artificial Sequence
  sgRNA
agtcccgtttcttgttccct

SEQ ID NO: 17129 - DNA, 20 bp, Artificial Sequence
  sgRNA
ctcgcgggcagatgcaggtg

SEQ ID NO: 17130 - DNA, 20 bp, Artificial Sequence
  sgRNA
ggagggaagggaagaccggt

SEQ ID NO: 17131 - DNA, 20 bp, Artificial Sequence
  sgRNA
acaaagcacacgggcggcgc

SEQ ID NO: 17132 - DNA, 20 bp, Artificial Sequence
  sgRNA
ggaattcgatccgttacttc

SEQ ID NO: 17133 - DNA, 20 bp, Artificial Sequence
  sgRNA
gggcgatccgagcttgctac

SEQ ID NO: 17134 - DNA, 20 bp, Artificial Sequence
  sgRNA
tttcccagggtccaccgcac

SEQ ID NO: 17135 - DNA, 20 bp, Artificial Sequence
  sgRNA
caagcgccgctctagccgct

SEQ ID NO: 17136 - DNA, 20 bp, Artificial Sequence
  sgRNA
tctcggagctctcggcggag

SEQ ID NO: 17137 - DNA, 20 bp, Artificial Sequence
  sgRNA
ccgaggcgcgcgggccatcc

SEQ ID NO: 17138 - DNA, 20 bp, Artificial Sequence
  sgRNA
gtgcggtagaaagtctccgg

SEQ ID NO: 17139 - DNA, 20 bp, Artificial Sequence
  sgRNA
aacgacgggacaaataggag

SEQ ID NO: 17140 - DNA, 20 bp, Artificial Sequence
  sgRNA
gatagagactggactggaaa

SEQ ID NO: 17141 - DNA, 20 bp, Artificial Sequence
  sgRNA
tgaaatctgccatcttacct

SEQ ID NO: 17142 - DNA, 20 bp, Artificial Sequence
  sgRNA
gcaagcccagataaacacca

SEQ ID NO: 17143 - DNA, 20 bp, Artificial Sequence
  sgRNA
ctaaggaaagggtcaccggg

SEQ ID NO: 17144 - DNA, 20 bp, Artificial Sequence
  sgRNA
tacttgcttaacagtccaga

SEQ ID NO: 17145 - DNA, 20 bp, Artificial Sequence
  sgRNA
tagagaaagcatatgaggag

SEQ ID NO: 17146 - DNA, 20 bp, Artificial Sequence
  sgRNA
acttcctgaggtgctccagc

SEQ ID NO: 17147 - DNA, 20 bp, Artificial Sequence
  sgRNA
gtcacctgtttgggacgcca

SEQ ID NO: 17148 - DNA, 20 bp, Artificial Sequence
  sgRNA
tgcttggcaaggaacgccac

SEQ ID NO: 17149 - DNA, 20 bp, Artificial Sequence
  sgRNA
tcctgaatcgccctcgcaat

SEQ ID NO: 17150 - DNA, 20 bp, Artificial Sequence
  sgRNA
gactgaggtggaggcctggg

SEQ ID NO: 17151 - DNA, 20 bp, Artificial Sequence
  sgRNA
ttgaacaggatcgtccaagg

SEQ ID NO: 17152 - DNA, 20 bp, Artificial Sequence
  sgRNA
agagtgcgagggcgaccagg

SEQ ID NO: 17153 - DNA, 20 bp, Artificial Sequence
  sgRNA
acgtgccttcagcagtgaca

SEQ ID NO: 17154 - DNA, 20 bp, Artificial Sequence
  sgRNA
gaccctagacacccgcatag

SEQ ID NO: 17155 - DNA, 20 bp, Artificial Sequence
  sgRNA
cctccagagaaagtactttc

SEQ ID NO: 17156 - DNA, 20 bp, Artificial Sequence
  sgRNA
cagtgaccacatgaaccttg

SEQ ID NO: 17157 - DNA, 20 bp, Artificial Sequence
  sgRNA
gtttgcccgaagcactctgt

SEQ ID NO: 17158 - DNA, 20 bp, Artificial Sequence
  sgRNA
gaaacagtacttccggcctc

SEQ ID NO: 17159 - DNA, 20 bp, Artificial Sequence
  sgRNA
cgcgttcgaactggcgcttg

SEQ ID NO: 17160 - DNA, 20 bp, Artificial Sequence
  sgRNA
ggcggttcattctccaccaa

SEQ ID NO: 17161 - DNA, 20 bp, Artificial Sequence
  sgRNA
cctgtcacctctcctctaaa

SEQ ID NO: 17162 - DNA, 20 bp, Artificial Sequence
  sgRNA
ggagtatgggttaactaatg

SEQ ID NO: 17163 - DNA, 20 bp, Artificial Sequence
  sgRNA
agatggacccggtggagcgc

SEQ ID NO: 17164 - DNA, 20 bp, Artificial Sequence
  sgRNA
ggagcatgcgtattagccga

SEQ ID NO: 17165 - DNA, 20 bp, Artificial Sequence
  sgRNA
aaccgaacccagggtcgagg

SEQ ID NO: 17166 - DNA, 20 bp, Artificial Sequence
  sgRNA
cagggcgcgcgtgtgagtcc

SEQ ID NO: 17167 - DNA, 20 bp, Artificial Sequence
  sgRNA
agactgcgggtcctgccctt

SEQ ID NO: 17168 - DNA, 20 bp, Artificial Sequence
  sgRNA
cataagctgcctgccagtgg

SEQ ID NO: 17169 - DNA, 20 bp, Artificial Sequence
  sgRNA
ttgtctcaattatgcaaagt

SEQ ID NO: 17170 - DNA, 20 bp, Artificial Sequence
  sgRNA
gttctcacatttcaccttgc

SEQ ID NO: 17171 - DNA, 20 bp, Artificial Sequence
  sgRNA
atgactaatctgtgtccatg

SEQ ID NO: 17172 - DNA, 20 bp, Artificial Sequence
  sgRNA
tttacatcatttagcaggga

SEQ ID NO: 17173 - DNA, 20 bp, Artificial Sequence
  sgRNA
tactaggcaatttggcattg

SEQ ID NO: 17174 - DNA, 20 bp, Artificial Sequence
  sgRNA
acttgatctccctgtataaa

SEQ ID NO: 17175 - DNA, 20 bp, Artificial Sequence
  sgRNA
taacttctgaaatgtgaatc

SEQ ID NO: 17176 - DNA, 20 bp, Artificial Sequence
  sgRNA
ctgatgcccactcaagcttc

SEQ ID NO: 17177 - DNA, 20 bp, Artificial Sequence
  sgRNA
ggagccacgcttcgggcatc

SEQ ID NO: 17178 - DNA, 20 bp, Artificial Sequence
  sgRNA
agtttgagtaagggcaagaa

SEQ ID NO: 17179 - DNA, 20 bp, Artificial Sequence
  sgRNA
ggcccgcggagccatctgat

SEQ ID NO: 17180 - DNA, 20 bp, Artificial Sequence
  sgRNA
gatgtgggaccagtccttgg

SEQ ID NO: 17181 - DNA, 20 bp, Artificial Sequence
  sgRNA
tcacgccttacctgcagagc

SEQ ID NO: 17182 - DNA, 20 bp, Artificial Sequence
  sgRNA
ataaatagttcagcaaacag

SEQ ID NO: 17183 - DNA, 20 bp, Artificial Sequence
  sgRNA
tactagtgtaacagagtcct

SEQ ID NO: 17184 - DNA, 20 bp, Artificial Sequence
  sgRNA
tttcgggcaatttcccgctg

SEQ ID NO: 17185 - DNA, 20 bp, Artificial Sequence
  sgRNA
ccagatatgggcgtgtcctg

SEQ ID NO: 17186 - DNA, 20 bp, Artificial Sequence
  sgRNA
tgcagagccctcggcggtcg

SEQ ID NO: 17187 - DNA, 20 bp, Artificial Sequence
  sgRNA
agcagagtgtgcaccgggct

SEQ ID NO: 17188 - DNA, 20 bp, Artificial Sequence
  sgRNA
ggagctgggcgtcgccatcc

SEQ ID NO: 17189 - DNA, 20 bp, Artificial Sequence
  sgRNA
ggctgggcccttgcttcctc

SEQ ID NO: 17190 - DNA, 20 bp, Artificial Sequence
  sgRNA
gagacagaagcccaggcctg

SEQ ID NO: 17191 - DNA, 20 bp, Artificial Sequence
  sgRNA
ggttcccagctgggctgtgc

SEQ ID NO: 17192 - DNA, 20 bp, Artificial Sequence
  sgRNA
attggcataaggctattagg

SEQ ID NO: 17193 - DNA, 20 bp, Artificial Sequence
  sgRNA
gcgtttgtgcccatctctgt

SEQ ID NO: 17194 - DNA, 20 bp, Artificial Sequence
  sgRNA
tggtgataggaaagggtaca

SEQ ID NO: 17195 - DNA, 20 bp, Artificial Sequence
  sgRNA
agtgaggcaagtctctgaag

SEQ ID NO: 17196 - DNA, 20 bp, Artificial Sequence
  sgRNA
cctcttccgtttcaaatttc

SEQ ID NO: 17197 - DNA, 20 bp, Artificial Sequence
  sgRNA
gggcctaacactgggcttgc

SEQ ID NO: 17198 - DNA, 20 bp, Artificial Sequence
  sgRNA
agacttctgacctctatacc

SEQ ID NO: 17199 - DNA, 20 bp, Artificial Sequence
  sgRNA
ggaggtagcagggtcagaca

SEQ ID NO: 17200 - DNA, 20 bp, Artificial Sequence
  sgRNA
gggtaactgggccagattcc

SEQ ID NO: 17201 - DNA, 20 bp, Artificial Sequence
  sgRNA
tcaggaactggctatattag

SEQ ID NO: 17202 - DNA, 20 bp, Artificial Sequence
  sgRNA
tctatgtgtgtctatgggag

SEQ ID NO: 17203 - DNA, 20 bp, Artificial Sequence
  sgRNA
caacaattcttacccagtat

SEQ ID NO: 17204 - DNA, 20 bp, Artificial Sequence
  sgRNA
gctgagccgcgcctgcgcat

SEQ ID NO: 17205 - DNA, 20 bp, Artificial Sequence
  sgRNA
tttaatttccgcccacgctg

SEQ ID NO: 17206 - DNA, 20 bp, Artificial Sequence
  sgRNA
gcaccgcgaccgcagcgagg

SEQ ID NO: 17207 - DNA, 20 bp, Artificial Sequence
  sgRNA
cgggctgtggagagagagcg

SEQ ID NO: 17208 - DNA, 20 bp, Artificial Sequence
  sgRNA
cgtgaaagtgactgcggagc

SEQ ID NO: 17209 - DNA, 20 bp, Artificial Sequence
  sgRNA
cctacggcggcccggcctcg

SEQ ID NO: 17210 - DNA, 20 bp, Artificial Sequence
  sgRNA
ttacccaaatgtttgaaaga

SEQ ID NO: 17211 - DNA, 20 bp, Artificial Sequence
  sgRNA
tgcaggctgccactagctca

SEQ ID NO: 17212 - DNA, 20 bp, Artificial Sequence
  sgRNA
gtttactttcactgcccatc

SEQ ID NO: 17213 - DNA, 20 bp, Artificial Sequence
  sgRNA
tgggcacagagcgagggcga

SEQ ID NO: 17214 - DNA, 20 bp, Artificial Sequence
  sgRNA
aagaggccgcctgcctggca

SEQ ID NO: 17215 - DNA, 20 bp, Artificial Sequence
  sgRNA
caggcacagcaggcgtggag

SEQ ID NO: 17216 - DNA, 20 bp, Artificial Sequence
  sgRNA
cagcacaaattcccttagaa

SEQ ID NO: 17217 - DNA, 20 bp, Artificial Sequence
  sgRNA
ccacagttgggctttggccc

SEQ ID NO: 17218 - DNA, 20 bp, Artificial Sequence
  sgRNA
ctgagggacagcagacagca

SEQ ID NO: 17219 - DNA, 20 bp, Artificial Sequence
  sgRNA
cgcgtctggccacacccacc

SEQ ID NO: 17220 - DNA, 20 bp, Artificial Sequence
  sgRNA
tggaggccgtgagacaagcc

SEQ ID NO: 17221 - DNA, 20 bp, Artificial Sequence
  sgRNA
aagggaggcgggagtcaggt

SEQ ID NO: 17222 - DNA, 20 bp, Artificial Sequence
  sgRNA
gagctcagtaaacacggcag

SEQ ID NO: 17223 - DNA, 20 bp, Artificial Sequence
  sgRNA
ttcagcctttatactcgatt

SEQ ID NO: 17224 - DNA, 20 bp, Artificial Sequence
  sgRNA
gagcataaattaaagagaac

SEQ ID NO: 17225 - DNA, 20 bp, Artificial Sequence
  sgRNA
cggtgaagtgtctaggccgc

SEQ ID NO: 17226 - DNA, 20 bp, Artificial Sequence
  sgRNA
tgactcagctcacaaggcag

SEQ ID NO: 17227 - DNA, 20 bp, Artificial Sequence
  sgRNA
tgtggatgggtcatgactca

SEQ ID NO: 17228 - DNA, 20 bp, Artificial Sequence
  sgRNA
caaggagttatttgtagagc

SEQ ID NO: 17229 - DNA, 20 bp, Artificial Sequence
  sgRNA
ccaagttggaaagaaacttc

SEQ ID NO: 17230 - DNA, 20 bp, Artificial Sequence
  sgRNA
agaattcagattggattcta

SEQ ID NO: 17231 - DNA, 20 bp, Artificial Sequence
  sgRNA
cgaagccttcagtcattctg

SEQ ID NO: 17232 - DNA, 20 bp, Artificial Sequence
  sgRNA
tgtcaccaacaacaactctt

SEQ ID NO: 17233 - DNA, 20 bp, Artificial Sequence
  sgRNA
cttacatgatcgcctcacca

SEQ ID NO: 17234 - DNA, 20 bp, Artificial Sequence
  sgRNA
cccaacggatttaagcaaag

SEQ ID NO: 17235 - DNA, 20 bp, Artificial Sequence
  sgRNA
caataaggaggagcttcccg

SEQ ID NO: 17236 - DNA, 20 bp, Artificial Sequence
  sgRNA
aagtgctgcccggtggctgc

SEQ ID NO: 17237 - DNA, 20 bp, Artificial Sequence
  sgRNA
agagagcacggctaccgccc

SEQ ID NO: 17238 - DNA, 20 bp, Artificial Sequence
  sgRNA
cctatcatggcaaatagcca

SEQ ID NO: 17239 - DNA, 20 bp, Artificial Sequence
  sgRNA
ctttgtatgataggccttat

SEQ ID NO: 17240 - DNA, 20 bp, Artificial Sequence
  sgRNA
tcttctgggaagaatgttca

SEQ ID NO: 17241 - DNA, 20 bp, Artificial Sequence
  sgRNA
agaggtggcagttgcaggcc

SEQ ID NO: 17242 - DNA, 20 bp, Artificial Sequence
  sgRNA
atgaatgccttcaagtctga

SEQ ID NO: 17243 - DNA, 20 bp, Artificial Sequence
  sgRNA
gctaggcgccaatggccacc

SEQ ID NO: 17244 - DNA, 20 bp, Artificial Sequence
  sgRNA
cttcaattctctaggtttgc

SEQ ID NO: 17245 - DNA, 20 bp, Artificial Sequence
  sgRNA
tgaattcggagtgctcgtgg

SEQ ID NO: 17246 - DNA, 20 bp, Artificial Sequence
  sgRNA
tggtcttaataggtgtgggc

SEQ ID NO: 17247 - DNA, 20 bp, Artificial Sequence
  sgRNA
tgggatgaagctttctggcg

SEQ ID NO: 17248 - DNA, 20 bp, Artificial Sequence
  sgRNA
tggtgcgtgtcgctctcaat

SEQ ID NO: 17249 - DNA, 20 bp, Artificial Sequence
  sgRNA
ggagtacgtctgctgggacc

SEQ ID NO: 17250 - DNA, 20 bp, Artificial Sequence
  sgRNA
cgtcaccgctcagccttata

SEQ ID NO: 17251 - DNA, 20 bp, Artificial Sequence
  sgRNA
tataactttctttccttgtc

SEQ ID NO: 17252 - DNA, 20 bp, Artificial Sequence
  sgRNA
tgtgagggtctgggctgtcg

SEQ ID NO: 17253 - DNA, 20 bp, Artificial Sequence
  sgRNA
ttctattgcttggcaaaccg

SEQ ID NO: 17254 - DNA, 20 bp, Artificial Sequence
  sgRNA
ggttgagggaggaggcagag

SEQ ID NO: 17255 - DNA, 20 bp, Artificial Sequence
  sgRNA
aaggaagttgtgagcctgtc

SEQ ID NO: 17256 - DNA, 20 bp, Artificial Sequence
  sgRNA
gcgtaactttggcgctcgcc

SEQ ID NO: 17257 - DNA, 20 bp, Artificial Sequence
  sgRNA
tatgcgggaaagtttcgcac

SEQ ID NO: 17258 - DNA, 20 bp, Artificial Sequence
  sgRNA
gaagaacaacgcggcgcaat

SEQ ID NO: 17259 - DNA, 20 bp, Artificial Sequence
  sgRNA
ttccgcgcgtcgtgacgtct

SEQ ID NO: 17260 - DNA, 20 bp, Artificial Sequence
  sgRNA
ggaagcacctggctctttgg

SEQ ID NO: 17261 - DNA, 20 bp, Artificial Sequence
  sgRNA
gatctgggaggtcagcacct

SEQ ID NO: 17262 - DNA, 20 bp, Artificial Sequence
  sgRNA
ctccttccaacacccttata

SEQ ID NO: 17263 - DNA, 20 bp, Artificial Sequence
  sgRNA
aaggaagcagaaatcataca

SEQ ID NO: 17264 - DNA, 20 bp, Artificial Sequence
  sgRNA
tgatgccaacccaaagacaa

SEQ ID NO: 17265 - DNA, 20 bp, Artificial Sequence
  sgRNA
caactagaccaaggttcctt

SEQ ID NO: 17266 - DNA, 20 bp, Artificial Sequence
  sgRNA
ttctcgctgattggtcacta

SEQ ID NO: 17267 - DNA, 20 bp, Artificial Sequence
  sgRNA
taattgactgaggttgaaga

SEQ ID NO: 17268 - DNA, 20 bp, Artificial Sequence
  sgRNA
cgctgtctgtcacgtgttcc

SEQ ID NO: 17269 - DNA, 20 bp, Artificial Sequence
  sgRNA
cgccatggaggccaacgctg

SEQ ID NO: 17270 - DNA, 20 bp, Artificial Sequence
  sgRNA
cccagttatccaaggaaacc

SEQ ID NO: 17271 - DNA, 20 bp, Artificial Sequence
  sgRNA
ctctgcgcgggatgacgccc

SEQ ID NO: 17272 - DNA, 20 bp, Artificial Sequence
  sgRNA
atttgagaggcgtaacgttg

SEQ ID NO: 17273 - DNA, 20 bp, Artificial Sequence
  sgRNA
atcacccacaatttatgacc

SEQ ID NO: 17274 - DNA, 20 bp, Artificial Sequence
  sgRNA
gaatcggaaagcctgcccat

SEQ ID NO: 17275 - DNA, 20 bp, Artificial Sequence
  sgRNA
catcaatacatgagagttct

SEQ ID NO: 17276 - DNA, 20 bp, Artificial Sequence
  sgRNA
caacaatctgaaatagtggc

SEQ ID NO: 17277 - DNA, 20 bp, Artificial Sequence
  sgRNA
atggctatagccatactggt

SEQ ID NO: 17278 - DNA, 20 bp, Artificial Sequence
  sgRNA
gcctataggtagggcgtgtt

SEQ ID NO: 17279 - DNA, 20 bp, Artificial Sequence
  sgRNA
gcacttcgggcgtctttgaa

SEQ ID NO: 17280 - DNA, 20 bp, Artificial Sequence
  sgRNA
ggcggagttaggtccgaagg

SEQ ID NO: 17281 - DNA, 20 bp, Artificial Sequence
  sgRNA
gccaagggactgcacgtgtg

SEQ ID NO: 17282 - DNA, 20 bp, Artificial Sequence
  sgRNA
ctacactcttgtggctgtcc

SEQ ID NO: 17283 - DNA, 20 bp, Artificial Sequence
  sgRNA
gctagggctgagtgactgca

SEQ ID NO: 17284 - DNA, 20 bp, Artificial Sequence
  sgRNA
aaacaaacatttctgtgtgc

SEQ ID NO: 17285 - DNA, 20 bp, Artificial Sequence
  sgRNA
ttacatttctctgatgtgca

SEQ ID NO: 17286 - DNA, 20 bp, Artificial Sequence
  sgRNA
aagacaggcaaacaacagcc

SEQ ID NO: 17287 - DNA, 20 bp, Artificial Sequence
  sgRNA
agacgcgcgcccgcaatgtc

SEQ ID NO: 17288 - DNA, 20 bp, Artificial Sequence
  sgRNA
ggattggattggctaatccg

SEQ ID NO: 17289 - DNA, 20 bp, Artificial Sequence
  sgRNA
aagacatacgctccgcaggc

SEQ ID NO: 17290 - DNA, 20 bp, Artificial Sequence
  sgRNA
agagaacttcaggctgtccg

SEQ ID NO: 17291 - DNA, 20 bp, Artificial Sequence
  sgRNA
tcactgactgggctaggacc

SEQ ID NO: 17292 - DNA, 20 bp, Artificial Sequence
  sgRNA
gactacccgggagctgtcta

SEQ ID NO: 17293 - DNA, 20 bp, Artificial Sequence
  sgRNA
agggaatctttgacagcgcc

SEQ ID NO: 17294 - DNA, 20 bp, Artificial Sequence
  sgRNA
aacttatgagaaggcccacc

SEQ ID NO: 17295 - DNA, 20 bp, Artificial Sequence
  sgRNA
gtcgctacaaacttcgccga

SEQ ID NO: 17296 - DNA, 20 bp, Artificial Sequence
  sgRNA
tactgggagaggcacggagc

SEQ ID NO: 17297 - DNA, 20 bp, Artificial Sequence
  sgRNA
gagagagtgtcagagtcact

SEQ ID NO: 17298 - DNA, 20 bp, Artificial Sequence
  sgRNA
tggcggtggcatgagaattg

SEQ ID NO: 17299 - DNA, 20 bp, Artificial Sequence
  sgRNA
ggcggatacggcgagccaat

SEQ ID NO: 17300 - DNA, 20 bp, Artificial Sequence
  sgRNA
gcgggaggctctcatgcggc

SEQ ID NO: 17301 - DNA, 20 bp, Artificial Sequence
  sgRNA
tgcctgttacggaagccgtc

SEQ ID NO: 17302 - DNA, 20 bp, Artificial Sequence
  sgRNA
tggccttgtctggccggcct

SEQ ID NO: 17303 - DNA, 20 bp, Artificial Sequence
  sgRNA
gggctgtcgtcctgccggcc

SEQ ID NO: 17304 - DNA, 20 bp, Artificial Sequence
  sgRNA
gttcggccgagcccggaggg

SEQ ID NO: 17305 - DNA, 20 bp, Artificial Sequence
  sgRNA
cctagaaatctcccacaccc

SEQ ID NO: 17306 - DNA, 20 bp, Artificial Sequence
  sgRNA
gctgtacaactggtgccaag

SEQ ID NO: 17307 - DNA, 20 bp, Artificial Sequence
  sgRNA
ctgatgtggctaatgctgat

SEQ ID NO: 17308 - DNA, 20 bp, Artificial Sequence
  sgRNA
tcttgtctttcttcaagtac

SEQ ID NO: 17309 - DNA, 20 bp, Artificial Sequence
  sgRNA
ggcagtggatccgctttggg

SEQ ID NO: 17310 - DNA, 20 bp, Artificial Sequence
  sgRNA
gaaacagttgtacaagcaga

SEQ ID NO: 17311 - DNA, 20 bp, Artificial Sequence
  sgRNA
gcggtttcagagcttgtggg

SEQ ID NO: 17312 - DNA, 20 bp, Artificial Sequence
  sgRNA
tccagggccttggctccgtg

SEQ ID NO: 17313 - DNA, 20 bp, Artificial Sequence
  sgRNA
ggtgcgctaatgacagcacg

SEQ ID NO: 17314 - DNA, 20 bp, Artificial Sequence
  sgRNA
aggctggagaagatgttcag

SEQ ID NO: 17315 - DNA, 20 bp, Artificial Sequence
  sgRNA
agccagctcttgatggaaag

SEQ ID NO: 17316 - DNA, 20 bp, Artificial Sequence
  sgRNA
gttgcttagttaccattgta

SEQ ID NO: 17317 - DNA, 20 bp, Artificial Sequence
  sgRNA
gcttagggacctccctttcg

SEQ ID NO: 17318 - DNA, 20 bp, Artificial Sequence
  sgRNA
tcctaagtttggcatcaccc

SEQ ID NO: 17319 - DNA, 20 bp, Artificial Sequence
  sgRNA
cattagcagggcacgaaccc

SEQ ID NO: 17320 - DNA, 20 bp, Artificial Sequence
  sgRNA
agcgggaatggacgtccatc

SEQ ID NO: 17321 - DNA, 20 bp, Artificial Sequence
  sgRNA
ttattctgcgcatgctcatt

SEQ ID NO: 17322 - DNA, 20 bp, Artificial Sequence
  sgRNA
gtcatcaatacgctcctccc

SEQ ID NO: 17323 - DNA, 20 bp, Artificial Sequence
  sgRNA
ggcatctgcagagacttaac

SEQ ID NO: 17324 - DNA, 20 bp, Artificial Sequence
  sgRNA
caccctgactcctccagccc

SEQ ID NO: 17325 - DNA, 20 bp, Artificial Sequence
  sgRNA
gatgtacttcctctgaacac

SEQ ID NO: 17326 - DNA, 20 bp, Artificial Sequence
  sgRNA
aagggttcctgagacagcca

SEQ ID NO: 17327 - DNA, 20 bp, Artificial Sequence
  sgRNA
gattacccttcttaccctcg

SEQ ID NO: 17328 - DNA, 20 bp, Artificial Sequence
  sgRNA
gagccgtaacctgctcttgc

SEQ ID NO: 17329 - DNA, 20 bp, Artificial Sequence
  sgRNA
gattcgaacgaccgtggaat

SEQ ID NO: 17330 - DNA, 20 bp, Artificial Sequence
  sgRNA
gctgggaagtcttctaaggc

SEQ ID NO: 17331 - DNA, 20 bp, Artificial Sequence
  sgRNA
cctgtctgtagttggtggca

SEQ ID NO: 17332 - DNA, 20 bp, Artificial Sequence
  sgRNA
cagagtctgtttgtgcctcg

SEQ ID NO: 17333 - DNA, 20 bp, Artificial Sequence
  sgRNA
ctcctcagcttcattcactg

SEQ ID NO: 17334 - DNA, 20 bp, Artificial Sequence
  sgRNA
aactcttccatcacatccag

SEQ ID NO: 17335 - DNA, 20 bp, Artificial Sequence
  sgRNA
cacagtgatcaaatgcttgg

SEQ ID NO: 17336 - DNA, 20 bp, Artificial Sequence
  sgRNA
ctgtttaactgagtcaaggg

SEQ ID NO: 17337 - DNA, 20 bp, Artificial Sequence
  sgRNA
cagagccaagactgaacctt

SEQ ID NO: 17338 - DNA, 20 bp, Artificial Sequence
  sgRNA
ctggtgattatagagaaata

SEQ ID NO: 17339 - DNA, 20 bp, Artificial Sequence
  sgRNA
aagggagagagctctaaggc

SEQ ID NO: 17340 - DNA, 20 bp, Artificial Sequence
  sgRNA
cagcctggaaagcaagtagt

SEQ ID NO: 17341 - DNA, 20 bp, Artificial Sequence
  sgRNA
agggcagcggaggacctagt

SEQ ID NO: 17342 - DNA, 20 bp, Artificial Sequence
  sgRNA
taggcagggctgaagattcc

SEQ ID NO: 17343 - DNA, 20 bp, Artificial Sequence
  sgRNA
tgaaagcccaagtaccaact

SEQ ID NO: 17344 - DNA, 20 bp, Artificial Sequence
  sgRNA
gacttaaggcaggccaatcc

SEQ ID NO: 17345 - DNA, 20 bp, Artificial Sequence
  sgRNA
gctagacataggaatactat

SEQ ID NO: 17346 - DNA, 20 bp, Artificial Sequence
  sgRNA
gaagaaaggagcgcatgaaa

SEQ ID NO: 17347 - DNA, 20 bp, Artificial Sequence
  sgRNA
ggtcggctgtctctgaacag

SEQ ID NO: 17348 - DNA, 20 bp, Artificial Sequence
  sgRNA
tgcgcccgactcttcctcac

SEQ ID NO: 17349 - DNA, 20 bp, Artificial Sequence
  sgRNA
gcttgctcgggctgagtgcg

SEQ ID NO: 17350 - DNA, 20 bp, Artificial Sequence
  sgRNA
agtatcgcacttccgcttta

SEQ ID NO: 17351 - DNA, 20 bp, Artificial Sequence
  sgRNA
cacggccgagcatacgtccc

SEQ ID NO: 17352 - DNA, 20 bp, Artificial Sequence
  sgRNA
gcgagacggctgctttccgg

SEQ ID NO: 17353 - DNA, 20 bp, Artificial Sequence
  sgRNA
ggtcagatgccaagagggcc

SEQ ID NO: 17354 - DNA, 20 bp, Artificial Sequence
  sgRNA
ggagcctgtgaagtactgcc

SEQ ID NO: 17355 - DNA, 20 bp, Artificial Sequence
  sgRNA
ggcctctcttccaagctact

SEQ ID NO: 17356 - DNA, 20 bp, Artificial Sequence
  sgRNA
gacgcagtagccgagttcta

SEQ ID NO: 17357 - DNA, 20 bp, Artificial Sequence
  sgRNA
aatttggatccgaggcttgt

SEQ ID NO: 17358 - DNA, 20 bp, Artificial Sequence
  sgRNA
ctaatggcagtggataggtg

SEQ ID NO: 17359 - DNA, 20 bp, Artificial Sequence
  sgRNA
agggctcttgcgcaggctct

SEQ ID NO: 17360 - DNA, 20 bp, Artificial Sequence
  sgRNA
gcgctgtgtgcgggttgtgc

SEQ ID NO: 17361 - DNA, 20 bp, Artificial Sequence
  sgRNA
cagcgccacggttcggacta

SEQ ID NO: 17362 - DNA, 20 bp, Artificial Sequence
  sgRNA
aacgggaagtctttggtctc

SEQ ID NO: 17363 - DNA, 20 bp, Artificial Sequence
  sgRNA
tttcagcagaggcagcaacc

SEQ ID NO: 17364 - DNA, 20 bp, Artificial Sequence
  sgRNA
gttggctttccctctgcagg

SEQ ID NO: 17365 - DNA, 20 bp, Artificial Sequence
  sgRNA
ttctgcttcttaagaaaccc

SEQ ID NO: 17366 - DNA, 20 bp, Artificial Sequence
  sgRNA
agcctgcagacgggctaaga

SEQ ID NO: 17367 - DNA, 20 bp, Artificial Sequence
  sgRNA
ctgtggctgcctacgtcacc

SEQ ID NO: 17368 - DNA, 20 bp, Artificial Sequence
  sgRNA
gggccaggaagccctgaaca

SEQ ID NO: 17369 - DNA, 20 bp, Artificial Sequence
  sgRNA
cccaggcaggtggctaatgg

SEQ ID NO: 17370 - DNA, 20 bp, Artificial Sequence
  sgRNA
ggcccaggtcgtccatgtgg

SEQ ID NO: 17371 - DNA, 20 bp, Artificial Sequence
  sgRNA
gtagttcaccgcccagcctg

SEQ ID NO: 17372 - DNA, 20 bp, Artificial Sequence
  sgRNA
gcatgcagtcactccatggg

SEQ ID NO: 17373 - DNA, 20 bp, Artificial Sequence
  sgRNA
cgcaccaacggcctggataa

SEQ ID NO: 17374 - DNA, 20 bp, Artificial Sequence
  sgRNA
tcgtaggtcgatcgcctgtc

SEQ ID NO: 17375 - DNA, 20 bp, Artificial Sequence
  sgRNA
agaggcgacttccggcgcgg

SEQ ID NO: 17376 - DNA, 20 bp, Artificial Sequence
  sgRNA
agtccagagcggcgagccag

SEQ ID NO: 17377 - DNA, 20 bp, Artificial Sequence
  sgRNA
gggcataggaaatagagccg

SEQ ID NO: 17378 - DNA, 20 bp, Artificial Sequence
  sgRNA
gaagaggcctgcttcagcca

SEQ ID NO: 17379 - DNA, 20 bp, Artificial Sequence
  sgRNA
gccagcaatgttagaattta

SEQ ID NO: 17380 - DNA, 20 bp, Artificial Sequence
  sgRNA
ctccagctcgatcctgtaag

SEQ ID NO: 17381 - DNA, 20 bp, Artificial Sequence
  sgRNA
gaagcgctcagctgacctgg

SEQ ID NO: 17382 - DNA, 20 bp, Artificial Sequence
  sgRNA
ctcacaggtcgcagagaccc

SEQ ID NO: 17383 - DNA, 20 bp, Artificial Sequence
  sgRNA
ggtgttggaggaacgtgcac

SEQ ID NO: 17384 - DNA, 20 bp, Artificial Sequence
  sgRNA
agttaacgggacttgtcctc

SEQ ID NO: 17385 - DNA, 20 bp, Artificial Sequence
  sgRNA
gattggcagggcctcttaaa

SEQ ID NO: 17386 - DNA, 20 bp, Artificial Sequence
  sgRNA
gaaggcgggcgcgcgcccat

SEQ ID NO: 17387 - DNA, 20 bp, Artificial Sequence
  sgRNA
agactgctggctgcagacgc

SEQ ID NO: 17388 - DNA, 20 bp, Artificial Sequence
  sgRNA
ggcgcgatgtcccggcgcgg

SEQ ID NO: 17389 - DNA, 20 bp, Artificial Sequence
  sgRNA
ggcctcccgggcacgttccg

SEQ ID NO: 17390 - DNA, 20 bp, Artificial Sequence
  sgRNA
ctcgtcatatccgttagccg

SEQ ID NO: 17391 - DNA, 20 bp, Artificial Sequence
  sgRNA
ctcctccgtggccaaggtca

SEQ ID NO: 17392 - DNA, 20 bp, Artificial Sequence
  sgRNA
agagagaacggtgctgagcc

SEQ ID NO: 17393 - DNA, 20 bp, Artificial Sequence
  sgRNA
gagcctgtcttgcaaggcgg

SEQ ID NO: 17394 - DNA, 20 bp, Artificial Sequence
  sgRNA
agagggcaagcagaagggtt

SEQ ID NO: 17395 - DNA, 20 bp, Artificial Sequence
  sgRNA
ggaaccactgcgcctgcgca

SEQ ID NO: 17396 - DNA, 20 bp, Artificial Sequence
  sgRNA
agttcagcacctcctctgag

SEQ ID NO: 17397 - DNA, 20 bp, Artificial Sequence
  sgRNA
ggacagccagcactgctggg

SEQ ID NO: 17398 - DNA, 20 bp, Artificial Sequence
  sgRNA
agtgtttgctgcacaagttt

SEQ ID NO: 17399 - DNA, 20 bp, Artificial Sequence
  sgRNA
tcagcatttatgtaacaagc

SEQ ID NO: 17400 - DNA, 20 bp, Artificial Sequence
  sgRNA
gtcttgcctgcaagatgtgc

SEQ ID NO: 17401 - DNA, 20 bp, Artificial Sequence
  sgRNA
gagggcgacacagtccgccg

SEQ ID NO: 17402 - DNA, 20 bp, Artificial Sequence
  sgRNA
ccagagcgttattacctcga

SEQ ID NO: 17403 - DNA, 20 bp, Artificial Sequence
  sgRNA
ccgtcgtgttgagctcctcg

SEQ ID NO: 17404 - DNA, 20 bp, Artificial Sequence
  sgRNA
gaaagtccgagctgaaagct

SEQ ID NO: 17405 - DNA, 20 bp, Artificial Sequence
  sgRNA
ctttcgtgagttcaggagat

SEQ ID NO: 17406 - DNA, 20 bp, Artificial Sequence
  sgRNA
gatctatctctagctgagct

SEQ ID NO: 17407 - DNA, 20 bp, Artificial Sequence
  sgRNA
tgtgtatgcgcatgagttgc

SEQ ID NO: 17408 - DNA, 20 bp, Artificial Sequence
  sgRNA
ttgcaggctggtgtctgata

SEQ ID NO: 17409 - DNA, 20 bp, Artificial Sequence
  sgRNA
ggatgctgggaattgaactg

SEQ ID NO: 17410 - DNA, 20 bp, Artificial Sequence
  sgRNA
ctggcaaggtgaggactagc

SEQ ID NO: 17411 - DNA, 20 bp, Artificial Sequence
  sgRNA
taagagtcgcatggactcct

SEQ ID NO: 17412 - DNA, 20 bp, Artificial Sequence
  sgRNA
acgcggtagccaacctagac

SEQ ID NO: 17413 - DNA, 20 bp, Artificial Sequence
  sgRNA
agatcctttctctggcaacg

SEQ ID NO: 17414 - DNA, 20 bp, Artificial Sequence
  sgRNA
aatatgggcacgaaataatt

SEQ ID NO: 17415 - DNA, 20 bp, Artificial Sequence
  sgRNA
ttatatagagagaagctgcg

SEQ ID NO: 17416 - DNA, 20 bp, Artificial Sequence
  sgRNA
gattagcggctaagtttact

SEQ ID NO: 17417 - DNA, 20 bp, Artificial Sequence
  sgRNA
gggcagatgctggattcata

SEQ ID NO: 17418 - DNA, 20 bp, Artificial Sequence
  sgRNA
gacattggaacaagaactac

SEQ ID NO: 17419 - DNA, 20 bp, Artificial Sequence
  sgRNA
acaattcccatggtcaaata

SEQ ID NO: 17420 - DNA, 20 bp, Artificial Sequence
  sgRNA
agtccatcgagtgggcactg

SEQ ID NO: 17421 - DNA, 20 bp, Artificial Sequence
  sgRNA
tctctctgcgcctaaaccaa

SEQ ID NO: 17422 - DNA, 20 bp, Artificial Sequence
  sgRNA
ttgttgtgtttatgagggat

SEQ ID NO: 17423 - DNA, 20 bp, Artificial Sequence
  sgRNA
agcttctgcccacacacagc

SEQ ID NO: 17424 - DNA, 20 bp, Artificial Sequence
  sgRNA
cagggaagggacattgggag

SEQ ID NO: 17425 - DNA, 20 bp, Artificial Sequence
  sgRNA
gcccaggacttgacttatac

SEQ ID NO: 17426 - DNA, 20 bp, Artificial Sequence
  sgRNA
ctttgctccaatcacagaaa

SEQ ID NO: 17427 - DNA, 20 bp, Artificial Sequence
  sgRNA
ttaatggatgagaagatctg

SEQ ID NO: 17428 - DNA, 20 bp, Artificial Sequence
  sgRNA
catgatgctcctcccaggga

SEQ ID NO: 17429 - DNA, 20 bp, Artificial Sequence
  sgRNA
ttagcggcagggcaattcta

SEQ ID NO: 17430 - DNA, 20 bp, Artificial Sequence
  sgRNA
tcagctttgtggcactgtca

SEQ ID NO: 17431 - DNA, 20 bp, Artificial Sequence
  sgRNA
gagaagtcacttgggtcagc

SEQ ID NO: 17432 - DNA, 20 bp, Artificial Sequence
  sgRNA
acaggtcccatgagcctctg

SEQ ID NO: 17433 - DNA, 20 bp, Artificial Sequence
  sgRNA
gtacgtactaccagtcccag

SEQ ID NO: 17434 - DNA, 20 bp, Artificial Sequence
  sgRNA
cggcaccctatatagtcttc

SEQ ID NO: 17435 - DNA, 20 bp, Artificial Sequence
  sgRNA
gagccatagctacactgctg

SEQ ID NO: 17436 - DNA, 20 bp, Artificial Sequence
  sgRNA
atgctgactttctcggagcc

SEQ ID NO: 17437 - DNA, 20 bp, Artificial Sequence
  sgRNA
gattgaacaatgacagcttt

SEQ ID NO: 17438 - DNA, 20 bp, Artificial Sequence
  sgRNA
gggtgccggacacgggatgg

SEQ ID NO: 17439 - DNA, 20 bp, Artificial Sequence
  sgRNA
gtcttcggatggcacccagt

SEQ ID NO: 17440 - DNA, 20 bp, Artificial Sequence
  sgRNA
tgacagaaatgtgagatagc

SEQ ID NO: 17441 - DNA, 20 bp, Artificial Sequence
  sgRNA
gtaggtactgtgctctgcca

SEQ ID NO: 17442 - DNA, 20 bp, Artificial Sequence
  sgRNA
atgctcgcacagtgtcctca

SEQ ID NO: 17443 - DNA, 20 bp, Artificial Sequence
  sgRNA
gcacacgtgcagagaacata

SEQ ID NO: 17444 - DNA, 20 bp, Artificial Sequence
  sgRNA
ttgagtaggtgtagccttgt

SEQ ID NO: 17445 - DNA, 20 bp, Artificial Sequence
  sgRNA
ccctctataccaggttgtga

SEQ ID NO: 17446 - DNA, 20 bp, Artificial Sequence
  sgRNA
aggtatgtcagtgtggatgt

SEQ ID NO: 17447 - DNA, 20 bp, Artificial Sequence
  sgRNA
tcccaggatatgtacaatgc

SEQ ID NO: 17448 - DNA, 20 bp, Artificial Sequence
  sgRNA
ctggcagggttggctgggag

SEQ ID NO: 17449 - DNA, 20 bp, Artificial Sequence
  sgRNA
cagtggtcagacagctggtg

SEQ ID NO: 17450 - DNA, 20 bp, Artificial Sequence
  sgRNA
cccgcaggtactttcagcgc

SEQ ID NO: 17451 - DNA, 20 bp, Artificial Sequence
  sgRNA
ggcgggagattctatcttgg

SEQ ID NO: 17452 - DNA, 20 bp, Artificial Sequence
  sgRNA
gtggacttgtctttatcgcc

SEQ ID NO: 17453 - DNA, 20 bp, Artificial Sequence
  sgRNA
ggcaacaacaccttcgttcc

SEQ ID NO: 17454 - DNA, 20 bp, Artificial Sequence
  sgRNA
atgcccagcaaaggcctccg

SEQ ID NO: 17455 - DNA, 20 bp, Artificial Sequence
  sgRNA
cttagcgtccacgcctcagt

SEQ ID NO: 17456 - DNA, 20 bp, Artificial Sequence
  sgRNA
cgtgcgcggacgagccagca

SEQ ID NO: 17457 - DNA, 20 bp, Artificial Sequence
  sgRNA
gagcggctcgactctggcac

SEQ ID NO: 17458 - DNA, 20 bp, Artificial Sequence
  sgRNA
caacacccaaacgcctgcgc

SEQ ID NO: 17459 - DNA, 20 bp, Artificial Sequence
  sgRNA
gtaattaatgtcaccctagg

SEQ ID NO: 17460 - DNA, 20 bp, Artificial Sequence
  sgRNA
tcttggcaaccaagggaagg

SEQ ID NO: 17461 - DNA, 20 bp, Artificial Sequence
  sgRNA
cactcccagctcagaagtaa

SEQ ID NO: 17462 - DNA, 20 bp, Artificial Sequence
  sgRNA
aaagcctgcacagccttcgg

SEQ ID NO: 17463 - DNA, 20 bp, Artificial Sequence
  sgRNA
ggttaagtgggtgatctctg

SEQ ID NO: 17464 - DNA, 20 bp, Artificial Sequence
  sgRNA
gagggtgcagatccggcctc

SEQ ID NO: 17465 - DNA, 20 bp, Artificial Sequence
  sgRNA
tcaaatgatggtcaagcatc

SEQ ID NO: 17466 - DNA, 20 bp, Artificial Sequence
  sgRNA
acctgaaatccctaaatttg

SEQ ID NO: 17467 - DNA, 20 bp, Artificial Sequence
  sgRNA
ccagctagaggaaggttgcc

SEQ ID NO: 17468 - DNA, 20 bp, Artificial Sequence
  sgRNA
ggcgtgatgattggacggca

SEQ ID NO: 17469 - DNA, 20 bp, Artificial Sequence
  sgRNA
gggcggtggagctttaggag

SEQ ID NO: 17470 - DNA, 20 bp, Artificial Sequence
  sgRNA
ctcgtagaccgaccgtctct

SEQ ID NO: 17471 - DNA, 20 bp, Artificial Sequence
  sgRNA
attcccagctccagccgcgg

SEQ ID NO: 17472 - DNA, 20 bp, Artificial Sequence
  sgRNA
ccacgcgggaatccggccct

SEQ ID NO: 17473 - DNA, 20 bp, Artificial Sequence
  sgRNA
ctccctctgagcccgcctag

SEQ ID NO: 17474 - DNA, 20 bp, Artificial Sequence
  sgRNA
ggagtctaatagggaagggc

SEQ ID NO: 17475 - DNA, 20 bp, Artificial Sequence
  sgRNA
gtggattcttgctccgctcg

SEQ ID NO: 17476 - DNA, 20 bp, Artificial Sequence
  sgRNA
tgctacttctggtctatcag

SEQ ID NO: 17477 - DNA, 20 bp, Artificial Sequence
  sgRNA
ggaatgtgcttaattcattc

SEQ ID NO: 17478 - DNA, 20 bp, Artificial Sequence
  sgRNA
cttgcagactcatagacacc

SEQ ID NO: 17479 - DNA, 20 bp, Artificial Sequence
  sgRNA
attaggttaatatgttcagc

SEQ ID NO: 17480 - DNA, 20 bp, Artificial Sequence
  sgRNA
tgctaagtgttggaaggata

SEQ ID NO: 17481 - DNA, 20 bp, Artificial Sequence
  sgRNA
ctggttccagataagcctcg

SEQ ID NO: 17482 - DNA, 20 bp, Artificial Sequence
  sgRNA
gggtgcgtgaggctgcaggg

SEQ ID NO: 17483 - DNA, 20 bp, Artificial Sequence
  sgRNA
ggtggtctcgcggttcagaa

SEQ ID NO: 17484 - DNA, 20 bp, Artificial Sequence
  sgRNA
taggcagagatgctaataga

SEQ ID NO: 17485 - DNA, 20 bp, Artificial Sequence
  sgRNA
tgcagctcgcgtttgcttgg

SEQ ID NO: 17486 - DNA, 20 bp, Artificial Sequence
  sgRNA
gtccacaggctcgcttgact

SEQ ID NO: 17487 - DNA, 20 bp, Artificial Sequence
  sgRNA
gccctggagcacactagaga

SEQ ID NO: 17488 - DNA, 20 bp, Artificial Sequence
  sgRNA
aactcttcctgctccgctcc

SEQ ID NO: 17489 - DNA, 20 bp, Artificial Sequence
  sgRNA
cgcgaacaatgctgtgaccc

SEQ ID NO: 17490 - DNA, 20 bp, Artificial Sequence
  sgRNA
tttctaataacttcctccaa

SEQ ID NO: 17491 - DNA, 20 bp, Artificial Sequence
  sgRNA
cccgtcttgccaatttatgt

SEQ ID NO: 17492 - DNA, 20 bp, Artificial Sequence
  sgRNA
aggacgcccgccaacaccgt

SEQ ID NO: 17493 - DNA, 20 bp, Artificial Sequence
  sgRNA
tgacccgcctccctagctcg

SEQ ID NO: 17494 - DNA, 20 bp, Artificial Sequence
  sgRNA
aaggagccgctgggaaaccc

SEQ ID NO: 17495 - DNA, 20 bp, Artificial Sequence
  sgRNA
ttcctgaacttctggttggt

SEQ ID NO: 17496 - DNA, 20 bp, Artificial Sequence
  sgRNA
tagcccagaggaccaatgcc

SEQ ID NO: 17497 - DNA, 20 bp, Artificial Sequence
  sgRNA
tttacagtgtcttaattgcc

SEQ ID NO: 17498 - DNA, 20 bp, Artificial Sequence
  sgRNA
agaggaggaaacctcagttg

SEQ ID NO: 17499 - DNA, 20 bp, Artificial Sequence
  sgRNA
aattaacaattggtgtggga

SEQ ID NO: 17500 - DNA, 20 bp, Artificial Sequence
  sgRNA
cctacacttcagtcttatag

SEQ ID NO: 17501 - DNA, 20 bp, Artificial Sequence
  sgRNA
gccatctactgtcactcaag

SEQ ID NO: 17502 - DNA, 20 bp, Artificial Sequence
  sgRNA
gagctcctacagctgtgcgt

SEQ ID NO: 17503 - DNA, 20 bp, Artificial Sequence
  sgRNA
ctcaactcagtgcctccgat

SEQ ID NO: 17504 - DNA, 20 bp, Artificial Sequence
  sgRNA
actcctggagagcaaggcaa

SEQ ID NO: 17505 - DNA, 20 bp, Artificial Sequence
  sgRNA
ccacaaacttgctttcctgc

SEQ ID NO: 17506 - DNA, 20 bp, Artificial Sequence
  sgRNA
caaggccggccgtccctgca

SEQ ID NO: 17507 - DNA, 20 bp, Artificial Sequence
  sgRNA
aggctcagaagcctgaacaa

SEQ ID NO: 17508 - DNA, 20 bp, Artificial Sequence
  sgRNA
agcaaacacttccactcagc

SEQ ID NO: 17509 - DNA, 20 bp, Artificial Sequence
  sgRNA
gtagcaaacaccgcgggcct

SEQ ID NO: 17510 - DNA, 20 bp, Artificial Sequence
  sgRNA
tttgccatcacaagagttag

SEQ ID NO: 17511 - DNA, 20 bp, Artificial Sequence
  sgRNA
atgtgttattatagaacctg

SEQ ID NO: 17512 - DNA, 20 bp, Artificial Sequence
  sgRNA
atcaagcctcctgacaagga

SEQ ID NO: 17513 - DNA, 20 bp, Artificial Sequence
  sgRNA
cgggaggaccaatgggagcg

SEQ ID NO: 17514 - DNA, 20 bp, Artificial Sequence
  sgRNA
ctgttggctctctctagcta

SEQ ID NO: 17515 - DNA, 20 bp, Artificial Sequence
  sgRNA
agctgtccattggtccgccc

SEQ ID NO: 17516 - DNA, 20 bp, Artificial Sequence
  sgRNA
gtactaattaaggacaacag

SEQ ID NO: 17517 - DNA, 20 bp, Artificial Sequence
  sgRNA
acagtttcacaacttgtgca

SEQ ID NO: 17518 - DNA, 20 bp, Artificial Sequence
  sgRNA
taggctgggcatccttgcag

SEQ ID NO: 17519 - DNA, 20 bp, Artificial Sequence
  sgRNA
gcgtgactagggagaaagcc

SEQ ID NO: 17520 - DNA, 20 bp, Artificial Sequence
  sgRNA
agcgtgaggcagcctagaaa

SEQ ID NO: 17521 - DNA, 20 bp, Artificial Sequence
  sgRNA
ttgcggcacgcgctactcgc

SEQ ID NO: 17522 - DNA, 20 bp, Artificial Sequence
  sgRNA
gcgcggacgaaccactgagc

SEQ ID NO: 17523 - DNA, 20 bp, Artificial Sequence
  sgRNA
taggttctgagtgtagctgc

SEQ ID NO: 17524 - DNA, 20 bp, Artificial Sequence
  sgRNA
gcacagggcccggttcggtt

SEQ ID NO: 17525 - DNA, 20 bp, Artificial Sequence
  sgRNA
cccagttattcacaaccgcc

SEQ ID NO: 17526 - DNA, 20 bp, Artificial Sequence
  sgRNA
actgtcaagagctgtcatga

SEQ ID NO: 17527 - DNA, 20 bp, Artificial Sequence
  sgRNA
aaggagctggatagatcaac

SEQ ID NO: 17528 - DNA, 20 bp, Artificial Sequence
  sgRNA
tatatgtccaagacctagag

SEQ ID NO: 17529 - DNA, 20 bp, Artificial Sequence
  sgRNA
gatgtgttcccagcattctc

SEQ ID NO: 17530 - DNA, 20 bp, Artificial Sequence
  sgRNA
cagtgcttgagtcccttcag

SEQ ID NO: 17531 - DNA, 20 bp, Artificial Sequence
  sgRNA
gatcagctcctgtcaggcgc

SEQ ID NO: 17532 - DNA, 20 bp, Artificial Sequence
  sgRNA
ggcgggcgggcgagcaggcg

SEQ ID NO: 17533 - DNA, 20 bp, Artificial Sequence
  sgRNA
cggccacgctacgtcactcc

SEQ ID NO: 17534 - DNA, 20 bp, Artificial Sequence
  sgRNA
gggtggcaccgtgatcagag

SEQ ID NO: 17535 - DNA, 20 bp, Artificial Sequence
  sgRNA
gccgaccctcgtccaggaag

SEQ ID NO: 17536 - DNA, 20 bp, Artificial Sequence
  sgRNA
gtctaggtggcgctgggact

SEQ ID NO: 17537 - DNA, 20 bp, Artificial Sequence
  sgRNA
gttggcaggaacagcacaaa

SEQ ID NO: 17538 - DNA, 20 bp, Artificial Sequence
  sgRNA
aaagtgccctgtcccactgc

SEQ ID NO: 17539 - DNA, 20 bp, Artificial Sequence
  sgRNA
gacactccagagctttcgaa

SEQ ID NO: 17540 - DNA, 20 bp, Artificial Sequence
  sgRNA
ctgttagctcactgattctt

SEQ ID NO: 17541 - DNA, 20 bp, Artificial Sequence
  sgRNA
ccggcagcccgcgttgccat

SEQ ID NO: 17542 - DNA, 20 bp, Artificial Sequence
  sgRNA
gtgagggttagcagcgggat

SEQ ID NO: 17543 - DNA, 20 bp, Artificial Sequence
  sgRNA
ggcagggcagaaccctactg

SEQ ID NO: 17544 - DNA, 20 bp, Artificial Sequence
  sgRNA
gggtgtttcccagagatatt

SEQ ID NO: 17545 - DNA, 20 bp, Artificial Sequence
  sgRNA
gggattgagcaattaagagg

SEQ ID NO: 17546 - DNA, 20 bp, Artificial Sequence
  sgRNA
tcttaaagcaacagctcctt

SEQ ID NO: 17547 - DNA, 20 bp, Artificial Sequence
  sgRNA
ctcagtagacggccaccgat

SEQ ID NO: 17548 - DNA, 20 bp, Artificial Sequence
  sgRNA
gtgcagaagctgcccatgat

SEQ ID NO: 17549 - DNA, 20 bp, Artificial Sequence
  sgRNA
cggaactggcgtgaaagcac

SEQ ID NO: 17550 - DNA, 20 bp, Artificial Sequence
  sgRNA
gcattgggttacagggtcct

SEQ ID NO: 17551 - DNA, 20 bp, Artificial Sequence
  sgRNA
gccctccctgactcgtcgcg

SEQ ID NO: 17552 - DNA, 20 bp, Artificial Sequence
  sgRNA
ctgttgaagagctgagctat

SEQ ID NO: 17553 - DNA, 20 bp, Artificial Sequence
  sgRNA
ctctcttaggcttcacaggc

SEQ ID NO: 17554 - DNA, 20 bp, Artificial Sequence
  sgRNA
cacaggtggtaagagggtgg

SEQ ID NO: 17555 - DNA, 20 bp, Artificial Sequence
  sgRNA
tagccacagcgcacgcacgc

SEQ ID NO: 17556 - DNA, 20 bp, Artificial Sequence
  sgRNA
agctgccgggccgaacgagc

SEQ ID NO: 17557 - DNA, 20 bp, Artificial Sequence
  sgRNA
acggcttctggcgtcagccg

SEQ ID NO: 17558 - DNA, 20 bp, Artificial Sequence
  sgRNA
cacgtcgtgacgtaagacgt

SEQ ID NO: 17559 - DNA, 20 bp, Artificial Sequence
  sgRNA
cacaatgcagcttgcaccct

SEQ ID NO: 17560 - DNA, 20 bp, Artificial Sequence
  sgRNA
tacaagtcccagagcagttt

SEQ ID NO: 17561 - DNA, 20 bp, Artificial Sequence
  sgRNA
atataaggactttcgaagaa

SEQ ID NO: 17562 - DNA, 20 bp, Artificial Sequence
  sgRNA
tattgcaacaactctcaatg

SEQ ID NO: 17563 - DNA, 20 bp, Artificial Sequence
  sgRNA
ttaggtcaccgttagggttt

SEQ ID NO: 17564 - DNA, 20 bp, Artificial Sequence
  sgRNA
actgctatacttagaatttc

SEQ ID NO: 17565 - DNA, 20 bp, Artificial Sequence
  sgRNA
gtttccaacgtgtgtgatcc

SEQ ID NO: 17566 - DNA, 20 bp, Artificial Sequence
  sgRNA
agaacgactggtcacgtgga

SEQ ID NO: 17567 - DNA, 20 bp, Artificial Sequence
  sgRNA
gcacttgcgggtaagaccac

SEQ ID NO: 17568 - DNA, 20 bp, Artificial Sequence
  sgRNA
ataggtgagactggttgccc

SEQ ID NO: 17569 - DNA, 20 bp, Artificial Sequence
  sgRNA
tagtgctgtttgctcccgca

SEQ ID NO: 17570 - DNA, 20 bp, Artificial Sequence
  sgRNA
tgacagaagggctgcggtcc

SEQ ID NO: 17571 - DNA, 20 bp, Artificial Sequence
  sgRNA
ctactcgagccatgcgcctc

SEQ ID NO: 17572 - DNA, 20 bp, Artificial Sequence
  sgRNA
tgggtcgaggagcctgatct

SEQ ID NO: 17573 - DNA, 20 bp, Artificial Sequence
  sgRNA
tctatgaagtctttcaccgc

SEQ ID NO: 17574 - DNA, 20 bp, Artificial Sequence
  sgRNA
ccgtctcgggccgcgtgagt

SEQ ID NO: 17575 - DNA, 20 bp, Artificial Sequence
  sgRNA
ctaaacgagacgcgagcatg

SEQ ID NO: 17576 - DNA, 20 bp, Artificial Sequence
  sgRNA
ttgctggtgtgccagcggag

SEQ ID NO: 17577 - DNA, 20 bp, Artificial Sequence
  sgRNA
gcgatcggaaatcaactact

SEQ ID NO: 17578 - DNA, 20 bp, Artificial Sequence
  sgRNA
tcaaagctcgcgcggcggcg

SEQ ID NO: 17579 - DNA, 20 bp, Artificial Sequence
  sgRNA
tgggcccgagctccagcgcg

SEQ ID NO: 17580 - DNA, 20 bp, Artificial Sequence
  sgRNA
gccaaatctttatatgcatc

SEQ ID NO: 17581 - DNA, 20 bp, Artificial Sequence
  sgRNA
gggcaaaggagatccacctg

SEQ ID NO: 17582 - DNA, 20 bp, Artificial Sequence
  sgRNA
ggcaggaagtggtagcctct

SEQ ID NO: 17583 - DNA, 20 bp, Artificial Sequence
  sgRNA
actaaagcctttatctttag

SEQ ID NO: 17584 - DNA, 20 bp, Artificial Sequence
  sgRNA
cgagccatcaggaagaactc

SEQ ID NO: 17585 - DNA, 20 bp, Artificial Sequence
  sgRNA
tgcacacagtggcaccactc

SEQ ID NO: 17586 - DNA, 20 bp, Artificial Sequence
  sgRNA
tcggaatcctgggaataagc

SEQ ID NO: 17587 - DNA, 20 bp, Artificial Sequence
  sgRNA
gaggttagccagagccgtcc

SEQ ID NO: 17588 - DNA, 20 bp, Artificial Sequence
  sgRNA
cccagtccggagtaagagcc

SEQ ID NO: 17589 - DNA, 20 bp, Artificial Sequence
  sgRNA
aaccgcggctggtcgacgtg

SEQ ID NO: 17590 - DNA, 20 bp, Artificial Sequence
  sgRNA
gcagtgcgaggcgaacgtgc

SEQ ID NO: 17591 - DNA, 20 bp, Artificial Sequence
  sgRNA
tctgggacgcggtggttcct

SEQ ID NO: 17592 - DNA, 20 bp, Artificial Sequence
  sgRNA
gctgtcgcgcagcgggatca

SEQ ID NO: 17593 - DNA, 20 bp, Artificial Sequence
  sgRNA
gcgctgccggcggtcacctg

SEQ ID NO: 17594 - DNA, 20 bp, Artificial Sequence
  sgRNA
tggaggcgtccctttaagag

SEQ ID NO: 17595 - DNA, 20 bp, Artificial Sequence
  sgRNA
gcctcccttcccgggaggcg

SEQ ID NO: 17596 - DNA, 20 bp, Artificial Sequence
  sgRNA
acgaggaaggaggccggccg

SEQ ID NO: 17597 - DNA, 20 bp, Artificial Sequence
  sgRNA
gggactgcgcgggcggcacg

SEQ ID NO: 17598 - DNA, 20 bp, Artificial Sequence
  sgRNA
agttccagcacggacacacc

SEQ ID NO: 17599 - DNA, 20 bp, Artificial Sequence
  sgRNA
agtccacgcacaggagcctg

SEQ ID NO: 17600 - DNA, 20 bp, Artificial Sequence
  sgRNA
gagcatagagtgcgagaccg

SEQ ID NO: 17601 - DNA, 20 bp, Artificial Sequence
  sgRNA
agtaaacaggagaaatttca

SEQ ID NO: 17602 - DNA, 20 bp, Artificial Sequence
  sgRNA
ggtgcggtcagtgcctcgcg

SEQ ID NO: 17603 - DNA, 20 bp, Artificial Sequence
  sgRNA
aaaggccggcctggaagaaa

SEQ ID NO: 17604 - DNA, 20 bp, Artificial Sequence
  sgRNA
cggctttgttcctgccgggc

SEQ ID NO: 17605 - DNA, 20 bp, Artificial Sequence
  sgRNA
ctccatctcctgttaggtat

SEQ ID NO: 17606 - DNA, 20 bp, Artificial Sequence
  sgRNA
gttacttagttcttactggc

SEQ ID NO: 17607 - DNA, 20 bp, Artificial Sequence
  sgRNA
atggctggtggtgtccaagg

SEQ ID NO: 17608 - DNA, 20 bp, Artificial Sequence
  sgRNA
caccacgggagcaggagtcc

SEQ ID NO: 17609 - DNA, 20 bp, Artificial Sequence
  sgRNA
gggcagcccgtgcgcagggc

SEQ ID NO: 17610 - DNA, 20 bp, Artificial Sequence
  sgRNA
gacaacaaccagcgccgctg

SEQ ID NO: 17611 - DNA, 20 bp, Artificial Sequence
  sgRNA
aaacagcccgagcgtggcag

SEQ ID NO: 17612 - DNA, 20 bp, Artificial Sequence
  sgRNA
gaatgagaaagatctggttg

SEQ ID NO: 17613 - DNA, 20 bp, Artificial Sequence
  sgRNA
aggctaggccgtggtttcct

SEQ ID NO: 17614 - DNA, 20 bp, Artificial Sequence
  sgRNA
tcaggaaaggtagatgcaag

SEQ ID NO: 17615 - DNA, 20 bp, Artificial Sequence
  sgRNA
caaggtcagctaaccaaagc

SEQ ID NO: 17616 - DNA, 20 bp, Artificial Sequence
  sgRNA
ggcgccagataggcctgcgg

SEQ ID NO: 17617 - DNA, 20 bp, Artificial Sequence
  sgRNA
ctgtgcgtttgttctgcaga

SEQ ID NO: 17618 - DNA, 20 bp, Artificial Sequence
  sgRNA
accggccggccggtgacttt

SEQ ID NO: 17619 - DNA, 20 bp, Artificial Sequence
  sgRNA
caaacccgggcgcacgcccg

SEQ ID NO: 17620 - DNA, 20 bp, Artificial Sequence
  sgRNA
gggctcggccttgcgtctcc

SEQ ID NO: 17621 - DNA, 20 bp, Artificial Sequence
  sgRNA
taactcaccgttctcaatgt

SEQ ID NO: 17622 - DNA, 20 bp, Artificial Sequence
  sgRNA
ctgggagtctttccattcgc

SEQ ID NO: 17623 - DNA, 20 bp, Artificial Sequence
  sgRNA
gccctggagaagaacgtgcg

SEQ ID NO: 17624 - DNA, 20 bp, Artificial Sequence
  sgRNA
tagggtgctgcctgaagtgg

SEQ ID NO: 17625 - DNA, 20 bp, Artificial Sequence
  sgRNA
tctctaagaaatgaccaagt

SEQ ID NO: 17626 - DNA, 20 bp, Artificial Sequence
  sgRNA
ttagtcgtgatttgttggcg

SEQ ID NO: 17627 - DNA, 20 bp, Artificial Sequence
  sgRNA
gttctcgtacaatgaccaat

SEQ ID NO: 17628 - DNA, 20 bp, Artificial Sequence
  sgRNA
cgttccgaatgttgatggtg

SEQ ID NO: 17629 - DNA, 20 bp, Artificial Sequence
  sgRNA
tcagcccgcacccgctccct

SEQ ID NO: 17630 - DNA, 20 bp, Artificial Sequence
  sgRNA
cagctggctgaggcacttgg

SEQ ID NO: 17631 - DNA, 20 bp, Artificial Sequence
  sgRNA
gtgcgccctgtgctcaggcg

SEQ ID NO: 17632 - DNA, 20 bp, Artificial Sequence
  sgRNA
gcctgagtgttacttgccag

SEQ ID NO: 17633 - DNA, 20 bp, Artificial Sequence
  sgRNA
gggtcatacccaagttagat

SEQ ID NO: 17634 - DNA, 20 bp, Artificial Sequence
  sgRNA
aagtgactgactgggtagtc

SEQ ID NO: 17635 - DNA, 20 bp, Artificial Sequence
  sgRNA
cgcaaagatcacggagaatt

SEQ ID NO: 17636 - DNA, 20 bp, Artificial Sequence
  sgRNA
gctagagagacacgcgttcg

SEQ ID NO: 17637 - DNA, 20 bp, Artificial Sequence
  sgRNA
tctatggtttctcatctagc

SEQ ID NO: 17638 - DNA, 20 bp, Artificial Sequence
  sgRNA
tcaggactggtataagacct

SEQ ID NO: 17639 - DNA, 20 bp, Artificial Sequence
  sgRNA
agagagtggaagggctggat

SEQ ID NO: 17640 - DNA, 20 bp, Artificial Sequence
  sgRNA
tgggaggatatgcaaatttg

SEQ ID NO: 17641 - DNA, 20 bp, Artificial Sequence
  sgRNA
ctccaggaatttggacggag

SEQ ID NO: 17642 - DNA, 20 bp, Artificial Sequence
  sgRNA
tggacgttctgcagggagcc

SEQ ID NO: 17643 - DNA, 20 bp, Artificial Sequence
  sgRNA
gcaattaccagcttcctccc

SEQ ID NO: 17644 - DNA, 20 bp, Artificial Sequence
  sgRNA
cacacacacacacacactgt

SEQ ID NO: 17645 - DNA, 20 bp, Artificial Sequence
  sgRNA
ccgcaggttggagaggcata

SEQ ID NO: 17646 - DNA, 20 bp, Artificial Sequence
  sgRNA
agcatccgctctgtcatccc

SEQ ID NO: 17647 - DNA, 20 bp, Artificial Sequence
  sgRNA
atactgcagcaacctgttgc

SEQ ID NO: 17648 - DNA, 20 bp, Artificial Sequence
  sgRNA
ggtccgcaaggaccgcgaga

SEQ ID NO: 17649 - DNA, 20 bp, Artificial Sequence
  sgRNA
gggaggagtctcagtctgca

SEQ ID NO: 17650 - DNA, 20 bp, Artificial Sequence
  sgRNA
gtggcagtgtcctgcattcc

SEQ ID NO: 17651 - DNA, 20 bp, Artificial Sequence
  sgRNA
gcctccaagatcacaagtta

SEQ ID NO: 17652 - DNA, 20 bp, Artificial Sequence
  sgRNA
agagaggcacaagcattcta

SEQ ID NO: 17653 - DNA, 20 bp, Artificial Sequence
  sgRNA
gattagctgctgtgagccct

SEQ ID NO: 17654 - DNA, 20 bp, Artificial Sequence
  sgRNA
tgcgggtctggttgacgtgg

SEQ ID NO: 17655 - DNA, 20 bp, Artificial Sequence
  sgRNA
tgcgcacctcggaccctctg

SEQ ID NO: 17656 - DNA, 20 bp, Artificial Sequence
  sgRNA
cgcaccgcgaccgcagcgag

SEQ ID NO: 17657 - DNA, 20 bp, Artificial Sequence
  sgRNA
gaatatggttggatagcagc

SEQ ID NO: 17658 - DNA, 20 bp, Artificial Sequence
  sgRNA
gcttgaggtttggatctacg

SEQ ID NO: 17659 - DNA, 20 bp, Artificial Sequence
  sgRNA
aggcgcttccacgctcctat

SEQ ID NO: 17660 - DNA, 20 bp, Artificial Sequence
  sgRNA
ctagacgatattaagtgctt

SEQ ID NO: 17661 - DNA, 20 bp, Artificial Sequence
  sgRNA
tcagcaggttccctcgcctc

SEQ ID NO: 17662 - DNA, 20 bp, Artificial Sequence
  sgRNA
aaagtagcggaccggaaggg

SEQ ID NO: 17663 - DNA, 20 bp, Artificial Sequence
  sgRNA
gcacgggtgccagtgtggag

SEQ ID NO: 17664 - DNA, 20 bp, Artificial Sequence
  sgRNA
atgaccctgactgaagcgca

SEQ ID NO: 17665 - DNA, 20 bp, Artificial Sequence
  sgRNA
tcgtttgcgtttagtgggaa

SEQ ID NO: 17666 - DNA, 20 bp, Artificial Sequence
  sgRNA
ggcgcgttcagctaggcccg

SEQ ID NO: 17667 - DNA, 20 bp, Artificial Sequence
  sgRNA
gcagcgtcctgtgaggcgag

SEQ ID NO: 17668 - DNA, 20 bp, Artificial Sequence
  sgRNA
agtcgtggccgctcccttcg

SEQ ID NO: 17669 - DNA, 20 bp, Artificial Sequence
  sgRNA
gagatatccctccgcagagc

SEQ ID NO: 17670 - DNA, 20 bp, Artificial Sequence
  sgRNA
gacagtcgatttgctgacag

SEQ ID NO: 17671 - DNA, 20 bp, Artificial Sequence
  sgRNA
cctggctcggacgagggtac

SEQ ID NO: 17672 - DNA, 20 bp, Artificial Sequence
  sgRNA
tggttccaactgtcagttgc

SEQ ID NO: 17673 - DNA, 20 bp, Artificial Sequence
  sgRNA
gagctcacggaactccttgg

SEQ ID NO: 17674 - DNA, 20 bp, Artificial Sequence
  sgRNA
ccaaacagacactgttcctg

SEQ ID NO: 17675 - DNA, 20 bp, Artificial Sequence
  sgRNA
ctgtctaggaagggaagtcc

SEQ ID NO: 17676 - DNA, 20 bp, Artificial Sequence
  sgRNA
ggccaaatttgtgctatgcc

SEQ ID NO: 17677 - DNA, 20 bp, Artificial Sequence
  sgRNA
acactctgtttcttctagct

SEQ ID NO: 17678 - DNA, 20 bp, Artificial Sequence
  sgRNA
actgtcaacagttggagaaa

SEQ ID NO: 17679 - DNA, 20 bp, Artificial Sequence
  sgRNA
atagaaatgctgatatctct

SEQ ID NO: 17680 - DNA, 20 bp, Artificial Sequence
  sgRNA
gtgggaggatcttacagata

SEQ ID NO: 17681 - DNA, 20 bp, Artificial Sequence
  sgRNA
gcagagaagggcaagctacc

SEQ ID NO: 17682 - DNA, 20 bp, Artificial Sequence
  sgRNA
caagaggtctggaactcaag

SEQ ID NO: 17683 - DNA, 20 bp, Artificial Sequence
  sgRNA
agctgtgaactgcaaactgc

SEQ ID NO: 17684 - DNA, 20 bp, Artificial Sequence
  sgRNA
gcatgctgggtagaggtgaa

SEQ ID NO: 17685 - DNA, 20 bp, Artificial Sequence
  sgRNA
gctgggagtgatgagtttgt

SEQ ID NO: 17686 - DNA, 20 bp, Artificial Sequence
  sgRNA
gcgtcctgtgctggagactc

SEQ ID NO: 17687 - DNA, 20 bp, Artificial Sequence
  sgRNA
gggaacagggaacccgcgag

SEQ ID NO: 17688 - DNA, 20 bp, Artificial Sequence
  sgRNA
tcactcccagtggaacactg

SEQ ID NO: 17689 - DNA, 20 bp, Artificial Sequence
  sgRNA
gtgacggctagggccggcta

SEQ ID NO: 17690 - DNA, 20 bp, Artificial Sequence
  sgRNA
ctcccacactacacatcctc

SEQ ID NO: 17691 - DNA, 20 bp, Artificial Sequence
  sgRNA
ggaatcagcaatctaccact

SEQ ID NO: 17692 - DNA, 20 bp, Artificial Sequence
  sgRNA
cttaatatctaacgcttaag

SEQ ID NO: 17693 - DNA, 20 bp, Artificial Sequence
  sgRNA
gttcccaggtgacccatccc

SEQ ID NO: 17694 - DNA, 20 bp, Artificial Sequence
  sgRNA
aggtatataagagcatgaaa

SEQ ID NO: 17695 - DNA, 20 bp, Artificial Sequence
  sgRNA
agtgagtaaagcattacttt

SEQ ID NO: 17696 - DNA, 20 bp, Artificial Sequence
  sgRNA
atagagtttggttacttgaa

SEQ ID NO: 17697 - DNA, 20 bp, Artificial Sequence
  sgRNA
ggagctagagaaagaaccca

SEQ ID NO: 17698 - DNA, 20 bp, Artificial Sequence
  sgRNA
acgcgaacgctatggacacg

SEQ ID NO: 17699 - DNA, 20 bp, Artificial Sequence
  sgRNA
atattgaagcacaaggcccg

SEQ ID NO: 17700 - DNA, 20 bp, Artificial Sequence
  sgRNA
ctcaaacacagttctaatcc

SEQ ID NO: 17701 - DNA, 20 bp, Artificial Sequence
  sgRNA
tttgtattaccggctattgg

SEQ ID NO: 17702 - DNA, 20 bp, Artificial Sequence
  sgRNA
tttgttctgagagggagaga

SEQ ID NO: 17703 - DNA, 20 bp, Artificial Sequence
  sgRNA
ccgaccggaagtgcagctgc

SEQ ID NO: 17704 - DNA, 20 bp, Artificial Sequence
  sgRNA
gagtcggtaccgacggaggg

SEQ ID NO: 17705 - DNA, 20 bp, Artificial Sequence
  sgRNA
tccctcctactcacggcgcg

SEQ ID NO: 17706 - DNA, 20 bp, Artificial Sequence
  sgRNA
tgatggccacgtggcctcgc

SEQ ID NO: 17707 - DNA, 20 bp, Artificial Sequence
  sgRNA
gcacgaagcacggccggttc

SEQ ID NO: 17708 - DNA, 20 bp, Artificial Sequence
  sgRNA
ttcatagacttccagtaacc

SEQ ID NO: 17709 - DNA, 20 bp, Artificial Sequence
  sgRNA
ttcttctgtgctcactgcac

SEQ ID NO: 17710 - DNA, 20 bp, Artificial Sequence
  sgRNA
atgactaattggaccagttc

SEQ ID NO: 17711 - DNA, 20 bp, Artificial Sequence
  sgRNA
tttccgtcccaacaggctgc

SEQ ID NO: 17712 - DNA, 20 bp, Artificial Sequence
  sgRNA
gataatttcagaaccacaaa

SEQ ID NO: 17713 - DNA, 20 bp, Artificial Sequence
  sgRNA
gatacctccctcagcgtcgt

SEQ ID NO: 17714 - DNA, 20 bp, Artificial Sequence
  sgRNA
aagtgtccgtgggccgcgcg

SEQ ID NO: 17715 - DNA, 20 bp, Artificial Sequence
  sgRNA
cgaagcagcagccggcagat

SEQ ID NO: 17716 - DNA, 20 bp, Artificial Sequence
  sgRNA
tgctggccgcggcggtcgga

SEQ ID NO: 17717 - DNA, 20 bp, Artificial Sequence
  sgRNA
caggcgccctgggagcgccc

SEQ ID NO: 17718 - DNA, 20 bp, Artificial Sequence
  sgRNA
gggagtgcgcttgcgcacag

SEQ ID NO: 17719 - DNA, 20 bp, Artificial Sequence
  sgRNA
gtaggactgaatatagtttc

SEQ ID NO: 17720 - DNA, 20 bp, Artificial Sequence
  sgRNA
agtacggagcgatgctactc

SEQ ID NO: 17721 - DNA, 20 bp, Artificial Sequence
  sgRNA
cagaacaagttcccgaccgc

SEQ ID NO: 17722 - DNA, 20 bp, Artificial Sequence
  sgRNA
tgatgtcgaaatccgagtga

SEQ ID NO: 17723 - DNA, 20 bp, Artificial Sequence
  sgRNA
ctggtggctggagggtgcag

SEQ ID NO: 17724 - DNA, 20 bp, Artificial Sequence
  sgRNA
atcaagtgctggtgagtttg

SEQ ID NO: 17725 - DNA, 20 bp, Artificial Sequence
  sgRNA
cagccagctggctgtgacac

SEQ ID NO: 17726 - DNA, 20 bp, Artificial Sequence
  sgRNA
taggagccatttaatagaag

SEQ ID NO: 17727 - DNA, 20 bp, Artificial Sequence
  sgRNA
catttcttcaaagtttaacc

SEQ ID NO: 17728 - DNA, 20 bp, Artificial Sequence
  sgRNA
catctgcagtggtgttgtcc

SEQ ID NO: 17729 - DNA, 20 bp, Artificial Sequence
  sgRNA
aacgtgaatttgtcttgacc

SEQ ID NO: 17730 - DNA, 20 bp, Artificial Sequence
  sgRNA
atctctttaagaggcggacc

SEQ ID NO: 17731 - DNA, 20 bp, Artificial Sequence
  sgRNA
aataagcgttagggatagac

SEQ ID NO: 17732 - DNA, 20 bp, Artificial Sequence
  sgRNA
tgagtgtaaggctccatctg

SEQ ID NO: 17733 - DNA, 20 bp, Artificial Sequence
  sgRNA
ttcagacgtgatcaagcgcc

SEQ ID NO: 17734 - DNA, 20 bp, Artificial Sequence
  sgRNA
tttctcggtgcaatgtcttc

SEQ ID NO: 17735 - DNA, 20 bp, Artificial Sequence
  sgRNA
attatccactgtgtacagag

SEQ ID NO: 17736 - DNA, 20 bp, Artificial Sequence
  sgRNA
gtatagatacatataagtcc

SEQ ID NO: 17737 - DNA, 20 bp, Artificial Sequence
  sgRNA
tgtggctcaagttatataag

SEQ ID NO: 17738 - DNA, 20 bp, Artificial Sequence
  sgRNA
ttcttagggttcactttggt

SEQ ID NO: 17739 - DNA, 20 bp, Artificial Sequence
  sgRNA
agggatgcgttcattggaca

SEQ ID NO: 17740 - DNA, 20 bp, Artificial Sequence
  sgRNA
tgggcttatggaaggtagct

SEQ ID NO: 17741 - DNA, 20 bp, Artificial Sequence
  sgRNA
gaagagctaatgtcctcaag

SEQ ID NO: 17742 - DNA, 20 bp, Artificial Sequence
  sgRNA
caagtcttcgaagttccaat

SEQ ID NO: 17743 - DNA, 20 bp, Artificial Sequence
  sgRNA
cgtctctgtgctaactgaga

SEQ ID NO: 17744 - DNA, 20 bp, Artificial Sequence
  sgRNA
gaggcgggctaatagaggct

SEQ ID NO: 17745 - DNA, 20 bp, Artificial Sequence
  sgRNA
acgaagggagagcgaccaat

SEQ ID NO: 17746 - DNA, 20 bp, Artificial Sequence
  sgRNA
tctaactgtcgcgaatccgc

SEQ ID NO: 17747 - DNA, 20 bp, Artificial Sequence
  sgRNA
caattagagacagataaacc

SEQ ID NO: 17748 - DNA, 20 bp, Artificial Sequence
  sgRNA
aggattgtgtcagagggtgg

SEQ ID NO: 17749 - DNA, 20 bp, Artificial Sequence
  sgRNA
agtgtgaagttctgagagac

SEQ ID NO: 17750 - DNA, 20 bp, Artificial Sequence
  sgRNA
tccaagcagggtcaaggacc

SEQ ID NO: 17751 - DNA, 20 bp, Artificial Sequence
  sgRNA
actcctgatagtctgaagtc

SEQ ID NO: 17752 - DNA, 20 bp, Artificial Sequence
  sgRNA
acactgttattgtatccacg

SEQ ID NO: 17753 - DNA, 20 bp, Artificial Sequence
  sgRNA
accctagcgttgcagggccc

SEQ ID NO: 17754 - DNA, 20 bp, Artificial Sequence
  sgRNA
cgcttattgcttgcctatgg

SEQ ID NO: 17755 - DNA, 20 bp, Artificial Sequence
  sgRNA
cggcgcgtgtggttcctaac

SEQ ID NO: 17756 - DNA, 20 bp, Artificial Sequence
  sgRNA
cgtgtcgcgcagtagtccgt

SEQ ID NO: 17757 - DNA, 20 bp, Artificial Sequence
  sgRNA
ggcgtcgccatctcgccgta

SEQ ID NO: 17758 - DNA, 20 bp, Artificial Sequence
  sgRNA
tttaggagctccagtgacaa

SEQ ID NO: 17759 - DNA, 20 bp, Artificial Sequence
  sgRNA
ggaggccgagtgaacgccag

SEQ ID NO: 17760 - DNA, 20 bp, Artificial Sequence
  sgRNA
atcgggagtcacgtgggtcc

SEQ ID NO: 17761 - DNA, 20 bp, Artificial Sequence
  sgRNA
aactgtgctggctggccacc

SEQ ID NO: 17762 - DNA, 20 bp, Artificial Sequence
  sgRNA
gactggtgagacccgcctcc

SEQ ID NO: 17763 - DNA, 20 bp, Artificial Sequence
  sgRNA
ggtgaccaccgggcaggaag

SEQ ID NO: 17764 - DNA, 20 bp, Artificial Sequence
  sgRNA
cttgtcaggtgtcactacat

SEQ ID NO: 17765 - DNA, 20 bp, Artificial Sequence
  sgRNA
gggtaccgcctctacgtcaa

SEQ ID NO: 17766 - DNA, 20 bp, Artificial Sequence
  sgRNA
acaggtgggcgggacattgt

SEQ ID NO: 17767 - DNA, 20 bp, Artificial Sequence
  sgRNA
ggatgttgatgcggaagttt

SEQ ID NO: 17768 - DNA, 20 bp, Artificial Sequence
  sgRNA
cgctgagtcatccaagtccc

SEQ ID NO: 17769 - DNA, 20 bp, Artificial Sequence
  sgRNA
gagggtctcacataaagtcg

SEQ ID NO: 17770 - DNA, 20 bp, Artificial Sequence
  sgRNA
tgactcaggctaaggattcc

SEQ ID NO: 17771 - DNA, 20 bp, Artificial Sequence
  sgRNA
ggaaggtgttctccctcccg

SEQ ID NO: 17772 - DNA, 20 bp, Artificial Sequence
  sgRNA
gcgccctgcgacgcaccagt

SEQ ID NO: 17773 - DNA, 20 bp, Artificial Sequence
  sgRNA
cagccggaacccatcatgtt

SEQ ID NO: 17774 - DNA, 20 bp, Artificial Sequence
  sgRNA
ggaggatcaataacaatttg

SEQ ID NO: 17775 - DNA, 20 bp, Artificial Sequence
  sgRNA
gctcatccaaacaactggga

SEQ ID NO: 17776 - DNA, 20 bp, Artificial Sequence
  sgRNA
ggaaagtcccacctggttac

SEQ ID NO: 17777 - DNA, 20 bp, Artificial Sequence
  sgRNA
cccagacagcgtgggatccc

SEQ ID NO: 17778 - DNA, 20 bp, Artificial Sequence
  sgRNA
caggtggctagacactcgct

SEQ ID NO: 17779 - DNA, 20 bp, Artificial Sequence
  sgRNA
tttcaaacaactatcgcggg

SEQ ID NO: 17780 - DNA, 20 bp, Artificial Sequence
  sgRNA
gagtcagctccgggaccctc

SEQ ID NO: 17781 - DNA, 20 bp, Artificial Sequence
  sgRNA
tggcctgccgctctcccaat

SEQ ID NO: 17782 - DNA, 20 bp, Artificial Sequence
  sgRNA
gatgaagcagagccaaggca

SEQ ID NO: 17783 - DNA, 20 bp, Artificial Sequence
  sgRNA
aaccgactaacggaagccag

SEQ ID NO: 17784 - DNA, 20 bp, Artificial Sequence
  sgRNA
agctttgatttgaactgggc

SEQ ID NO: 17785 - DNA, 20 bp, Artificial Sequence
  sgRNA
agtaaactagctgtttgcag

SEQ ID NO: 17786 - DNA, 20 bp, Artificial Sequence
  sgRNA
ggcgggaacacatcctgagg

SEQ ID NO: 17787 - DNA, 20 bp, Artificial Sequence
  sgRNA
ggtggtggtggtagcggtgg

SEQ ID NO: 17788 - DNA, 20 bp, Artificial Sequence
  sgRNA
ccctcctcagacgccggccc

SEQ ID NO: 17789 - DNA, 20 bp, Artificial Sequence
  sgRNA
cgccgccgaggaggaggagg

SEQ ID NO: 17790 - DNA, 20 bp, Artificial Sequence
  sgRNA
tctttgatcatgacccatac

SEQ ID NO: 17791 - DNA, 20 bp, Artificial Sequence
  sgRNA
agttatctatctacactgca

SEQ ID NO: 17792 - DNA, 20 bp, Artificial Sequence
  sgRNA
ttactgacatactctccaaa

SEQ ID NO: 17793 - DNA, 20 bp, Artificial Sequence
  sgRNA
aggagccgaccgagcgcccg

SEQ ID NO: 17794 - DNA, 20 bp, Artificial Sequence
  sgRNA
cgagtcggcacctgccggcc

SEQ ID NO: 17795 - DNA, 20 bp, Artificial Sequence
  sgRNA
ttactcagacctggcgaaac

SEQ ID NO: 17796 - DNA, 20 bp, Artificial Sequence
  sgRNA
agaagagacagaagaggacc

SEQ ID NO: 17797 - DNA, 20 bp, Artificial Sequence
  sgRNA
gggaggccgctgacccgcca

SEQ ID NO: 17798 - DNA, 20 bp, Artificial Sequence
  sgRNA
agcgggcgcgctgggacttg

SEQ ID NO: 17799 - DNA, 20 bp, Artificial Sequence
  sgRNA
gctgttggttcagctcgcaa

SEQ ID NO: 17800 - DNA, 20 bp, Artificial Sequence
  sgRNA
cagacgcacttctcagtacg

SEQ ID NO: 17801 - DNA, 20 bp, Artificial Sequence
  sgRNA
cagcacaagctggcgatccc

SEQ ID NO: 17802 - DNA, 20 bp, Artificial Sequence
  sgRNA
tcgatacgcacctaaagcag

SEQ ID NO: 17803 - DNA, 20 bp, Artificial Sequence
  sgRNA
gtcgtgccgcgagatttgaa

SEQ ID NO: 17804 - DNA, 20 bp, Artificial Sequence
  sgRNA
ttgtgcttggtggcgagagg

SEQ ID NO: 17805 - DNA, 20 bp, Artificial Sequence
  sgRNA
gggaacaatggagcccttga

SEQ ID NO: 17806 - DNA, 20 bp, Artificial Sequence
  sgRNA
gcagggtgcagcattcctga

SEQ ID NO: 17807 - DNA, 20 bp, Artificial Sequence
  sgRNA
ggcagatcccacagggaaac

SEQ ID NO: 17808 - DNA, 20 bp, Artificial Sequence
  sgRNA
agcaactctctcaggttgag

SEQ ID NO: 17809 - DNA, 20 bp, Artificial Sequence
  sgRNA
atgctacttgatgctgtgat

SEQ ID NO: 17810 - DNA, 20 bp, Artificial Sequence
  sgRNA
tctgacatgtttatggcttc

SEQ ID NO: 17811 - DNA, 20 bp, Artificial Sequence
  sgRNA
catgattctgcaagccttac

SEQ ID NO: 17812 - DNA, 20 bp, Artificial Sequence
  sgRNA
ctactcctaacctgaaagtc

SEQ ID NO: 17813 - DNA, 20 bp, Artificial Sequence
  sgRNA
actgcttcatatgtatggca

SEQ ID NO: 17814 - DNA, 20 bp, Artificial Sequence
  sgRNA
gcagtttaagccaatacaac

SEQ ID NO: 17815 - DNA, 20 bp, Artificial Sequence
  sgRNA
atccttatataaagccattg

SEQ ID NO: 17816 - DNA, 20 bp, Artificial Sequence
  sgRNA
gtatttgcaccacccaaact

SEQ ID NO: 17817 - DNA, 20 bp, Artificial Sequence
  sgRNA
aatgcaatggcttctttcta

SEQ ID NO: 17818 - DNA, 20 bp, Artificial Sequence
  sgRNA
ctctggttgagagtgccttg

SEQ ID NO: 17819 - DNA, 20 bp, Artificial Sequence
  sgRNA
tctcaaagttccaagggtct

SEQ ID NO: 17820 - DNA, 20 bp, Artificial Sequence
  sgRNA
cagaggtgtgtgctgatgta

SEQ ID NO: 17821 - DNA, 20 bp, Artificial Sequence
  sgRNA
tttccctcgccagccaggta

SEQ ID NO: 17822 - DNA, 20 bp, Artificial Sequence
  sgRNA
ccctacgccggagagcccat

SEQ ID NO: 17823 - DNA, 20 bp, Artificial Sequence
  sgRNA
caagcaagctttgctgttgc

SEQ ID NO: 17824 - DNA, 20 bp, Artificial Sequence
  sgRNA
ctaaatgacaaagagggtgg

SEQ ID NO: 17825 - DNA, 20 bp, Artificial Sequence
  sgRNA
ggctattgcagcctacctct

SEQ ID NO: 17826 - DNA, 20 bp, Artificial Sequence
  sgRNA
gcttaggtcacagcaacaca

SEQ ID NO: 17827 - DNA, 20 bp, Artificial Sequence
  sgRNA
ctttctctaccacttctccc

SEQ ID NO: 17828 - DNA, 20 bp, Artificial Sequence
  sgRNA
agtgactcagcccagcctga

SEQ ID NO: 17829 - DNA, 20 bp, Artificial Sequence
  sgRNA
gggctggaccaaccctggcc

SEQ ID NO: 17830 - DNA, 20 bp, Artificial Sequence
  sgRNA
ctcgctgtctggcaccacag

SEQ ID NO: 17831 - DNA, 20 bp, Artificial Sequence
  sgRNA
gcaggcggcgacaaatctcc

SEQ ID NO: 17832 - DNA, 20 bp, Artificial Sequence
  sgRNA
gcctgacagagcgccctacc

SEQ ID NO: 17833 - DNA, 20 bp, Artificial Sequence
  sgRNA
aatggacagtctttgtgaaa

SEQ ID NO: 17834 - DNA, 20 bp, Artificial Sequence
  sgRNA
cagccctcagcaatggtgat

SEQ ID NO: 17835 - DNA, 20 bp, Artificial Sequence
  sgRNA
cgcttgtagacctcaaagaa

SEQ ID NO: 17836 - DNA, 20 bp, Artificial Sequence
  sgRNA
caccttaaggcctccgacgc

SEQ ID NO: 17837 - DNA, 20 bp, Artificial Sequence
  sgRNA
gccgctaggtcggcctggcg

SEQ ID NO: 17838 - DNA, 20 bp, Artificial Sequence
  sgRNA
gcattgtgggacagtggcgg

SEQ ID NO: 17839 - DNA, 20 bp, Artificial Sequence
  sgRNA
ctctaacggtcttcacacaa

SEQ ID NO: 17840 - DNA, 20 bp, Artificial Sequence
  sgRNA
tataactttcaactccatca

SEQ ID NO: 17841 - DNA, 20 bp, Artificial Sequence
  sgRNA
atttcagaatccttcttgcg

SEQ ID NO: 17842 - DNA, 20 bp, Artificial Sequence
  sgRNA
attcatgtcacggagactag

SEQ ID NO: 17843 - DNA, 20 bp, Artificial Sequence
  sgRNA
cccaggataaactttggcct

SEQ ID NO: 17844 - DNA, 20 bp, Artificial Sequence
  sgRNA
ctgaagaactcagacgccca

SEQ ID NO: 17845 - DNA, 20 bp, Artificial Sequence
  sgRNA
agaccagtggttcaatctcc

SEQ ID NO: 17846 - DNA, 20 bp, Artificial Sequence
  sgRNA
cagaacctggattgacgttt

SEQ ID NO: 17847 - DNA, 20 bp, Artificial Sequence
  sgRNA
cttgggtctccagccacgtt

SEQ ID NO: 17848 - DNA, 20 bp, Artificial Sequence
  sgRNA
ggagcggagcgccaaccggg

SEQ ID NO: 17849 - DNA, 20 bp, Artificial Sequence
  sgRNA
gaaggcgcatgcgcagatgc

SEQ ID NO: 17850 - DNA, 20 bp, Artificial Sequence
  sgRNA
gggcgggaacctttgctccg

SEQ ID NO: 17851 - DNA, 20 bp, Artificial Sequence
  sgRNA
taacccactttaaagaatca

SEQ ID NO: 17852 - DNA, 20 bp, Artificial Sequence
  sgRNA
ttgctaccaaccagtaattt

SEQ ID NO: 17853 - DNA, 20 bp, Artificial Sequence
  sgRNA
ttagatctaacaattggcac

SEQ ID NO: 17854 - DNA, 20 bp, Artificial Sequence
  sgRNA
ggagcggctgccggagggcc

SEQ ID NO: 17855 - DNA, 20 bp, Artificial Sequence
  sgRNA
cggctgcgcaggcatgccgg

SEQ ID NO: 17856 - DNA, 20 bp, Artificial Sequence
  sgRNA
ggccggaatgattagcccag

SEQ ID NO: 17857 - DNA, 20 bp, Artificial Sequence
  sgRNA
gggctcaggccgcaaggcta

SEQ ID NO: 17858 - DNA, 20 bp, Artificial Sequence
  sgRNA
ggattgtggcccgaggttgc

SEQ ID NO: 17859 - DNA, 20 bp, Artificial Sequence
  sgRNA
tagtttgagagagctgtctt

SEQ ID NO: 17860 - DNA, 20 bp, Artificial Sequence
  sgRNA
gtaatgggaggctcctaggc

SEQ ID NO: 17861 - DNA, 20 bp, Artificial Sequence
  sgRNA
gcaaagaaagtaggcgttaa

SEQ ID NO: 17862 - DNA, 20 bp, Artificial Sequence
  sgRNA
tcccattaccgctcgaagag

SEQ ID NO: 17863 - DNA, 20 bp, Artificial Sequence
  sgRNA
cgaggagctcctgtttcatt

SEQ ID NO: 17864 - DNA, 20 bp, Artificial Sequence
  sgRNA
atattataggttctcagtga

SEQ ID NO: 17865 - DNA, 20 bp, Artificial Sequence
  sgRNA
ccagacgccagagtctgtag

SEQ ID NO: 17866 - DNA, 20 bp, Artificial Sequence
  sgRNA
agcttggcaaagttagaatc

SEQ ID NO: 17867 - DNA, 20 bp, Artificial Sequence
  sgRNA
ggaggtgaagggttaattcc

SEQ ID NO: 17868 - DNA, 20 bp, Artificial Sequence
  sgRNA
gaggagccagaaacaaacca

SEQ ID NO: 17869 - DNA, 20 bp, Artificial Sequence
  sgRNA
tggcaagaagagataagtgg

SEQ ID NO: 17870 - DNA, 20 bp, Artificial Sequence
  sgRNA
attctcaattaggaaatctg

SEQ ID NO: 17871 - DNA, 20 bp, Artificial Sequence
  sgRNA
ataggaacaggatgcgctga

SEQ ID NO: 17872 - DNA, 20 bp, Artificial Sequence
  sgRNA
ctagttctcaacgaggctaa

SEQ ID NO: 17873 - DNA, 20 bp, Artificial Sequence
  sgRNA
gaacagtccatttgtcaggg

SEQ ID NO: 17874 - DNA, 20 bp, Artificial Sequence
  sgRNA
cgattgtaatttacagttgt

SEQ ID NO: 17875 - DNA, 20 bp, Artificial Sequence
  sgRNA
ggattgctgagaaactggtc

SEQ ID NO: 17876 - DNA, 20 bp, Artificial Sequence
  sgRNA
tctacattggctgacttagg

SEQ ID NO: 17877 - DNA, 20 bp, Artificial Sequence
  sgRNA
agttcagaggtaaggtcctc

SEQ ID NO: 17878 - DNA, 20 bp, Artificial Sequence
  sgRNA
cagtctacagctgccttggc

SEQ ID NO: 17879 - DNA, 20 bp, Artificial Sequence
  sgRNA
ctgaagcagtaggcccagtg

SEQ ID NO: 17880 - DNA, 20 bp, Artificial Sequence
  sgRNA
tgacatcacaggttcctgag

SEQ ID NO: 17881 - DNA, 20 bp, Artificial Sequence
  sgRNA
ctaaccctagaagtggtgtg

SEQ ID NO: 17882 - DNA, 20 bp, Artificial Sequence
  sgRNA
cggccagagcaggcacgtcc

SEQ ID NO: 17883 - DNA, 20 bp, Artificial Sequence
  sgRNA
ggagagcggaaaggcgtccc

SEQ ID NO: 17884 - DNA, 20 bp, Artificial Sequence
  sgRNA
gggagtgcgcgggtgaggcg

SEQ ID NO: 17885 - DNA, 20 bp, Artificial Sequence
  sgRNA
gcctgaaggaatggtgggcg

SEQ ID NO: 17886 - DNA, 20 bp, Artificial Sequence
  sgRNA
cgcgcgctctgcgatcatga

SEQ ID NO: 17887 - DNA, 20 bp, Artificial Sequence
  sgRNA
aagcaacccaacacaccaat

SEQ ID NO: 17888 - DNA, 20 bp, Artificial Sequence
  sgRNA
gcctagtggctgcctgggta

SEQ ID NO: 17889 - DNA, 20 bp, Artificial Sequence
  sgRNA
tctgcgcgcgcacgtcacgt

SEQ ID NO: 17890 - DNA, 20 bp, Artificial Sequence
  sgRNA
aggcaagcaagagtagtagc

SEQ ID NO: 17891 - DNA, 20 bp, Artificial Sequence
  sgRNA
tcacatgaacttcaagtatg

SEQ ID NO: 17892 - DNA, 20 bp, Artificial Sequence
  sgRNA
aagatagagtgaacatggtc

SEQ ID NO: 17893 - DNA, 20 bp, Artificial Sequence
  sgRNA
tcgcggtacagggtgtcacc

SEQ ID NO: 17894 - DNA, 20 bp, Artificial Sequence
  sgRNA
gctgacagccgcgcgctcat

SEQ ID NO: 17895 - DNA, 20 bp, Artificial Sequence
  sgRNA
ctccgcgggaggccgtccag

SEQ ID NO: 17896 - DNA, 20 bp, Artificial Sequence
  sgRNA
gaagagagcgagcttgaaga

SEQ ID NO: 17897 - DNA, 20 bp, Artificial Sequence
  sgRNA
gtcagaactaatgagcgggt

SEQ ID NO: 17898 - DNA, 20 bp, Artificial Sequence
  sgRNA
gaaagcgactcccagaggta

SEQ ID NO: 17899 - DNA, 20 bp, Artificial Sequence
  sgRNA
atccagggagacgcactgtg

SEQ ID NO: 17900 - DNA, 20 bp, Artificial Sequence
  sgRNA
tgcaagagagcagagagtca

SEQ ID NO: 17901 - DNA, 20 bp, Artificial Sequence
  sgRNA
gtcacaccaactggaagctc

SEQ ID NO: 17902 - DNA, 20 bp, Artificial Sequence
  sgRNA
gcttgtgcacatcaagctaa

SEQ ID NO: 17903 - DNA, 20 bp, Artificial Sequence
  sgRNA
gaagttaggtgttcttgcgc

SEQ ID NO: 17904 - DNA, 20 bp, Artificial Sequence
  sgRNA
tagttaagggataggtcatg

SEQ ID NO: 17905 - DNA, 20 bp, Artificial Sequence
  sgRNA
gcgaaacctcgagagtcagc

SEQ ID NO: 17906 - DNA, 20 bp, Artificial Sequence
  sgRNA
ggcctccctttgcgcttgcg

SEQ ID NO: 17907 - DNA, 20 bp, Artificial Sequence
  sgRNA
ctaaccttgcggataccaga

SEQ ID NO: 17908 - DNA, 20 bp, Artificial Sequence
  sgRNA
gttcctatagctttcaaacg

SEQ ID NO: 17909 - DNA, 20 bp, Artificial Sequence
  sgRNA
gcaaatccagcaagacaatg

SEQ ID NO: 17910 - DNA, 20 bp, Artificial Sequence
  sgRNA
tttgagagaatgcagaagca

SEQ ID NO: 17911 - DNA, 20 bp, Artificial Sequence
  sgRNA
aatccacggagggagggcct

SEQ ID NO: 17912 - DNA, 20 bp, Artificial Sequence
  sgRNA
cccgcgccgagccaaccaat

SEQ ID NO: 17913 - DNA, 20 bp, Artificial Sequence
  sgRNA
ttcagaccaatcgaattaac

SEQ ID NO: 17914 - DNA, 20 bp, Artificial Sequence
  sgRNA
gtccaaagacccgtcgcagc

SEQ ID NO: 17915 - DNA, 20 bp, Artificial Sequence
  sgRNA
gtttgatctctcggtgctag

SEQ ID NO: 17916 - DNA, 20 bp, Artificial Sequence
  sgRNA
cctggagttcccatgggtct

SEQ ID NO: 17917 - DNA, 20 bp, Artificial Sequence
  sgRNA
gccctggttgtcccggatcg

SEQ ID NO: 17918 - DNA, 20 bp, Artificial Sequence
  sgRNA
atccagtgtccaggtcttcc

SEQ ID NO: 17919 - DNA, 20 bp, Artificial Sequence
  sgRNA
agctgagggacccgcagccc

SEQ ID NO: 17920 - DNA, 20 bp, Artificial Sequence
  sgRNA
acgaaacttattctctggcc

SEQ ID NO: 17921 - DNA, 20 bp, Artificial Sequence
  sgRNA
ccttgtgttgagaaagcaag

SEQ ID NO: 17922 - DNA, 20 bp, Artificial Sequence
  sgRNA
ggcgggttaggtgaggactt

SEQ ID NO: 17923 - DNA, 20 bp, Artificial Sequence
  sgRNA
gtaatatctcacctgcgcag

SEQ ID NO: 17924 - DNA, 20 bp, Artificial Sequence
  sgRNA
attgatggcataatactggt

SEQ ID NO: 17925 - DNA, 20 bp, Artificial Sequence
  sgRNA
taagttgagggcttgtgcct

SEQ ID NO: 17926 - DNA, 20 bp, Artificial Sequence
  sgRNA
cactaccacagggctgccag

SEQ ID NO: 17927 - DNA, 20 bp, Artificial Sequence
  sgRNA
cagatatgagtgtgtcccag

SEQ ID NO: 17928 - DNA, 20 bp, Artificial Sequence
  sgRNA
tgggctccaggcctctttat

SEQ ID NO: 17929 - DNA, 20 bp, Artificial Sequence
  sgRNA
agccatccctaggcagggtg

SEQ ID NO: 17930 - DNA, 20 bp, Artificial Sequence
  sgRNA
ccgccctgcactacaagtgg

SEQ ID NO: 17931 - DNA, 20 bp, Artificial Sequence
  sgRNA
ctagctatttggtaagtatg

SEQ ID NO: 17932 - DNA, 20 bp, Artificial Sequence
  sgRNA
aaagtgtatgtcctggctgc

SEQ ID NO: 17933 - DNA, 20 bp, Artificial Sequence
  sgRNA
atatttgtcaggtcagttcc

SEQ ID NO: 17934 - DNA, 20 bp, Artificial Sequence
  sgRNA
tttgccttcccgtcagttcc

SEQ ID NO: 17935 - DNA, 20 bp, Artificial Sequence
  sgRNA
cgtatttgagaagcagtcaa

SEQ ID NO: 17936 - DNA, 20 bp, Artificial Sequence
  sgRNA
gggagaaacaaagggcttca

SEQ ID NO: 17937 - DNA, 20 bp, Artificial Sequence
  sgRNA
tttgcttcatgatgaccatg

SEQ ID NO: 17938 - DNA, 20 bp, Artificial Sequence
  sgRNA
gggtagtgggtagcagtctg

SEQ ID NO: 17939 - DNA, 20 bp, Artificial Sequence
  sgRNA
attgagtcaccgcagtcttg

SEQ ID NO: 17940 - DNA, 20 bp, Artificial Sequence
  sgRNA
gggaaattctgggcaagatt

SEQ ID NO: 17941 - DNA, 20 bp, Artificial Sequence
  sgRNA
ccgatttcacccaccagagc

SEQ ID NO: 17942 - DNA, 20 bp, Artificial Sequence
  sgRNA
atggagagctttccttcgca

SEQ ID NO: 17943 - DNA, 20 bp, Artificial Sequence
  sgRNA
aacgcacttcaggtagttct

SEQ ID NO: 17944 - DNA, 20 bp, Artificial Sequence
  sgRNA
tttgggctgcgcgtgtccac

SEQ ID NO: 17945 - DNA, 20 bp, Artificial Sequence
  sgRNA
gccggaatccggaatgcttc

SEQ ID NO: 17946 - DNA, 20 bp, Artificial Sequence
  sgRNA
gcgtattcttgtgggatggc

SEQ ID NO: 17947 - DNA, 20 bp, Artificial Sequence
  sgRNA
gtgaagtttaccatatttca

SEQ ID NO: 17948 - DNA, 20 bp, Artificial Sequence
  sgRNA
gacagatgcaccaagaggtg

SEQ ID NO: 17949 - DNA, 20 bp, Artificial Sequence
  sgRNA
ccctgcccgcccgcgtcgcg

SEQ ID NO: 17950 - DNA, 20 bp, Artificial Sequence
  sgRNA
tgactcgatctggaggagag

SEQ ID NO: 17951 - DNA, 20 bp, Artificial Sequence
  sgRNA
tcctcattgtgggccggccg

SEQ ID NO: 17952 - DNA, 20 bp, Artificial Sequence
  sgRNA
gcgctccacaagtcacagcg

SEQ ID NO: 17953 - DNA, 20 bp, Artificial Sequence
  sgRNA
gctgagaggcgagtacgcgg

SEQ ID NO: 17954 - DNA, 20 bp, Artificial Sequence
  sgRNA
cgcgtcacccacgtccctct

SEQ ID NO: 17955 - DNA, 20 bp, Artificial Sequence
  sgRNA
attggctgctcttgtgttcc

SEQ ID NO: 17956 - DNA, 20 bp, Artificial Sequence
  sgRNA
cctggtggcgaaaccgggcc

SEQ ID NO: 17957 - DNA, 20 bp, Artificial Sequence
  sgRNA
tcaagagttctctgcggctg

SEQ ID NO: 17958 - DNA, 20 bp, Artificial Sequence
  sgRNA
aatatcatagagctttgttg

SEQ ID NO: 17959 - DNA, 20 bp, Artificial Sequence
  sgRNA
tcaaccacgaaactagagag

SEQ ID NO: 17960 - DNA, 20 bp, Artificial Sequence
  sgRNA
gcaaactctggctaactacc

SEQ ID NO: 17961 - DNA, 20 bp, Artificial Sequence
  sgRNA
aggatatgagtctcctgaag

SEQ ID NO: 17962 - DNA, 20 bp, Artificial Sequence
  sgRNA
ctgaaggagtgcggattccc

SEQ ID NO: 17963 - DNA, 20 bp, Artificial Sequence
  sgRNA
tagctacgtcatcagttacc

SEQ ID NO: 17964 - DNA, 20 bp, Artificial Sequence
  sgRNA
gacagcgagctaaattatcc

SEQ ID NO: 17965 - DNA, 20 bp, Artificial Sequence
  sgRNA
cggctttatacaggcccggc

SEQ ID NO: 17966 - DNA, 20 bp, Artificial Sequence
  sgRNA
gcaattggacttgcagacgc

SEQ ID NO: 17967 - DNA, 20 bp, Artificial Sequence
  sgRNA
gggctagatggacaggtgcc

SEQ ID NO: 17968 - DNA, 20 bp, Artificial Sequence
  sgRNA
ggctgggcgctagactcgca

SEQ ID NO: 17969 - DNA, 20 bp, Artificial Sequence
  sgRNA
gcgcttagccagaggcgcga

SEQ ID NO: 17970 - DNA, 20 bp, Artificial Sequence
  sgRNA
gcggcgcaggccatccctag

SEQ ID NO: 17971 - DNA, 20 bp, Artificial Sequence
  sgRNA
cgcgtgcgtatgcgtcgccc

SEQ ID NO: 17972 - DNA, 20 bp, Artificial Sequence
  sgRNA
tcagaaccatggcaggaaag

SEQ ID NO: 17973 - DNA, 20 bp, Artificial Sequence
  sgRNA
tgggaaaggtttagagatgg

SEQ ID NO: 17974 - DNA, 20 bp, Artificial Sequence
  sgRNA
tggtgatgctatcctttgtc

SEQ ID NO: 17975 - DNA, 20 bp, Artificial Sequence
  sgRNA
aggttgagaaggcatcagca

SEQ ID NO: 17976 - DNA, 20 bp, Artificial Sequence
  sgRNA
ctaccacttctctgttgttt

SEQ ID NO: 17977 - DNA, 20 bp, Artificial Sequence
  sgRNA
acttaaactcgagattggaa

SEQ ID NO: 17978 - DNA, 20 bp, Artificial Sequence
  sgRNA
gctctctgttaccatgggaa

SEQ ID NO: 17979 - DNA, 20 bp, Artificial Sequence
  sgRNA
gccggcgagggcgggtagcc

SEQ ID NO: 17980 - DNA, 20 bp, Artificial Sequence
  sgRNA
gaggaagaagagggtaggtg

SEQ ID NO: 17981 - DNA, 20 bp, Artificial Sequence
  sgRNA
gtcactggaaggaggtgccg

SEQ ID NO: 17982 - DNA, 20 bp, Artificial Sequence
  sgRNA
cgttggctgttaccactctc

SEQ ID NO: 17983 - DNA, 20 bp, Artificial Sequence
  sgRNA
tccttcaggagtcgggtttc

SEQ ID NO: 17984 - DNA, 20 bp, Artificial Sequence
  sgRNA
gccgcagacttgccactgac

SEQ ID NO: 17985 - DNA, 20 bp, Artificial Sequence
  sgRNA
agccaaaggagattgccggt

SEQ ID NO: 17986 - DNA, 20 bp, Artificial Sequence
  sgRNA
cacgtaggttggcagccaat

SEQ ID NO: 17987 - DNA, 20 bp, Artificial Sequence
  sgRNA
gttatcttaagacactcatc

SEQ ID NO: 17988 - DNA, 20 bp, Artificial Sequence
  sgRNA
tgattatgctttagactcag

SEQ ID NO: 17989 - DNA, 20 bp, Artificial Sequence
  sgRNA
accttcagtgctactaggag

SEQ ID NO: 17990 - DNA, 20 bp, Artificial Sequence
  sgRNA
tcagattgtgatgcatactg

SEQ ID NO: 17991 - DNA, 20 bp, Artificial Sequence
  sgRNA
agggagggaagagagcaagg

SEQ ID NO: 17992 - DNA, 20 bp, Artificial Sequence
  sgRNA
ggcaccttgaaacgcgaggg

SEQ ID NO: 17993 - DNA, 20 bp, Artificial Sequence
  sgRNA
tgcgagctagacggcggcga

SEQ ID NO: 17994 - DNA, 20 bp, Artificial Sequence
  sgRNA
actaagaggagggagaaggg

SEQ ID NO: 17995 - DNA, 20 bp, Artificial Sequence
  sgRNA
ttacgaggcaaccaagagga

SEQ ID NO: 17996 - DNA, 20 bp, Artificial Sequence
  sgRNA
aaactggaggaagtaaaggg

SEQ ID NO: 17997 - DNA, 20 bp, Artificial Sequence
  sgRNA
actggtcccacagtccttcg

SEQ ID NO: 17998 - DNA, 20 bp, Artificial Sequence
  sgRNA
cgcgtttggaagggctaaag

SEQ ID NO: 17999 - DNA, 20 bp, Artificial Sequence
  sgRNA
accctattgtcgcgaagtgc

SEQ ID NO: 18000 - DNA, 20 bp, Artificial Sequence
  sgRNA
gcttgggtcttgaaactttg

SEQ ID NO: 18001 - DNA, 20 bp, Artificial Sequence
  sgRNA
aaccgaggcaggccatccag

SEQ ID NO: 18002 - DNA, 20 bp, Artificial Sequence
  sgRNA
tcaccgacatcttgcagcta

SEQ ID NO: 18003 - DNA, 20 bp, Artificial Sequence
  sgRNA
gaggccggacgttgtgagcc

SEQ ID NO: 18004 - DNA, 20 bp, Artificial Sequence
  sgRNA
ggagttcggcggacacagat

SEQ ID NO: 18005 - DNA, 20 bp, Artificial Sequence
  sgRNA
tccctttagttgggcatact

SEQ ID NO: 18006 - DNA, 20 bp, Artificial Sequence
  sgRNA
cttctttcgctttcatttcc

SEQ ID NO: 18007 - DNA, 20 bp, Artificial Sequence
  sgRNA
attccaatcctgggatagcg

SEQ ID NO: 18008 - DNA, 20 bp, Artificial Sequence
  sgRNA
gaagatagaaactaaggacg

SEQ ID NO: 18009 - DNA, 20 bp, Artificial Sequence
  sgRNA
taacagtcactgggtgtggc

SEQ ID NO: 18010 - DNA, 20 bp, Artificial Sequence
  sgRNA
gagtctgaatgtgttagctg

SEQ ID NO: 18011 - DNA, 20 bp, Artificial Sequence
  sgRNA
ggagctaaatccctctgctg

SEQ ID NO: 18012 - DNA, 20 bp, Artificial Sequence
  sgRNA
acagactccggattacagct

SEQ ID NO: 18013 - DNA, 20 bp, Artificial Sequence
  sgRNA
ctgtctttcagcgagggtcg

SEQ ID NO: 18014 - DNA, 20 bp, Artificial Sequence
  sgRNA
tctcagtggccgcaatcagt

SEQ ID NO: 18015 - DNA, 20 bp, Artificial Sequence
  sgRNA
ggcatcgcacttaaagggtt

SEQ ID NO: 18016 - DNA, 20 bp, Artificial Sequence
  sgRNA
cagaggtgtggcacattctc

SEQ ID NO: 18017 - DNA, 20 bp, Artificial Sequence
  sgRNA
tgatgccactagcatcctaa

SEQ ID NO: 18018 - DNA, 20 bp, Artificial Sequence
  sgRNA
atccacgtggcagagggacc

SEQ ID NO: 18019 - DNA, 20 bp, Artificial Sequence
  sgRNA
aaagcccggaccagctatcc

SEQ ID NO: 18020 - DNA, 20 bp, Artificial Sequence
  sgRNA
tgaggaaacaaactcgttca

SEQ ID NO: 18021 - DNA, 20 bp, Artificial Sequence
  sgRNA
tacgcgaggcacgtggacca

SEQ ID NO: 18022 - DNA, 20 bp, Artificial Sequence
  sgRNA
acaggtctgccatggttaaa

SEQ ID NO: 18023 - DNA, 20 bp, Artificial Sequence
  sgRNA
tttcctgcgtaagatagaaa

SEQ ID NO: 18024 - DNA, 20 bp, Artificial Sequence
  sgRNA
ggccactctggtcactgctt

SEQ ID NO: 18025 - DNA, 20 bp, Artificial Sequence
  sgRNA
ggcttgcccagctgtttacc

SEQ ID NO: 18026 - DNA, 20 bp, Artificial Sequence
  sgRNA
gtcaagtttagcactctggc

SEQ ID NO: 18027 - DNA, 20 bp, Artificial Sequence
  sgRNA
gctctgtgtcaacttgacac

SEQ ID NO: 18028 - DNA, 20 bp, Artificial Sequence
  sgRNA
tgctgcagccttgcccaatc

SEQ ID NO: 18029 - DNA, 20 bp, Artificial Sequence
  sgRNA
ccatccaggaccacctgccc

SEQ ID NO: 18030 - DNA, 20 bp, Artificial Sequence
  sgRNA
tgcccaagctcagcgcgcgg

SEQ ID NO: 18031 - DNA, 20 bp, Artificial Sequence
  sgRNA
agctaaggacgcgacgatca

SEQ ID NO: 18032 - DNA, 20 bp, Artificial Sequence
  sgRNA
ctgatggattgcatgagtgc

SEQ ID NO: 18033 - DNA, 20 bp, Artificial Sequence
  sgRNA
taaagggcaggagaattcac

SEQ ID NO: 18034 - DNA, 20 bp, Artificial Sequence
  sgRNA
tctttatctgtataccacaa

SEQ ID NO: 18035 - DNA, 20 bp, Artificial Sequence
  sgRNA
aaaggtcagacacactgatt

SEQ ID NO: 18036 - DNA, 20 bp, Artificial Sequence
  sgRNA
gataatcaagtctactatga

SEQ ID NO: 18037 - DNA, 20 bp, Artificial Sequence
  sgRNA
agggtggagcttcttgggtt

SEQ ID NO: 18038 - DNA, 20 bp, Artificial Sequence
  sgRNA
gctatgagtcatgttgccaa

SEQ ID NO: 18039 - DNA, 20 bp, Artificial Sequence
  sgRNA
gctgtagggcggcgatgcag

SEQ ID NO: 18040 - DNA, 20 bp, Artificial Sequence
  sgRNA
cctcactggagcggagagat

SEQ ID NO: 18041 - DNA, 20 bp, Artificial Sequence
  sgRNA
tctgggttgcacgcaggcta

SEQ ID NO: 18042 - DNA, 20 bp, Artificial Sequence
  sgRNA
ggagtaggctaagccaccag

SEQ ID NO: 18043 - DNA, 20 bp, Artificial Sequence
  sgRNA
gactagaatgaacgtgaatg

SEQ ID NO: 18044 - DNA, 20 bp, Artificial Sequence
  sgRNA
gccacagcacgcccagtttc

SEQ ID NO: 18045 - DNA, 20 bp, Artificial Sequence
  sgRNA
attgaatcagatccatacag

SEQ ID NO: 18046 - DNA, 20 bp, Artificial Sequence
  sgRNA
ttcctaggcttaaggccttt

SEQ ID NO: 18047 - DNA, 20 bp, Artificial Sequence
  sgRNA
gttgaccacctctttgtgtg

SEQ ID NO: 18048 - DNA, 20 bp, Artificial Sequence
  sgRNA
tcggctgagcatatgagtcc

SEQ ID NO: 18049 - DNA, 20 bp, Artificial Sequence
  sgRNA
gctaagagccagccatgcta

SEQ ID NO: 18050 - DNA, 20 bp, Artificial Sequence
  sgRNA
gaaaggtttcagaagcggac

SEQ ID NO: 18051 - DNA, 20 bp, Artificial Sequence
  sgRNA
gggccttgtttgtgccctgt

SEQ ID NO: 18052 - DNA, 20 bp, Artificial Sequence
  sgRNA
tttgacagccctccaaggtc

SEQ ID NO: 18053 - DNA, 20 bp, Artificial Sequence
  sgRNA
gaagattgtggccactctca

SEQ ID NO: 18054 - DNA, 20 bp, Artificial Sequence
  sgRNA
catgctataaaggcaacagc

SEQ ID NO: 18055 - DNA, 20 bp, Artificial Sequence
  sgRNA
ggatgtggcactaggcccgc

SEQ ID NO: 18056 - DNA, 20 bp, Artificial Sequence
  sgRNA
tggccactgacgttatgtaa

SEQ ID NO: 18057 - DNA, 20 bp, Artificial Sequence
  sgRNA
tgacgcagagctcatcgcta

SEQ ID NO: 18058 - DNA, 20 bp, Artificial Sequence
  sgRNA
ctgctgtccgtctgatccct

SEQ ID NO: 18059 - DNA, 20 bp, Artificial Sequence
  sgRNA
actgtcttcggttcttctac

SEQ ID NO: 18060 - DNA, 20 bp, Artificial Sequence
  sgRNA
gcaccacccgtagcgcttgg

SEQ ID NO: 18061 - DNA, 20 bp, Artificial Sequence
  sgRNA
gagtctctttagcgcgctca

SEQ ID NO: 18062 - DNA, 20 bp, Artificial Sequence
  sgRNA
gagagcggcgactggtgacg

SEQ ID NO: 18063 - DNA, 20 bp, Artificial Sequence
  sgRNA
aggcggtgcttgggccttgg

SEQ ID NO: 18064 - DNA, 20 bp, Artificial Sequence
  sgRNA
agctcgctgcagcactgccc

SEQ ID NO: 18065 - DNA, 20 bp, Artificial Sequence
  sgRNA
tgataacacaatgccacgtt

SEQ ID NO: 18066 - DNA, 20 bp, Artificial Sequence
  sgRNA
acgcctgggcgcacgtacaa

SEQ ID NO: 18067 - DNA, 20 bp, Artificial Sequence
  sgRNA
agtccctgaggcgcaatcgc

SEQ ID NO: 18068 - DNA, 20 bp, Artificial Sequence
  sgRNA
aagggaagggtcgccaggtg

SEQ ID NO: 18069 - DNA, 20 bp, Artificial Sequence
  sgRNA
tggcaaactggagctcttag

SEQ ID NO: 18070 - DNA, 20 bp, Artificial Sequence
  sgRNA
gctacctacaaagcaagtag

SEQ ID NO: 18071 - DNA, 20 bp, Artificial Sequence
  sgRNA
acatataagtaagttgacag

SEQ ID NO: 18072 - DNA, 20 bp, Artificial Sequence
  sgRNA
tctgcatatgtctctcattc

SEQ ID NO: 18073 - DNA, 20 bp, Artificial Sequence
  sgRNA
gacggttaccaggcacgcgg

SEQ ID NO: 18074 - DNA, 20 bp, Artificial Sequence
  sgRNA
tgacagcgttcagaggccat

SEQ ID NO: 18075 - DNA, 20 bp, Artificial Sequence
  sgRNA
ggagcctcgagctgtcaagc

SEQ ID NO: 18076 - DNA, 20 bp, Artificial Sequence
  sgRNA
cgatcggaaatcaactacta

SEQ ID NO: 18077 - DNA, 20 bp, Artificial Sequence
  sgRNA
gcgccgagcgcaggtccggg

SEQ ID NO: 18078 - DNA, 20 bp, Artificial Sequence
  sgRNA
gacacaaggagcagctttcc

SEQ ID NO: 18079 - DNA, 20 bp, Artificial Sequence
  sgRNA
cgcagcgcccgcagcgcacg

SEQ ID NO: 18080 - DNA, 20 bp, Artificial Sequence
  sgRNA
cgggaggtcgcggagctccg

SEQ ID NO: 18081 - DNA, 20 bp, Artificial Sequence
  sgRNA
tcggcgagcgcagctggcta

SEQ ID NO: 18082 - DNA, 20 bp, Artificial Sequence
  sgRNA
gggcggctcaggcctttccc

SEQ ID NO: 18083 - DNA, 20 bp, Artificial Sequence
  sgRNA
atccagggaggcgtgtccag

SEQ ID NO: 18084 - DNA, 20 bp, Artificial Sequence
  sgRNA
tgctgcatagagttaaagcc

SEQ ID NO: 18085 - DNA, 20 bp, Artificial Sequence
  sgRNA
acaagccaaatgccctttgg

SEQ ID NO: 18086 - DNA, 20 bp, Artificial Sequence
  sgRNA
ggttgcttacaagcatcacg

SEQ ID NO: 18087 - DNA, 20 bp, Artificial Sequence
  sgRNA
gcatgcgtctccgcgcccgg

SEQ ID NO: 18088 - DNA, 20 bp, Artificial Sequence
  sgRNA
tgcactccagcgagtcaacc

SEQ ID NO: 18089 - DNA, 20 bp, Artificial Sequence
  sgRNA
ctagctatctattaagaatg

SEQ ID NO: 18090 - DNA, 20 bp, Artificial Sequence
  sgRNA
caaccactggaagcgagagc

SEQ ID NO: 18091 - DNA, 20 bp, Artificial Sequence
  sgRNA
aagggaggagaccaaagaat

SEQ ID NO: 18092 - DNA, 20 bp, Artificial Sequence
  sgRNA
tctacttgtgttctatgctg

SEQ ID NO: 18093 - DNA, 20 bp, Artificial Sequence
  sgRNA
ccagtgagtgatatcaattc

SEQ ID NO: 18094 - DNA, 20 bp, Artificial Sequence
  sgRNA
gtcgcgtagaccctttccct

SEQ ID NO: 18095 - DNA, 20 bp, Artificial Sequence
  sgRNA
tgcagcatttgtggaaacct

SEQ ID NO: 18096 - DNA, 20 bp, Artificial Sequence
  sgRNA
aggcgctcctgtgtgttgcg

SEQ ID NO: 18097 - DNA, 20 bp, Artificial Sequence
  sgRNA
caatagaatagggagtaagc

SEQ ID NO: 18098 - DNA, 20 bp, Artificial Sequence
  sgRNA
aagtatggtgctcacacacc

SEQ ID NO: 18099 - DNA, 20 bp, Artificial Sequence
  sgRNA
gacagtgagagacaggatgt

SEQ ID NO: 18100 - DNA, 20 bp, Artificial Sequence
  sgRNA
ctgtatgagaataaacggtc

SEQ ID NO: 18101 - DNA, 20 bp, Artificial Sequence
  sgRNA
tcgctggcttgtgaaagcag

SEQ ID NO: 18102 - DNA, 20 bp, Artificial Sequence
  sgRNA
gctgattactcattcacttg

SEQ ID NO: 18103 - DNA, 20 bp, Artificial Sequence
  sgRNA
ccgcgtggcgcgacgcaccc

SEQ ID NO: 18104 - DNA, 20 bp, Artificial Sequence
  sgRNA
gtgaaagctctaacagaatg

SEQ ID NO: 18105 - DNA, 20 bp, Artificial Sequence
  sgRNA
gggaagtgtagtcgcatctg

SEQ ID NO: 18106 - DNA, 20 bp, Artificial Sequence
  sgRNA
gggcgtccgcgctccgctgt

SEQ ID NO: 18107 - DNA, 20 bp, Artificial Sequence
  sgRNA
ggacggtctgtgctgcgaag

SEQ ID NO: 18108 - DNA, 20 bp, Artificial Sequence
  sgRNA
agccgggcagggcgagaaca

SEQ ID NO: 18109 - DNA, 20 bp, Artificial Sequence
  sgRNA
gggcgggaggagccggcctc

SEQ ID NO: 18110 - DNA, 20 bp, Artificial Sequence
  sgRNA
cccggcgcgcgctcactgcc

SEQ ID NO: 18111 - DNA, 20 bp, Artificial Sequence
  sgRNA
cccacccgcagggtgggtgt

SEQ ID NO: 18112 - DNA, 20 bp, Artificial Sequence
  sgRNA
aaactctaaggaagttgact

SEQ ID NO: 18113 - DNA, 20 bp, Artificial Sequence
  sgRNA
cccgagctccgggatgccat

SEQ ID NO: 18114 - DNA, 20 bp, Artificial Sequence
  sgRNA
ggtaccctagatatgggagg

SEQ ID NO: 18115 - DNA, 20 bp, Artificial Sequence
  sgRNA
gtaaattcttacccagggtg

SEQ ID NO: 18116 - DNA, 20 bp, Artificial Sequence
  sgRNA
gacaaaccgtgcttcctagt

SEQ ID NO: 18117 - DNA, 20 bp, Artificial Sequence
  sgRNA
gaatggtaattctgtcagga

SEQ ID NO: 18118 - DNA, 20 bp, Artificial Sequence
  sgRNA
ggatttgtgctggatcttct

SEQ ID NO: 18119 - DNA, 20 bp, Artificial Sequence
  sgRNA
tgcgcgtaccgggtgaacgg

SEQ ID NO: 18120 - DNA, 20 bp, Artificial Sequence
  sgRNA
gaacgttctcttagccaatg

SEQ ID NO: 18121 - DNA, 20 bp, Artificial Sequence
  sgRNA
ctggcagggctcgccattgg

SEQ ID NO: 18122 - DNA, 20 bp, Artificial Sequence
  sgRNA
gttcgattcgagacggcctc

SEQ ID NO: 18123 - DNA, 20 bp, Artificial Sequence
  sgRNA
gcattgtacttgcaaggtgg

SEQ ID NO: 18124 - DNA, 20 bp, Artificial Sequence
  sgRNA
taggagtccgtggcgagagg

SEQ ID NO: 18125 - DNA, 20 bp, Artificial Sequence
  sgRNA
cagggatgccaagccaggcc

SEQ ID NO: 18126 - DNA, 20 bp, Artificial Sequence
  sgRNA
tggccagccagcccgggagg

SEQ ID NO: 18127 - DNA, 20 bp, Artificial Sequence
  sgRNA
ccgcgagcgctgcagtggcg

SEQ ID NO: 18128 - DNA, 20 bp, Artificial Sequence
  sgRNA
gtgtaggtgaatactgataa

SEQ ID NO: 18129 - DNA, 20 bp, Artificial Sequence
  sgRNA
gaactacctacaggcacaga

SEQ ID NO: 18130 - DNA, 20 bp, Artificial Sequence
  sgRNA
acaaatgacaaatatcaccc

SEQ ID NO: 18131 - DNA, 20 bp, Artificial Sequence
  sgRNA
tttctgctgctgcgcgaccc

SEQ ID NO: 18132 - DNA, 20 bp, Artificial Sequence
  sgRNA
ccacctccagccctgggcgg

SEQ ID NO: 18133 - DNA, 20 bp, Artificial Sequence
  sgRNA
ggctgggcacgcgcagtgcg

SEQ ID NO: 18134 - DNA, 20 bp, Artificial Sequence
  sgRNA
catcagaggtttgagggaga

SEQ ID NO: 18135 - DNA, 20 bp, Artificial Sequence
  sgRNA
gacttcatcatcctatcagg

SEQ ID NO: 18136 - DNA, 20 bp, Artificial Sequence
  sgRNA
cagctttgatctgagaggtg

SEQ ID NO: 18137 - DNA, 20 bp, Artificial Sequence
  sgRNA
gctggtcttctcctttataa

SEQ ID NO: 18138 - DNA, 20 bp, Artificial Sequence
  sgRNA
ggcaacagagttgagtcaac

SEQ ID NO: 18139 - DNA, 20 bp, Artificial Sequence
  sgRNA
ttgagtaacaacctttgcac

SEQ ID NO: 18140 - DNA, 20 bp, Artificial Sequence
  sgRNA
aagtttcctgatcttgttct

SEQ ID NO: 18141 - DNA, 20 bp, Artificial Sequence
  sgRNA
ttgtcaacatcatcacctcc

SEQ ID NO: 18142 - DNA, 20 bp, Artificial Sequence
  sgRNA
tctgtagaagcaagaataga

SEQ ID NO: 18143 - DNA, 20 bp, Artificial Sequence
  sgRNA
gtgccacaatcagagagaca

SEQ ID NO: 18144 - DNA, 20 bp, Artificial Sequence
  sgRNA
aggtcaaaggtcaactcgat

SEQ ID NO: 18145 - DNA, 20 bp, Artificial Sequence
  sgRNA
tcccgtctgacgcgggcaag

SEQ ID NO: 18146 - DNA, 20 bp, Artificial Sequence
  sgRNA
taaccttcacaagaacaatg

SEQ ID NO: 18147 - DNA, 20 bp, Artificial Sequence
  sgRNA
ttaaaggtgagacaggcgca

SEQ ID NO: 18148 - DNA, 20 bp, Artificial Sequence
  sgRNA
aaggagagaatcttgggata

SEQ ID NO: 18149 - DNA, 20 bp, Artificial Sequence
  sgRNA
gcgcgtgattgacaagggcg

SEQ ID NO: 18150 - DNA, 20 bp, Artificial Sequence
  sgRNA
caatcgttgagcggcctccg

SEQ ID NO: 18151 - DNA, 20 bp, Artificial Sequence
  sgRNA
gggtgatgcgtgctcctcag

SEQ ID NO: 18152 - DNA, 20 bp, Artificial Sequence
  sgRNA
gggtggacacgcagctgcgg

SEQ ID NO: 18153 - DNA, 20 bp, Artificial Sequence
  sgRNA
ccggcggtggtgacgttccc

SEQ ID NO: 18154 - DNA, 20 bp, Artificial Sequence
  sgRNA
ctatcatcctcacagggcat

SEQ ID NO: 18155 - DNA, 20 bp, Artificial Sequence
  sgRNA
tgcgcgagacacaggtcctg

SEQ ID NO: 18156 - DNA, 20 bp, Artificial Sequence
  sgRNA
atgcgccgtgcaattggcgc

SEQ ID NO: 18157 - DNA, 20 bp, Artificial Sequence
  sgRNA
ccgattcgcttcgaaacttg

SEQ ID NO: 18158 - DNA, 20 bp, Artificial Sequence
  sgRNA
catggagcgagcacttccgc

SEQ ID NO: 18159 - DNA, 20 bp, Artificial Sequence
  sgRNA
cgcgcacttccggctgtgtg

SEQ ID NO: 18160 - DNA, 20 bp, Artificial Sequence
  sgRNA
caccgccgccttgctctcat

SEQ ID NO: 18161 - DNA, 20 bp, Artificial Sequence
  sgRNA
ttcttaccgggctagctggg

SEQ ID NO: 18162 - DNA, 20 bp, Artificial Sequence
  sgRNA
cgcacgagggttgggcacgt

SEQ ID NO: 18163 - DNA, 20 bp, Artificial Sequence
  sgRNA
ttcggctgtagcagggcttg

SEQ ID NO: 18164 - DNA, 20 bp, Artificial Sequence
  sgRNA
gcccttgccctgagattgta

SEQ ID NO: 18165 - DNA, 20 bp, Artificial Sequence
  sgRNA
ttggagttgccagaaagtca

SEQ ID NO: 18166 - DNA, 20 bp, Artificial Sequence
  sgRNA
gccagcggacgtgaagcttt

SEQ ID NO: 18167 - DNA, 20 bp, Artificial Sequence
  sgRNA
tgcgcaggtgcgcgcgcgta

SEQ ID NO: 18168 - DNA, 20 bp, Artificial Sequence
  sgRNA
accctgactgcagtgcatgt

SEQ ID NO: 18169 - DNA, 20 bp, Artificial Sequence
  sgRNA
agagagagagagaagaggag

SEQ ID NO: 18170 - DNA, 20 bp, Artificial Sequence
  sgRNA
aaagagtttaccaggccctg

SEQ ID NO: 18171 - DNA, 20 bp, Artificial Sequence
  sgRNA
tttgtgcaatgctctgtaca

SEQ ID NO: 18172 - DNA, 20 bp, Artificial Sequence
  sgRNA
cgtatctatggactacagga

SEQ ID NO: 18173 - DNA, 20 bp, Artificial Sequence
  sgRNA
aatggttagtggctaccgcg

SEQ ID NO: 18174 - DNA, 20 bp, Artificial Sequence
  sgRNA
ggagcagcagtggccgtctt

SEQ ID NO: 18175 - DNA, 20 bp, Artificial Sequence
  sgRNA
aggagctggcaatagaaaga

SEQ ID NO: 18176 - DNA, 20 bp, Artificial Sequence
  sgRNA
ccagtggatagattaggcgg

SEQ ID NO: 18177 - DNA, 20 bp, Artificial Sequence
  sgRNA
ggcgcgcgcggacggcgagg

SEQ ID NO: 18178 - DNA, 20 bp, Artificial Sequence
  sgRNA
gacggcgcgggccgggtgcg

SEQ ID NO: 18179 - DNA, 20 bp, Artificial Sequence
  sgRNA
ctcggtcccgaggctcgaag

SEQ ID NO: 18180 - DNA, 20 bp, Artificial Sequence
  sgRNA
ggcctatggccagatggaaa

SEQ ID NO: 18181 - DNA, 20 bp, Artificial Sequence
  sgRNA
gaatgaaattgtcacagcga

SEQ ID NO: 18182 - DNA, 20 bp, Artificial Sequence
  sgRNA
gaggcggaggccgcacccag

SEQ ID NO: 18183 - DNA, 20 bp, Artificial Sequence
  sgRNA
tgccttataagtggctggcc

SEQ ID NO: 18184 - DNA, 20 bp, Artificial Sequence
  sgRNA
tagtttgctctgctgccacc

SEQ ID NO: 18185 - DNA, 20 bp, Artificial Sequence
  sgRNA
tgcacgggcattgagcgggc

SEQ ID NO: 18186 - DNA, 20 bp, Artificial Sequence
  sgRNA
actctaggtctcttggagcc

SEQ ID NO: 18187 - DNA, 20 bp, Artificial Sequence
  sgRNA
gaaaggtatatagtcacacc

SEQ ID NO: 18188 - DNA, 20 bp, Artificial Sequence
  sgRNA
tttcgatggtgtcaataata

SEQ ID NO: 18189 - DNA, 20 bp, Artificial Sequence
  sgRNA
ttctgaggagggttcattct

SEQ ID NO: 18190 - DNA, 20 bp, Artificial Sequence
  sgRNA
gaagtgggctgagagcttgg

SEQ ID NO: 18191 - DNA, 20 bp, Artificial Sequence
  sgRNA
agataggtgtgtaagaccca

SEQ ID NO: 18192 - DNA, 20 bp, Artificial Sequence
  sgRNA
ggcgaggccgagcgctgcgc

SEQ ID NO: 18193 - DNA, 20 bp, Artificial Sequence
  sgRNA
gcccggcatcgcaggcagcg

SEQ ID NO: 18194 - DNA, 20 bp, Artificial Sequence
  sgRNA
cccgtcccgcgggcccggcg

SEQ ID NO: 18195 - DNA, 20 bp, Artificial Sequence
  sgRNA
ctgctataaataccatgtcc

SEQ ID NO: 18196 - DNA, 20 bp, Artificial Sequence
  sgRNA
gatatatagatgtgtttcct

SEQ ID NO: 18197 - DNA, 20 bp, Artificial Sequence
  sgRNA
gttactatttgtggtgactg

SEQ ID NO: 18198 - DNA, 20 bp, Artificial Sequence
  sgRNA
aacggttatgaaatatgctc

SEQ ID NO: 18199 - DNA, 20 bp, Artificial Sequence
  sgRNA
ttgcaagtgacgttaaattc

SEQ ID NO: 18200 - DNA, 20 bp, Artificial Sequence
  sgRNA
actatataaagagtcaaagc

SEQ ID NO: 18201 - DNA, 20 bp, Artificial Sequence
  sgRNA
agactcaactattgatccag

SEQ ID NO: 18202 - DNA, 20 bp, Artificial Sequence
  sgRNA
attgaatcagatccatacac

SEQ ID NO: 18203 - DNA, 20 bp, Artificial Sequence
  sgRNA
gccagagtgaaactgtttaa

SEQ ID NO: 18204 - DNA, 20 bp, Artificial Sequence
  sgRNA
tttccagaaatgacccaggg

SEQ ID NO: 18205 - DNA, 20 bp, Artificial Sequence
  sgRNA
agtggctggttgccagtact

SEQ ID NO: 18206 - DNA, 20 bp, Artificial Sequence
  sgRNA
agcacgagcttaatgcccat

SEQ ID NO: 18207 - DNA, 20 bp, Artificial Sequence
  sgRNA
aagttctgagtagcccttcc

SEQ ID NO: 18208 - DNA, 20 bp, Artificial Sequence
  sgRNA
aaggacgtattagaatcaag

SEQ ID NO: 18209 - DNA, 20 bp, Artificial Sequence
  sgRNA
taagaacagacccatctcag

SEQ ID NO: 18210 - DNA, 20 bp, Artificial Sequence
  sgRNA
caggagctagctgccagcga

SEQ ID NO: 18211 - DNA, 20 bp, Artificial Sequence
  sgRNA
gcataattctgccagagatg

SEQ ID NO: 18212 - DNA, 20 bp, Artificial Sequence
  sgRNA
tacttgtcagataagtctcc

SEQ ID NO: 18213 - DNA, 20 bp, Artificial Sequence
  sgRNA
gtcactgatatcaatcagcc

SEQ ID NO: 18214 - DNA, 20 bp, Artificial Sequence
  sgRNA
ctgcgtagcgattggctaag

SEQ ID NO: 18215 - DNA, 20 bp, Artificial Sequence
  sgRNA
aggagagcctagcgtcatgg

SEQ ID NO: 18216 - DNA, 20 bp, Artificial Sequence
  sgRNA
ggcgccaaacgccagtcggc

SEQ ID NO: 18217 - DNA, 20 bp, Artificial Sequence
  sgRNA
acggaggcggtcgtcaagcc

SEQ ID NO: 18218 - DNA, 20 bp, Artificial Sequence
  sgRNA
acgcgccctttgaaactcag

SEQ ID NO: 18219 - DNA, 20 bp, Artificial Sequence
  sgRNA
ttccggtaggaaagtgggcg

SEQ ID NO: 18220 - DNA, 20 bp, Artificial Sequence
  sgRNA
caacagtgcactcagctgat

SEQ ID NO: 18221 - DNA, 20 bp, Artificial Sequence
  sgRNA
ggtagatgcgcgctgcgctc

SEQ ID NO: 18222 - DNA, 20 bp, Artificial Sequence
  sgRNA
gttgttgggacacgtgacca

SEQ ID NO: 18223 - DNA, 20 bp, Artificial Sequence
  sgRNA
gagcagttcttccagccaat

SEQ ID NO: 18224 - DNA, 20 bp, Artificial Sequence
  sgRNA
ggaggcggaagttcggcaag

SEQ ID NO: 18225 - DNA, 20 bp, Artificial Sequence
  sgRNA
gggcggaaactctcgggccc

SEQ ID NO: 18226 - DNA, 20 bp, Artificial Sequence
  sgRNA
ggtcagtgagcgtagcgagg

SEQ ID NO: 18227 - DNA, 20 bp, Artificial Sequence
  sgRNA
caaagcagtctcgagcctcg

SEQ ID NO: 18228 - DNA, 20 bp, Artificial Sequence
  sgRNA
acagctctgacgcacctcct

SEQ ID NO: 18229 - DNA, 20 bp, Artificial Sequence
  sgRNA
gagaatttctggaactttca

SEQ ID NO: 18230 - DNA, 20 bp, Artificial Sequence
  sgRNA
cacctttgattggtttatga

SEQ ID NO: 18231 - DNA, 20 bp, Artificial Sequence
  sgRNA
attcaaatgagggatgtgaa

SEQ ID NO: 18232 - DNA, 20 bp, Artificial Sequence
  sgRNA
ttacggaataggaaagctag

SEQ ID NO: 18233 - DNA, 20 bp, Artificial Sequence
  sgRNA
tacagtccgttcgcttcgcc

SEQ ID NO: 18234 - DNA, 20 bp, Artificial Sequence
  sgRNA
gggctggactaagagtgatg

SEQ ID NO: 18235 - DNA, 20 bp, Artificial Sequence
  sgRNA
gatgtgtatcctcctcctta

SEQ ID NO: 18236 - DNA, 20 bp, Artificial Sequence
  sgRNA
gaggtcctcagctggccctg

SEQ ID NO: 18237 - DNA, 20 bp, Artificial Sequence
  sgRNA
agaagaatgagaagttgagg

SEQ ID NO: 18238 - DNA, 20 bp, Artificial Sequence
  sgRNA
gaatccggcatccaagatgt

SEQ ID NO: 18239 - DNA, 20 bp, Artificial Sequence
  sgRNA
caccgggcctagaggatgtg

SEQ ID NO: 18240 - DNA, 20 bp, Artificial Sequence
  sgRNA
aatccgatcctcctcccaac

SEQ ID NO: 18241 - DNA, 20 bp, Artificial Sequence
  sgRNA
cccgtcgggaccgcggctct

SEQ ID NO: 18242 - DNA, 20 bp, Artificial Sequence
  sgRNA
catgaatcctcgggccctcc

SEQ ID NO: 18243 - DNA, 20 bp, Artificial Sequence
  sgRNA
ttctcttggccaaggtcctg

SEQ ID NO: 18244 - DNA, 20 bp, Artificial Sequence
  sgRNA
gggcaggtggtttcacaggg

SEQ ID NO: 18245 - DNA, 20 bp, Artificial Sequence
  sgRNA
gtgggcactaccgcagttcc

SEQ ID NO: 18246 - DNA, 20 bp, Artificial Sequence
  sgRNA
gttctgcccagccatgagaa

SEQ ID NO: 18247 - DNA, 20 bp, Artificial Sequence
  sgRNA
tttgaaggttataaggcacc

SEQ ID NO: 18248 - DNA, 20 bp, Artificial Sequence
  sgRNA
ggatccttccattatctaga

SEQ ID NO: 18249 - DNA, 20 bp, Artificial Sequence
  sgRNA
tgacaaactattctgccctg

SEQ ID NO: 18250 - DNA, 20 bp, Artificial Sequence
  sgRNA
cagttcacgtcgcacgcctg

SEQ ID NO: 18251 - DNA, 20 bp, Artificial Sequence
  sgRNA
ttctgcgcatgcgcacaaac

SEQ ID NO: 18252 - DNA, 20 bp, Artificial Sequence
  sgRNA
gtcctcgcttgcgtcagtct

SEQ ID NO: 18253 - DNA, 20 bp, Artificial Sequence
  sgRNA
cccgctcagccggaaccacc

SEQ ID NO: 18254 - DNA, 20 bp, Artificial Sequence
  sgRNA
aggacgccaaatggttacta

SEQ ID NO: 18255 - DNA, 20 bp, Artificial Sequence
  sgRNA
agcactaccggacagctcag

SEQ ID NO: 18256 - DNA, 20 bp, Artificial Sequence
  sgRNA
aggtgctgcgcgtgcgcagt

SEQ ID NO: 18257 - DNA, 20 bp, Artificial Sequence
  sgRNA
atggaacttgtagtttcact

SEQ ID NO: 18258 - DNA, 20 bp, Artificial Sequence
  sgRNA
cttaagatggcgggctactc

SEQ ID NO: 18259 - DNA, 20 bp, Artificial Sequence
  sgRNA
tgttattctctgagggcatg

SEQ ID NO: 18260 - DNA, 20 bp, Artificial Sequence
  sgRNA
tcttggaggtagaacataaa

SEQ ID NO: 18261 - DNA, 20 bp, Artificial Sequence
  sgRNA
catcctacctaggtgtcctt

SEQ ID NO: 18262 - DNA, 20 bp, Artificial Sequence
  sgRNA
tttggagacggagacaggtc

SEQ ID NO: 18263 - DNA, 20 bp, Artificial Sequence
  sgRNA
gtcgctggcagcgcggtcgg

SEQ ID NO: 18264 - DNA, 20 bp, Artificial Sequence
  sgRNA
tttcccgccattgtgagaag

SEQ ID NO: 18265 - DNA, 20 bp, Artificial Sequence
  sgRNA
aatatactgattgacatctc

SEQ ID NO: 18266 - DNA, 20 bp, Artificial Sequence
  sgRNA
ggtctagagtactaaatgaa

SEQ ID NO: 18267 - DNA, 20 bp, Artificial Sequence
  sgRNA
taaagtgggtcaggttggtt

SEQ ID NO: 18268 - DNA, 20 bp, Artificial Sequence
  sgRNA
cctcagtataaagtccagcc

SEQ ID NO: 18269 - DNA, 20 bp, Artificial Sequence
  sgRNA
tcaggatgaccaatgtcaac

SEQ ID NO: 18270 - DNA, 20 bp, Artificial Sequence
  sgRNA
atgtcataggacagacacta

SEQ ID NO: 18271 - DNA, 20 bp, Artificial Sequence
  sgRNA
ctttgctgagcaacgcgcaa

SEQ ID NO: 18272 - DNA, 20 bp, Artificial Sequence
  sgRNA
tggctgaggtcggctctcag

SEQ ID NO: 18273 - DNA, 20 bp, Artificial Sequence
  sgRNA
ctgcggacacctccttagcc

SEQ ID NO: 18274 - DNA, 20 bp, Artificial Sequence
  sgRNA
cctttgagttggccaatcac

SEQ ID NO: 18275 - DNA, 20 bp, Artificial Sequence
  sgRNA
ttcgctagcccgcccggaag

SEQ ID NO: 18276 - DNA, 20 bp, Artificial Sequence
  sgRNA
gcatgccaagacctctttac

SEQ ID NO: 18277 - DNA, 20 bp, Artificial Sequence
  sgRNA
ggctgtctgccaagagttcg

SEQ ID NO: 18278 - DNA, 20 bp, Artificial Sequence
  sgRNA
acccagacagctccctcgca

SEQ ID NO: 18279 - DNA, 20 bp, Artificial Sequence
  sgRNA
aacagggagggagctaacct

SEQ ID NO: 18280 - DNA, 20 bp, Artificial Sequence
  sgRNA
attagctttctcggcttcta

SEQ ID NO: 18281 - DNA, 20 bp, Artificial Sequence
  sgRNA
attccactaggtgggaatgc

SEQ ID NO: 18282 - DNA, 20 bp, Artificial Sequence
  sgRNA
attctgaccgcatctcattt

SEQ ID NO: 18283 - DNA, 20 bp, Artificial Sequence
  sgRNA
ctaacgttcgtactttagct

SEQ ID NO: 18284 - DNA, 20 bp, Artificial Sequence
  sgRNA
gggaggtgcaggtcttcggg

SEQ ID NO: 18285 - DNA, 20 bp, Artificial Sequence
  sgRNA
cggagccggcgcgagaatcc

SEQ ID NO: 18286 - DNA, 20 bp, Artificial Sequence
  sgRNA
atgtttgacccaatctgtaa

SEQ ID NO: 18287 - DNA, 20 bp, Artificial Sequence
  sgRNA
tatcagatgggagagttcca

SEQ ID NO: 18288 - DNA, 20 bp, Artificial Sequence
  sgRNA
caatcagagagctggagcta

SEQ ID NO: 18289 - DNA, 20 bp, Artificial Sequence
  sgRNA
attgtggcgtcaactcacgc

SEQ ID NO: 18290 - DNA, 20 bp, Artificial Sequence
  sgRNA
gttgcttggcagagatgccg

SEQ ID NO: 18291 - DNA, 20 bp, Artificial Sequence
  sgRNA
tcgttgcttagggtggagcc

SEQ ID NO: 18292 - DNA, 20 bp, Artificial Sequence
  sgRNA
ggtcctatctaaccggtcat

SEQ ID NO: 18293 - DNA, 20 bp, Artificial Sequence
  sgRNA
atgaccaatcaaccagtcag

SEQ ID NO: 18294 - DNA, 20 bp, Artificial Sequence
  sgRNA
tggccaatctgtgagccgca

SEQ ID NO: 18295 - DNA, 20 bp, Artificial Sequence
  sgRNA
cctgaaagcccgtgcgaccc

SEQ ID NO: 18296 - DNA, 20 bp, Artificial Sequence
  sgRNA
gcaggctttgcattataagc

SEQ ID NO: 18297 - DNA, 20 bp, Artificial Sequence
  sgRNA
gggagaggtgtctggttact

SEQ ID NO: 18298 - DNA, 20 bp, Artificial Sequence
  sgRNA
cctagcaacaagagactctc

SEQ ID NO: 18299 - DNA, 20 bp, Artificial Sequence
  sgRNA
ggattcaatagaaagctaag

SEQ ID NO: 18300 - DNA, 20 bp, Artificial Sequence
  sgRNA
cagaacagtgcaactagcta

SEQ ID NO: 18301 - DNA, 20 bp, Artificial Sequence
  sgRNA
ggatttcgaatctacagtcc

SEQ ID NO: 18302 - DNA, 20 bp, Artificial Sequence
  sgRNA
ctttgtttagtcagtctcct

SEQ ID NO: 18303 - DNA, 20 bp, Artificial Sequence
  sgRNA
ggagagagggcactttcatt

SEQ ID NO: 18304 - DNA, 20 bp, Artificial Sequence
  sgRNA
tgctgggcaggtccttggcg

SEQ ID NO: 18305 - DNA, 20 bp, Artificial Sequence
  sgRNA
cgtcttgtgtatgttgccag

SEQ ID NO: 18306 - DNA, 20 bp, Artificial Sequence
  sgRNA
tgcctgggaagcagcccttg

SEQ ID NO: 18307 - DNA, 20 bp, Artificial Sequence
  sgRNA
atccagagaagataacgtta

SEQ ID NO: 18308 - DNA, 20 bp, Artificial Sequence
  sgRNA
cagatcttcagcggcctttg

SEQ ID NO: 18309 - DNA, 20 bp, Artificial Sequence
  sgRNA
cgggtgcttcgtgccaaatg

SEQ ID NO: 18310 - DNA, 20 bp, Artificial Sequence
  sgRNA
gcagagcgtgagatcatttc

SEQ ID NO: 18311 - DNA, 20 bp, Artificial Sequence
  sgRNA
ttcccgcccacagtagaatc

SEQ ID NO: 18312 - DNA, 20 bp, Artificial Sequence
  sgRNA
gtctccttctctaagaattc

SEQ ID NO: 18313 - DNA, 20 bp, Artificial Sequence
  sgRNA
gggagcgtcctagaggctcc

SEQ ID NO: 18314 - DNA, 20 bp, Artificial Sequence
  sgRNA
ggcccgcacgcacgcggctg

SEQ ID NO: 18315 - DNA, 20 bp, Artificial Sequence
  sgRNA
ccaggtcggtgctcacaatg

SEQ ID NO: 18316 - DNA, 20 bp, Artificial Sequence
  sgRNA
tttataacgtgaaaccttca

SEQ ID NO: 18317 - DNA, 20 bp, Artificial Sequence
  sgRNA
gcttctaaatgagattgaaa

SEQ ID NO: 18318 - DNA, 20 bp, Artificial Sequence
  sgRNA
cttaatgagccgtgcattct

SEQ ID NO: 18319 - DNA, 20 bp, Artificial Sequence
  sgRNA
caagacctccagctcaaggg

SEQ ID NO: 18320 - DNA, 20 bp, Artificial Sequence
  sgRNA
ttcacatgacttgcttagcc

SEQ ID NO: 18321 - DNA, 20 bp, Artificial Sequence
  sgRNA
gcatgaaactcagcctcatt

SEQ ID NO: 18322 - DNA, 20 bp, Artificial Sequence
  sgRNA
gatggtttgtctaccgttgt

SEQ ID NO: 18323 - DNA, 20 bp, Artificial Sequence
  sgRNA
tgagctgggacgtagctcac

SEQ ID NO: 18324 - DNA, 20 bp, Artificial Sequence
  sgRNA
ggaggcaaatagcagggttt

SEQ ID NO: 18325 - DNA, 20 bp, Artificial Sequence
  sgRNA
gatatgtgtcctaaaggatg

SEQ ID NO: 18326 - DNA, 20 bp, Artificial Sequence
  sgRNA
acatcatagctattatgaga

SEQ ID NO: 18327 - DNA, 20 bp, Artificial Sequence
  sgRNA
ctgctcttaggaaattacag

SEQ ID NO: 18328 - DNA, 20 bp, Artificial Sequence
  sgRNA
tggcgaacaaaggcggcgcg

SEQ ID NO: 18329 - DNA, 20 bp, Artificial Sequence
  sgRNA
cccgcgggctccggcagctt

SEQ ID NO: 18330 - DNA, 20 bp, Artificial Sequence
  sgRNA
cgcgtctccctagcaggagg

SEQ ID NO: 18331 - DNA, 20 bp, Artificial Sequence
  sgRNA
cgggttggatccggaatgct

SEQ ID NO: 18332 - DNA, 20 bp, Artificial Sequence
  sgRNA
ccgcctgtcccgtctaccaa

SEQ ID NO: 18333 - DNA, 20 bp, Artificial Sequence
  sgRNA
caacgcccactgctgcgcgg

SEQ ID NO: 18334 - DNA, 20 bp, Artificial Sequence
  sgRNA
gaatgaaatgtaaatgggcc

SEQ ID NO: 18335 - DNA, 20 bp, Artificial Sequence
  sgRNA
gtggccaatcagctgttcgc

SEQ ID NO: 18336 - DNA, 20 bp, Artificial Sequence
  sgRNA
gcgcggcgtcaagtgcagct

SEQ ID NO: 18337 - DNA, 20 bp, Artificial Sequence
  sgRNA
catggaaggaaagaggactg

SEQ ID NO: 18338 - DNA, 20 bp, Artificial Sequence
  sgRNA
aatcctgagttgggtggagt

SEQ ID NO: 18339 - DNA, 20 bp, Artificial Sequence
  sgRNA
actggaggagggatcttaag

SEQ ID NO: 18340 - DNA, 20 bp, Artificial Sequence
  sgRNA
ggcgcgcctagccggcctgg

SEQ ID NO: 18341 - DNA, 20 bp, Artificial Sequence
  sgRNA
cgggcgcgcgcctcgcgacg

SEQ ID NO: 18342 - DNA, 20 bp, Artificial Sequence
  sgRNA
gagccagaccacgcgatccg

SEQ ID NO: 18343 - DNA, 20 bp, Artificial Sequence
  sgRNA
tcccaccgggcagccaacca

SEQ ID NO: 18344 - DNA, 20 bp, Artificial Sequence
  sgRNA
gctcgttccttctctcctat

SEQ ID NO: 18345 - DNA, 20 bp, Artificial Sequence
  sgRNA
aaagaattgagggagggaga

SEQ ID NO: 18346 - DNA, 20 bp, Artificial Sequence
  sgRNA
ccctctgggctttaacttcg

SEQ ID NO: 18347 - DNA, 20 bp, Artificial Sequence
  sgRNA
gctcgggaggctaacgttag

SEQ ID NO: 18348 - DNA, 20 bp, Artificial Sequence
  sgRNA
cctgcaccgagggctcaccc

SEQ ID NO: 18349 - DNA, 20 bp, Artificial Sequence
  sgRNA
gtggcgtcctggcgttgcct

SEQ ID NO: 18350 - DNA, 20 bp, Artificial Sequence
  sgRNA
tcttcctcctgcacagagcc

SEQ ID NO: 18351 - DNA, 20 bp, Artificial Sequence
  sgRNA
acaaagggcccagttgcttg

SEQ ID NO: 18352 - DNA, 20 bp, Artificial Sequence
  sgRNA
tagaacgcacgcgcgccgtg

SEQ ID NO: 18353 - DNA, 20 bp, Artificial Sequence
  sgRNA
ctgcgtaccgccagcgcacg

SEQ ID NO: 18354 - DNA, 20 bp, Artificial Sequence
  sgRNA
ggaagcgttctggacgatct

SEQ ID NO: 18355 - DNA, 20 bp, Artificial Sequence
  sgRNA
ggacgaacagacacgtgctg

SEQ ID NO: 18356 - DNA, 20 bp, Artificial Sequence
  sgRNA
gggacaaacctagagcgaca

SEQ ID NO: 18357 - DNA, 20 bp, Artificial Sequence
  sgRNA
cttcccacacgcgccctgcc

SEQ ID NO: 18358 - DNA, 20 bp, Artificial Sequence
  sgRNA
ccgacctggctgtgaggccg

SEQ ID NO: 18359 - DNA, 20 bp, Artificial Sequence
  sgRNA
gatgggcgtgtttatgggcg

SEQ ID NO: 18360 - DNA, 20 bp, Artificial Sequence
  sgRNA
gcccagaaccttctgagttt

SEQ ID NO: 18361 - DNA, 20 bp, Artificial Sequence
  sgRNA
gcactaactttcggctggca

SEQ ID NO: 18362 - DNA, 20 bp, Artificial Sequence
  sgRNA
gacgagcgctgcgccagcga

SEQ ID NO: 18363 - DNA, 20 bp, Artificial Sequence
  sgRNA
ccggtgcacagcaagtgtcc

SEQ ID NO: 18364 - DNA, 20 bp, Artificial Sequence
  sgRNA
acaatttgggctgaaggttg

SEQ ID NO: 18365 - DNA, 20 bp, Artificial Sequence
  sgRNA
agtatcctcacgtctaagcc

SEQ ID NO: 18366 - DNA, 20 bp, Artificial Sequence
  sgRNA
tgcttcgtgctggagtggac

SEQ ID NO: 18367 - DNA, 20 bp, Artificial Sequence
  sgRNA
ttggctgcgcgctgagctag

SEQ ID NO: 18368 - DNA, 20 bp, Artificial Sequence
  sgRNA
cgggcacgcggcgctgtccg

SEQ ID NO: 18369 - DNA, 20 bp, Artificial Sequence
  sgRNA
agggcgccagccaatggcgg

SEQ ID NO: 18370 - DNA, 20 bp, Artificial Sequence
  sgRNA
aggcccttggaaggaggtgg

SEQ ID NO: 18371 - DNA, 20 bp, Artificial Sequence
  sgRNA
tcgggtgcccataggtgtac

SEQ ID NO: 18372 - DNA, 20 bp, Artificial Sequence
  sgRNA
ccagcgctcagcttccgatc

SEQ ID NO: 18373 - DNA, 20 bp, Artificial Sequence
  sgRNA
ccgaagggagcttgaactag

SEQ ID NO: 18374 - DNA, 20 bp, Artificial Sequence
  sgRNA
ctccctcaagtctccacgaa

SEQ ID NO: 18375 - DNA, 20 bp, Artificial Sequence
  sgRNA
ggagtcttagctgagggacc

SEQ ID NO: 18376 - DNA, 20 bp, Artificial Sequence
  sgRNA
tatccaggctccggtcctat

SEQ ID NO: 18377 - DNA, 20 bp, Artificial Sequence
  sgRNA
tgggcagagttctcacgccc

SEQ ID NO: 18378 - DNA, 20 bp, Artificial Sequence
  sgRNA
ggcgtggtctgcacgctggg

SEQ ID NO: 18379 - DNA, 20 bp, Artificial Sequence
  sgRNA
gccaggctgcccgtcaaccc

SEQ ID NO: 18380 - DNA, 20 bp, Artificial Sequence
  sgRNA
gttcagctaccgcaatccag

SEQ ID NO: 18381 - DNA, 20 bp, Artificial Sequence
  sgRNA
ctgtgaggatttcacaccca

SEQ ID NO: 18382 - DNA, 20 bp, Artificial Sequence
  sgRNA
cggaggacgtggtcaccgag

SEQ ID NO: 18383 - DNA, 20 bp, Artificial Sequence
  sgRNA
ccttccagcctcaggtctgg

SEQ ID NO: 18384 - DNA, 20 bp, Artificial Sequence
  sgRNA
gcagaggtcgggacgtacca

SEQ ID NO: 18385 - DNA, 20 bp, Artificial Sequence
  sgRNA
cggtctcgcgtcagccgcgg

SEQ ID NO: 18386 - DNA, 20 bp, Artificial Sequence
  sgRNA
cgcctatcccaggccgttcc

SEQ ID NO: 18387 - DNA, 20 bp, Artificial Sequence
  sgRNA
cggcctcgaggaggagttgc

SEQ ID NO: 18388 - DNA, 20 bp, Artificial Sequence
  sgRNA
attgtctgggattaaggtca

SEQ ID NO: 18389 - DNA, 20 bp, Artificial Sequence
  sgRNA
aatctcagagaggtttcgcc

SEQ ID NO: 18390 - DNA, 20 bp, Artificial Sequence
  sgRNA
tgcctaatactatccttccc

SEQ ID NO: 18391 - DNA, 20 bp, Artificial Sequence
  sgRNA
gttagtttctgaaatcttgc

SEQ ID NO: 18392 - DNA, 20 bp, Artificial Sequence
  sgRNA
ctaggtcggtggaatcgcaa

SEQ ID NO: 18393 - DNA, 20 bp, Artificial Sequence
  sgRNA
tctataaatactccgtgcag

SEQ ID NO: 18394 - DNA, 20 bp, Artificial Sequence
  sgRNA
ggtcagggattcggtgcttc

SEQ ID NO: 18395 - DNA, 20 bp, Artificial Sequence
  sgRNA
tccgaagtcctgctggtcgc

SEQ ID NO: 18396 - DNA, 20 bp, Artificial Sequence
  sgRNA
ggccctggcgatatagatgc

SEQ ID NO: 18397 - DNA, 20 bp, Artificial Sequence
  sgRNA
gtgccaggtcctggttctcc

SEQ ID NO: 18398 - DNA, 20 bp, Artificial Sequence
  sgRNA
atcccaagagctaggagccg

SEQ ID NO: 18399 - DNA, 20 bp, Artificial Sequence
  sgRNA
gggcctctgtgacttagtgc

SEQ ID NO: 18400 - DNA, 20 bp, Artificial Sequence
  sgRNA
gcccacgggatccaggtcgg

SEQ ID NO: 18401 - DNA, 20 bp, Artificial Sequence
  sgRNA
ggtcagtgggcgctcagctc

SEQ ID NO: 18402 - DNA, 20 bp, Artificial Sequence
  sgRNA
agtggctagcaactccctcc

SEQ ID NO: 18403 - DNA, 20 bp, Artificial Sequence
  sgRNA
aaacactcccacttcctgaa

SEQ ID NO: 18404 - DNA, 20 bp, Artificial Sequence
  sgRNA
aatgaggttctgggcagcca

SEQ ID NO: 18405 - DNA, 20 bp, Artificial Sequence
  sgRNA
atgaggtcctgtctcaagga

SEQ ID NO: 18406 - DNA, 20 bp, Artificial Sequence
  sgRNA
atgcctgtgcttgtggaggc

SEQ ID NO: 18407 - DNA, 20 bp, Artificial Sequence
  sgRNA
aaactagtgtagaaggcact

SEQ ID NO: 18408 - DNA, 20 bp, Artificial Sequence
  sgRNA
cctgaggcaatctgaccagc

SEQ ID NO: 18409 - DNA, 20 bp, Artificial Sequence
  sgRNA
ctgtgtgccggccgccaccg

SEQ ID NO: 18410 - DNA, 20 bp, Artificial Sequence
  sgRNA
gcaagcccagctttgagagc

SEQ ID NO: 18411 - DNA, 20 bp, Artificial Sequence
  sgRNA
acgtcaggcggcgtcacgcg

SEQ ID NO: 18412 - DNA, 20 bp, Artificial Sequence
  sgRNA
gcagcggcacctgtacttgc

SEQ ID NO: 18413 - DNA, 20 bp, Artificial Sequence
  sgRNA
cttcctgtggcgaccctgcg

SEQ ID NO: 18414 - DNA, 20 bp, Artificial Sequence
  sgRNA
ccctgcactatattcccgcc

SEQ ID NO: 18415 - DNA, 20 bp, Artificial Sequence
  sgRNA
gttatccctcaatactttct

SEQ ID NO: 18416 - DNA, 20 bp, Artificial Sequence
  sgRNA
atgtccgtcagtttaccgat

SEQ ID NO: 18417 - DNA, 20 bp, Artificial Sequence
  sgRNA
gcctgcgttcgacgagagag

SEQ ID NO: 18418 - DNA, 20 bp, Artificial Sequence
  sgRNA
aaatgtccagggcagggtcg

SEQ ID NO: 18419 - DNA, 20 bp, Artificial Sequence
  sgRNA
gcctgcgggtgggagaaagg

SEQ ID NO: 18420 - DNA, 20 bp, Artificial Sequence
  sgRNA
gaaagaggcaccctgagtct

SEQ ID NO: 18421 - DNA, 20 bp, Artificial Sequence
  sgRNA
gctttgcttctgactttatg

SEQ ID NO: 18422 - DNA, 20 bp, Artificial Sequence
  sgRNA
cccgcggacgcaccaccgat

SEQ ID NO: 18423 - DNA, 20 bp, Artificial Sequence
  sgRNA
agctctgattggtgatcaca

SEQ ID NO: 18424 - DNA, 20 bp, Artificial Sequence
  sgRNA
ttgtagttcccagcgtgcgg

SEQ ID NO: 18425 - DNA, 20 bp, Artificial Sequence
  sgRNA
ggcggtgcagcgaggatttg

SEQ ID NO: 18426 - DNA, 20 bp, Artificial Sequence
  sgRNA
gcatttgcgttcagcctctt

SEQ ID NO: 18427 - DNA, 20 bp, Artificial Sequence
  sgRNA
gtaacagtccaaattacgtc

SEQ ID NO: 18428 - DNA, 20 bp, Artificial Sequence
  sgRNA
ggagggctggaagtcacacc

SEQ ID NO: 18429 - DNA, 20 bp, Artificial Sequence
  sgRNA
aaatgaaggctaagggaatt

SEQ ID NO: 18430 - DNA, 20 bp, Artificial Sequence
  sgRNA
ttaacagaaggtcatatgcc

SEQ ID NO: 18431 - DNA, 20 bp, Artificial Sequence
  sgRNA
gacagcagcccgcccgagca

SEQ ID NO: 18432 - DNA, 20 bp, Artificial Sequence
  sgRNA
gcttatcagtcatgcaaatg

SEQ ID NO: 18433 - DNA, 20 bp, Artificial Sequence
  sgRNA
gcatgagggcgagtgtgcga

SEQ ID NO: 18434 - DNA, 20 bp, Artificial Sequence
  sgRNA
actcatctgatcgtgatgcg

SEQ ID NO: 18435 - DNA, 20 bp, Artificial Sequence
  sgRNA
cgatgggctggcaaccgagg

SEQ ID NO: 18436 - DNA, 20 bp, Artificial Sequence
  sgRNA
tcataattaggtgactgaca

SEQ ID NO: 18437 - DNA, 20 bp, Artificial Sequence
  sgRNA
ggccagttgcccaccaccgg

SEQ ID NO: 18438 - DNA, 20 bp, Artificial Sequence
  sgRNA
ggatataactgagtcacagg

SEQ ID NO: 18439 - DNA, 20 bp, Artificial Sequence
  sgRNA
cctttctctctggcgcgaga

SEQ ID NO: 18440 - DNA, 20 bp, Artificial Sequence
  sgRNA
cctgggctcgacgctggact

SEQ ID NO: 18441 - DNA, 20 bp, Artificial Sequence
  sgRNA
tgtcacattacggcttctgc

SEQ ID NO: 18442 - DNA, 20 bp, Artificial Sequence
  sgRNA
ggccgtttccggcccatctt

SEQ ID NO: 18443 - DNA, 20 bp, Artificial Sequence
  sgRNA
cctgtgccttcggacgcgtc

SEQ ID NO: 18444 - DNA, 20 bp, Artificial Sequence
  sgRNA
cagagacattcgtgactttc

SEQ ID NO: 18445 - DNA, 20 bp, Artificial Sequence
  sgRNA
cattgggtccttcggcaccc

SEQ ID NO: 18446 - DNA, 20 bp, Artificial Sequence
  sgRNA
agagagctgtcctgactaaa

SEQ ID NO: 18447 - DNA, 20 bp, Artificial Sequence
  sgRNA
ggacaccacccacatgggcc

SEQ ID NO: 18448 - DNA, 20 bp, Artificial Sequence
  sgRNA
aagttcggccgggtgagagc

SEQ ID NO: 18449 - DNA, 20 bp, Artificial Sequence
  sgRNA
cacgaaggccgatggataaa

SEQ ID NO: 18450 - DNA, 20 bp, Artificial Sequence
  sgRNA
gcaaatccagtagtggatcg

SEQ ID NO: 18451 - DNA, 20 bp, Artificial Sequence
  sgRNA
cttgagagcacgcagtcacg

SEQ ID NO: 18452 - DNA, 20 bp, Artificial Sequence
  sgRNA
gagaccacagccatgtcacg

SEQ ID NO: 18453 - DNA, 20 bp, Artificial Sequence
  sgRNA
caccacggaccggtgctccg

SEQ ID NO: 18454 - DNA, 20 bp, Artificial Sequence
  sgRNA
gcaggaagctcttgcagata

SEQ ID NO: 18455 - DNA, 20 bp, Artificial Sequence
  sgRNA
cagcctccagcagattcgct

SEQ ID NO: 18456 - DNA, 20 bp, Artificial Sequence
  sgRNA
gcaggacagctgatggtttc

SEQ ID NO: 18457 - DNA, 20 bp, Artificial Sequence
  sgRNA
gaatgacccaggttaacttt

SEQ ID NO: 18458 - DNA, 20 bp, Artificial Sequence
  sgRNA
gtctgctttatatccaaggt

SEQ ID NO: 18459 - DNA, 20 bp, Artificial Sequence
  sgRNA
ggcacgagaccataggtgat

SEQ ID NO: 18460 - DNA, 20 bp, Artificial Sequence
  sgRNA
tctgggaagcagtgtagtag

SEQ ID NO: 18461 - DNA, 20 bp, Artificial Sequence
  sgRNA
ccctagttcccagtgctttc

SEQ ID NO: 18462 - DNA, 20 bp, Artificial Sequence
  sgRNA
tatgaagtgctcttcagaca

SEQ ID NO: 18463 - DNA, 20 bp, Artificial Sequence
  sgRNA
gccttggactcctggatacg

SEQ ID NO: 18464 - DNA, 20 bp, Artificial Sequence
  sgRNA
ggttaacatacactctaatg

SEQ ID NO: 18465 - DNA, 20 bp, Artificial Sequence
  sgRNA
ttcttaaccatgttctcaca

SEQ ID NO: 18466 - DNA, 20 bp, Artificial Sequence
  sgRNA
ggcggaggcgcacgggatcg

SEQ ID NO: 18467 - DNA, 20 bp, Artificial Sequence
  sgRNA
ctgcggacgccgctgaacag

SEQ ID NO: 18468 - DNA, 20 bp, Artificial Sequence
  sgRNA
gagcgctcctgggcgtgtgt

SEQ ID NO: 18469 - DNA, 20 bp, Artificial Sequence
  sgRNA
gtggaaacgcttaaatgaag

SEQ ID NO: 18470 - DNA, 20 bp, Artificial Sequence
  sgRNA
acgacaggcgtcggtcgctt

SEQ ID NO: 18471 - DNA, 20 bp, Artificial Sequence
  sgRNA
aaacattaatgctacccggg

SEQ ID NO: 18472 - DNA, 20 bp, Artificial Sequence
  sgRNA
acactatcccagagtctccc

SEQ ID NO: 18473 - DNA, 20 bp, Artificial Sequence
  sgRNA
gtccctgacacttcctttcc

SEQ ID NO: 18474 - DNA, 20 bp, Artificial Sequence
  sgRNA
tgtgtgctccaacagtgagt

SEQ ID NO: 18475 - DNA, 20 bp, Artificial Sequence
  sgRNA
cgagcgccagcggtgatccc

SEQ ID NO: 18476 - DNA, 20 bp, Artificial Sequence
  sgRNA
tgccttggctagcagtcgcc

SEQ ID NO: 18477 - DNA, 20 bp, Artificial Sequence
  sgRNA
gctggagcgcacggcgacac

SEQ ID NO: 18478 - DNA, 20 bp, Artificial Sequence
  sgRNA
cccggagactcatccgcttc

SEQ ID NO: 18479 - DNA, 20 bp, Artificial Sequence
  sgRNA
gcattgaacactggtcaggg

SEQ ID NO: 18480 - DNA, 20 bp, Artificial Sequence
  sgRNA
gctgtgcgaggtgtgtcagg

SEQ ID NO: 18481 - DNA, 20 bp, Artificial Sequence
  sgRNA
caggatggatcgcgcggcag

SEQ ID NO: 18482 - DNA, 20 bp, Artificial Sequence
  sgRNA
ggctacccaagttacttgct

SEQ ID NO: 18483 - DNA, 20 bp, Artificial Sequence
  sgRNA
gctcagtggcccggtccggc

SEQ ID NO: 18484 - DNA, 20 bp, Artificial Sequence
  sgRNA
cactttaactcattgtcatc

SEQ ID NO: 18485 - DNA, 20 bp, Artificial Sequence
  sgRNA
atttctccaattgggaatga

SEQ ID NO: 18486 - DNA, 20 bp, Artificial Sequence
  sgRNA
tgacacaaggaatactcaca

SEQ ID NO: 18487 - DNA, 20 bp, Artificial Sequence
  sgRNA
tgccacagctctactgtccc

SEQ ID NO: 18488 - DNA, 20 bp, Artificial Sequence
  sgRNA
gcaacatttatgacacgatg

SEQ ID NO: 18489 - DNA, 20 bp, Artificial Sequence
  sgRNA
tgtcaggaccagtaggttga

SEQ ID NO: 18490 - DNA, 20 bp, Artificial Sequence
  sgRNA
aaaggaaactcacacatagc

SEQ ID NO: 18491 - DNA, 20 bp, Artificial Sequence
  sgRNA
cgtggtccgctaaatgggcg

SEQ ID NO: 18492 - DNA, 20 bp, Artificial Sequence
  sgRNA
tgcattcagagagaaggctg

SEQ ID NO: 18493 - DNA, 20 bp, Artificial Sequence
  sgRNA
caacatctcagcagggtgag

SEQ ID NO: 18494 - DNA, 20 bp, Artificial Sequence
  sgRNA
gcaccgctgcacctgtatcg

SEQ ID NO: 18495 - DNA, 20 bp, Artificial Sequence
  sgRNA
agattctacaggtaacttcc

SEQ ID NO: 18496 - DNA, 20 bp, Artificial Sequence
  sgRNA
tagcgttctttacggcacgg

SEQ ID NO: 18497 - DNA, 20 bp, Artificial Sequence
  sgRNA
acgtcgtgaagagtcgtggc

SEQ ID NO: 18498 - DNA, 20 bp, Artificial Sequence
  sgRNA
ggcgctgaaactgctgtctt

SEQ ID NO: 18499 - DNA, 20 bp, Artificial Sequence
  sgRNA
ccaagtttcagtggatttct

SEQ ID NO: 18500 - DNA, 20 bp, Artificial Sequence
  sgRNA
gaaccgttgggcgggacttt

SEQ ID NO: 18501 - DNA, 20 bp, Artificial Sequence
  sgRNA
tcaagcagggcagttgtgtc

SEQ ID NO: 18502 - DNA, 20 bp, Artificial Sequence
  sgRNA
ttccgagaagccactttatg

SEQ ID NO: 18503 - DNA, 20 bp, Artificial Sequence
  sgRNA
ttagcactgaactggaggga

SEQ ID NO: 18504 - DNA, 20 bp, Artificial Sequence
  sgRNA
aaggcagagaagaatgacaa

SEQ ID NO: 18505 - DNA, 20 bp, Artificial Sequence
  sgRNA
tgcctgaagtacttatatgc

SEQ ID NO: 18506 - DNA, 20 bp, Artificial Sequence
  sgRNA
ccctatgttgacctccttta

SEQ ID NO: 18507 - DNA, 20 bp, Artificial Sequence
  sgRNA
gggcttgaatcgggaccaat

SEQ ID NO: 18508 - DNA, 20 bp, Artificial Sequence
  sgRNA
gctagcatcctggcaacggg

SEQ ID NO: 18509 - DNA, 20 bp, Artificial Sequence
  sgRNA
agcgtacgagagtgtgggcg

SEQ ID NO: 18510 - DNA, 20 bp, Artificial Sequence
  sgRNA
ccgttcgcgctggcaaattc

SEQ ID NO: 18511 - DNA, 20 bp, Artificial Sequence
  sgRNA
accgctgtaacacgtgactg

SEQ ID NO: 18512 - DNA, 20 bp, Artificial Sequence
  sgRNA
ccaggaacttacgtagttcc

SEQ ID NO: 18513 - DNA, 20 bp, Artificial Sequence
  sgRNA
ggagggagagcagggaggga

SEQ ID NO: 18514 - DNA, 20 bp, Artificial Sequence
  sgRNA
gtcagggagaaaggacagca

SEQ ID NO: 18515 - DNA, 20 bp, Artificial Sequence
  sgRNA
ggcgcatgtgcgtgccgcga

SEQ ID NO: 18516 - DNA, 20 bp, Artificial Sequence
  sgRNA
gactgttccacgaagggtgc

SEQ ID NO: 18517 - DNA, 20 bp, Artificial Sequence
  sgRNA
cactgcttagacattagagg

SEQ ID NO: 18518 - DNA, 20 bp, Artificial Sequence
  sgRNA
cagcacttacacctgtctaa

SEQ ID NO: 18519 - DNA, 20 bp, Artificial Sequence
  sgRNA
gtgtcttctccattcatccc

SEQ ID NO: 18520 - DNA, 20 bp, Artificial Sequence
  sgRNA
agaatccctcgcggcagtcc

SEQ ID NO: 18521 - DNA, 20 bp, Artificial Sequence
  sgRNA
ctcttggaacctcgcaaccc

SEQ ID NO: 18522 - DNA, 20 bp, Artificial Sequence
  sgRNA
ccattcaacccaagtctgcc

SEQ ID NO: 18523 - DNA, 20 bp, Artificial Sequence
  sgRNA
gctatgttcggagtattaag

SEQ ID NO: 18524 - DNA, 20 bp, Artificial Sequence
  sgRNA
ggaatcagttacaattcctc

SEQ ID NO: 18525 - DNA, 20 bp, Artificial Sequence
  sgRNA
cgtgccgctcgcttccgtac

SEQ ID NO: 18526 - DNA, 20 bp, Artificial Sequence
  sgRNA
ttatgtccctggcagtctgg

SEQ ID NO: 18527 - DNA, 20 bp, Artificial Sequence
  sgRNA
gcaagtgtctctatagataa

SEQ ID NO: 18528 - DNA, 20 bp, Artificial Sequence
  sgRNA
ggagtctctctctggcactc

SEQ ID NO: 18529 - DNA, 20 bp, Artificial Sequence
  sgRNA
tggacagagatctggtggac

SEQ ID NO: 18530 - DNA, 20 bp, Artificial Sequence
  sgRNA
tgcacttcagagggaagtag

SEQ ID NO: 18531 - DNA, 20 bp, Artificial Sequence
  sgRNA
caaagtgagggctttaggcc

SEQ ID NO: 18532 - DNA, 20 bp, Artificial Sequence
  sgRNA
gggagatgattgagggacga

SEQ ID NO: 18533 - DNA, 20 bp, Artificial Sequence
  sgRNA
cgtcacagggcagatgatca

SEQ ID NO: 18534 - DNA, 20 bp, Artificial Sequence
  sgRNA
gctctgagctagagcaggac

SEQ ID NO: 18535 - DNA, 20 bp, Artificial Sequence
  sgRNA
ctctgccgggcacacagctc

SEQ ID NO: 18536 - DNA, 20 bp, Artificial Sequence
  sgRNA
atgggagggaatctccctaa

SEQ ID NO: 18537 - DNA, 20 bp, Artificial Sequence
  sgRNA
aagtccgttgacttcccagc

SEQ ID NO: 18538 - DNA, 20 bp, Artificial Sequence
  sgRNA
ggcacttccctgcttatcag

SEQ ID NO: 18539 - DNA, 20 bp, Artificial Sequence
  sgRNA
cagagtgtctggagcctaag

SEQ ID NO: 18540 - DNA, 20 bp, Artificial Sequence
  sgRNA
tcgagtcactcaagacttac

SEQ ID NO: 18541 - DNA, 20 bp, Artificial Sequence
  sgRNA
cgcggacctgccagtcagag

SEQ ID NO: 18542 - DNA, 20 bp, Artificial Sequence
  sgRNA
aggcactggacttgaagcta

SEQ ID NO: 18543 - DNA, 20 bp, Artificial Sequence
  sgRNA
tgaggagaggagtgtgccct

SEQ ID NO: 18544 - DNA, 20 bp, Artificial Sequence
  sgRNA
gagcgggaacattgtgtagg

SEQ ID NO: 18545 - DNA, 20 bp, Artificial Sequence
  sgRNA
gccacctcccacctagattg

SEQ ID NO: 18546 - DNA, 20 bp, Artificial Sequence
  sgRNA
gggctacaggttagggcgac

SEQ ID NO: 18547 - DNA, 20 bp, Artificial Sequence
  sgRNA
cagagtagttgtcccgggcc

SEQ ID NO: 18548 - DNA, 20 bp, Artificial Sequence
  sgRNA
ggtggtgcaacttccgtccc

SEQ ID NO: 18549 - DNA, 20 bp, Artificial Sequence
  sgRNA
tgaactcacaaagaaaggcg

SEQ ID NO: 18550 - DNA, 20 bp, Artificial Sequence
  sgRNA
tggcagtttgagtctgtacc

SEQ ID NO: 18551 - DNA, 20 bp, Artificial Sequence
  sgRNA
ccatcctgtctatcttgatt

SEQ ID NO: 18552 - DNA, 20 bp, Artificial Sequence
  sgRNA
cccgcgctgacttacctcag

SEQ ID NO: 18553 - DNA, 20 bp, Artificial Sequence
  sgRNA
gtttccggaagccgggtggc

SEQ ID NO: 18554 - DNA, 20 bp, Artificial Sequence
  sgRNA
ggcgggacttcaaacgttcc

SEQ ID NO: 18555 - DNA, 20 bp, Artificial Sequence
  sgRNA
actgcaaactgacgccgacg

SEQ ID NO: 18556 - DNA, 20 bp, Artificial Sequence
  sgRNA
cggaacttaatagacaccaa

SEQ ID NO: 18557 - DNA, 20 bp, Artificial Sequence
  sgRNA
gacagtgagaagcgcaaacc

SEQ ID NO: 18558 - DNA, 20 bp, Artificial Sequence
  sgRNA
ggagacgcgatcgtgagaag

SEQ ID NO: 18559 - DNA, 20 bp, Artificial Sequence
  sgRNA
aatggaacaccttcctaaca

SEQ ID NO: 18560 - DNA, 20 bp, Artificial Sequence
  sgRNA
gagtgctgtcactcaagccc

SEQ ID NO: 18561 - DNA, 20 bp, Artificial Sequence
  sgRNA
aggagcgaacaccgccaggg

SEQ ID NO: 18562 - DNA, 20 bp, Artificial Sequence
  sgRNA
gccattgagcctgcgttcta

SEQ ID NO: 18563 - DNA, 20 bp, Artificial Sequence
  sgRNA
atttctaagcaacaggtctc

SEQ ID NO: 18564 - DNA, 20 bp, Artificial Sequence
  sgRNA
aatagtcgccttctggctcc

SEQ ID NO: 18565 - DNA, 20 bp, Artificial Sequence
  sgRNA
ggccttagggaagtcgaata

SEQ ID NO: 18566 - DNA, 20 bp, Artificial Sequence
  sgRNA
ccaataaggtacaatcactg

SEQ ID NO: 18567 - DNA, 20 bp, Artificial Sequence
  sgRNA
ccagtaccacggaaagagca

SEQ ID NO: 18568 - DNA, 20 bp, Artificial Sequence
  sgRNA
ctacaggattgggtaagatg

SEQ ID NO: 18569 - DNA, 20 bp, Artificial Sequence
  sgRNA
gggagggagagatgatgcaa

SEQ ID NO: 18570 - DNA, 20 bp, Artificial Sequence
  sgRNA
tacacacgatgggctgtgtg

SEQ ID NO: 18571 - DNA, 20 bp, Artificial Sequence
  sgRNA
cagtcttaaagcagcagcag

SEQ ID NO: 18572 - DNA, 20 bp, Artificial Sequence
  sgRNA
agtgcggcggatcacgcagt

SEQ ID NO: 18573 - DNA, 20 bp, Artificial Sequence
  sgRNA
cttatcatctgtgttgctca

SEQ ID NO: 18574 - DNA, 20 bp, Artificial Sequence
  sgRNA
agtcagcagatatcagcgcc

SEQ ID NO: 18575 - DNA, 20 bp, Artificial Sequence
  sgRNA
gggacacataggaaagatag

SEQ ID NO: 18576 - DNA, 20 bp, Artificial Sequence
  sgRNA
gggtttctggttagttgtcc

SEQ ID NO: 18577 - DNA, 20 bp, Artificial Sequence
  sgRNA
gccttactccgcccttaatg

SEQ ID NO: 18578 - DNA, 20 bp, Artificial Sequence
  sgRNA
actgaagtaggctaggtcga

SEQ ID NO: 18579 - DNA, 20 bp, Artificial Sequence
  sgRNA
ggtgcggcgtcttgggctaa

SEQ ID NO: 18580 - DNA, 20 bp, Artificial Sequence
  sgRNA
tgtcgggtggcgagccgggt

SEQ ID NO: 18581 - DNA, 20 bp, Artificial Sequence
  sgRNA
gcgggatcagctgactctgc

SEQ ID NO: 18582 - DNA, 20 bp, Artificial Sequence
  sgRNA
catcgcttcgcttccgacct

SEQ ID NO: 18583 - DNA, 20 bp, Artificial Sequence
  sgRNA
ctgtaacctcaattcgaccc

SEQ ID NO: 18584 - DNA, 20 bp, Artificial Sequence
  sgRNA
aacggcggcaacgggtggcg

SEQ ID NO: 18585 - DNA, 20 bp, Artificial Sequence
  sgRNA
caccttgtgcttcctggcag

SEQ ID NO: 18586 - DNA, 20 bp, Artificial Sequence
  sgRNA
atcaatctgcttagtctcca

SEQ ID NO: 18587 - DNA, 20 bp, Artificial Sequence
  sgRNA
tcctaggcaccctaggcacg

SEQ ID NO: 18588 - DNA, 20 bp, Artificial Sequence
  sgRNA
ctaagagagcctgccctttc

SEQ ID NO: 18589 - DNA, 20 bp, Artificial Sequence
  sgRNA
tcagtttgcaaagtccagaa

SEQ ID NO: 18590 - DNA, 20 bp, Artificial Sequence
  sgRNA
aaacaaccaacaacagagat

SEQ ID NO: 18591 - DNA, 20 bp, Artificial Sequence
  sgRNA
ccattcttcccaggctaagg

SEQ ID NO: 18592 - DNA, 20 bp, Artificial Sequence
  sgRNA
gtgatggaagggagcactcc

SEQ ID NO: 18593 - DNA, 20 bp, Artificial Sequence
  sgRNA
tcctctgcatcagtttggag

SEQ ID NO: 18594 - DNA, 20 bp, Artificial Sequence
  sgRNA
ctgtagtgcataaatgtaat

SEQ ID NO: 18595 - DNA, 20 bp, Artificial Sequence
  sgRNA
acgattcccatggtcaaata

SEQ ID NO: 18596 - DNA, 20 bp, Artificial Sequence
  sgRNA
catcccagctgcctgagccc

SEQ ID NO: 18597 - DNA, 20 bp, Artificial Sequence
  sgRNA
ccaggagtcccggcccagag

SEQ ID NO: 18598 - DNA, 20 bp, Artificial Sequence
  sgRNA
tagctcccgctgtccagcag

SEQ ID NO: 18599 - DNA, 20 bp, Artificial Sequence
  sgRNA
gtctccaaagatattaaatg

SEQ ID NO: 18600 - DNA, 20 bp, Artificial Sequence
  sgRNA
ctgagtttgttctcactcaa

SEQ ID NO: 18601 - DNA, 20 bp, Artificial Sequence
  sgRNA
agagagcataatgttgatag

SEQ ID NO: 18602 - DNA, 20 bp, Artificial Sequence
  sgRNA
gctttatataaaggagctgc

SEQ ID NO: 18603 - DNA, 20 bp, Artificial Sequence
  sgRNA
cctgttcttacacctcacgc

SEQ ID NO: 18604 - DNA, 20 bp, Artificial Sequence
  sgRNA
gttggctggaagcctgctga

SEQ ID NO: 18605 - DNA, 20 bp, Artificial Sequence
  sgRNA
gaaactctgaaatgtctcaa

SEQ ID NO: 18606 - DNA, 20 bp, Artificial Sequence
  sgRNA
aaatgagctaagactgggtc

SEQ ID NO: 18607 - DNA, 20 bp, Artificial Sequence
  sgRNA
aaacttctgcctccaatgca

SEQ ID NO: 18608 - DNA, 20 bp, Artificial Sequence
  sgRNA
gcgcaccgcagccgggcata

SEQ ID NO: 18609 - DNA, 20 bp, Artificial Sequence
  sgRNA
gctcgcctggagataggaac

SEQ ID NO: 18610 - DNA, 20 bp, Artificial Sequence
  sgRNA
gggaggatgcagccacaagg

SEQ ID NO: 18611 - DNA, 20 bp, Artificial Sequence
  sgRNA
cccaccggccagcggttgga

SEQ ID NO: 18612 - DNA, 20 bp, Artificial Sequence
  sgRNA
cctcaggagccgggagccgt

SEQ ID NO: 18613 - DNA, 20 bp, Artificial Sequence
  sgRNA
gctgagcctgcgcgagcacc

SEQ ID NO: 18614 - DNA, 20 bp, Artificial Sequence
  sgRNA
gagagagagagagagaaagt

SEQ ID NO: 18615 - DNA, 20 bp, Artificial Sequence
  sgRNA
cttatggtactttgaacaaa

SEQ ID NO: 18616 - DNA, 20 bp, Artificial Sequence
  sgRNA
tgatgtccgttcttagtctg

SEQ ID NO: 18617 - DNA, 20 bp, Artificial Sequence
  sgRNA
atcattaagtctagttcagt

SEQ ID NO: 18618 - DNA, 20 bp, Artificial Sequence
  sgRNA
cgtgcccagaattcgagagg

SEQ ID NO: 18619 - DNA, 20 bp, Artificial Sequence
  sgRNA
taggaagcgcggagtcgcct

SEQ ID NO: 18620 - DNA, 20 bp, Artificial Sequence
  sgRNA
agaagcttctgaagtgggtg

SEQ ID NO: 18621 - DNA, 20 bp, Artificial Sequence
  sgRNA
aacatctgaactcctcagag

SEQ ID NO: 18622 - DNA, 20 bp, Artificial Sequence
  sgRNA
tgcttggctgctcctgtttg

SEQ ID NO: 18623 - DNA, 20 bp, Artificial Sequence
  sgRNA
atcaagaactgtttagtcgc

SEQ ID NO: 18624 - DNA, 20 bp, Artificial Sequence
  sgRNA
gcacggaaatatcgcgagag

SEQ ID NO: 18625 - DNA, 20 bp, Artificial Sequence
  sgRNA
gggttgtgacgtcatcaaag

SEQ ID NO: 18626 - DNA, 20 bp, Artificial Sequence
  sgRNA
caccaggactcctaggtcta

SEQ ID NO: 18627 - DNA, 20 bp, Artificial Sequence
  sgRNA
acaaggaggctgacccagct

SEQ ID NO: 18628 - DNA, 20 bp, Artificial Sequence
  sgRNA
aaactcaaattcctgcactc

SEQ ID NO: 18629 - DNA, 20 bp, Artificial Sequence
  sgRNA
tctcggtcctttaagccgtc

SEQ ID NO: 18630 - DNA, 20 bp, Artificial Sequence
  sgRNA
cgaaccctcaaataattgtg

SEQ ID NO: 18631 - DNA, 20 bp, Artificial Sequence
  sgRNA
gggtctttataaagatgccg

SEQ ID NO: 18632 - DNA, 20 bp, Artificial Sequence
  sgRNA
catttcacagggaggtgccc

SEQ ID NO: 18633 - DNA, 20 bp, Artificial Sequence
  sgRNA
attgcccactcagggttcca

SEQ ID NO: 18634 - DNA, 20 bp, Artificial Sequence
  sgRNA
ctatgctctaaagttgactc

SEQ ID NO: 18635 - DNA, 20 bp, Artificial Sequence
  sgRNA
cagggctcctcgcgaaagtg

SEQ ID NO: 18636 - DNA, 20 bp, Artificial Sequence
  sgRNA
ctcttgggcagccgctagga

SEQ ID NO: 18637 - DNA, 20 bp, Artificial Sequence
  sgRNA
aggaggaggcgccctgtatc

SEQ ID NO: 18638 - DNA, 20 bp, Artificial Sequence
  sgRNA
atgagtggatgtgtactctg

SEQ ID NO: 18639 - DNA, 20 bp, Artificial Sequence
  sgRNA
tatgatggctgaggtgggtg

SEQ ID NO: 18640 - DNA, 20 bp, Artificial Sequence
  sgRNA
tctgcctctaagtcaattgg

SEQ ID NO: 18641 - DNA, 20 bp, Artificial Sequence
  sgRNA
tctctccctagagatgcgag

SEQ ID NO: 18642 - DNA, 20 bp, Artificial Sequence
  sgRNA
tgcattgtgggaacgcggcg

SEQ ID NO: 18643 - DNA, 20 bp, Artificial Sequence
  sgRNA
gcaagcgcacctcgcggcgg

SEQ ID NO: 18644 - DNA, 20 bp, Artificial Sequence
  sgRNA
gctagcggtagcggttgccc

SEQ ID NO: 18645 - DNA, 20 bp, Artificial Sequence
  sgRNA
cttccggtactcaccacgta

SEQ ID NO: 18646 - DNA, 20 bp, Artificial Sequence
  sgRNA
ccgtacaggcgtgtggcgtg

SEQ ID NO: 18647 - DNA, 20 bp, Artificial Sequence
  sgRNA
ggaagtgggtacatctcaag

SEQ ID NO: 18648 - DNA, 20 bp, Artificial Sequence
  sgRNA
aaaggtcacttgagagctca

SEQ ID NO: 18649 - DNA, 20 bp, Artificial Sequence
  sgRNA
tagcccagcctgaccctgct

SEQ ID NO: 18650 - DNA, 20 bp, Artificial Sequence
  sgRNA
ggagggagcggaagccgagc

SEQ ID NO: 18651 - DNA, 20 bp, Artificial Sequence
  sgRNA
ggagggcgcggcttggcggg

SEQ ID NO: 18652 - DNA, 20 bp, Artificial Sequence
  sgRNA
tgccaagtctctgtactgac

SEQ ID NO: 18653 - DNA, 20 bp, Artificial Sequence
  sgRNA
gaggtgagaggcgggataaa

SEQ ID NO: 18654 - DNA, 20 bp, Artificial Sequence
  sgRNA
cctcgagaccaccgaggatg

SEQ ID NO: 18655 - DNA, 20 bp, Artificial Sequence
  sgRNA
ctattgtccctccttgaatc

SEQ ID NO: 18656 - DNA, 20 bp, Artificial Sequence
  sgRNA
gttggtgtgcaagtttcttt

SEQ ID NO: 18657 - DNA, 20 bp, Artificial Sequence
  sgRNA
cttatgacaggcgcgccatt

SEQ ID NO: 18658 - DNA, 20 bp, Artificial Sequence
  sgRNA
cccacgcctttgcgtacatc

SEQ ID NO: 18659 - DNA, 20 bp, Artificial Sequence
  sgRNA
ccgcgaccggctcaatttaa

SEQ ID NO: 18660 - DNA, 20 bp, Artificial Sequence
  sgRNA
atggctatacaccaacgagg

SEQ ID NO: 18661 - DNA, 20 bp, Artificial Sequence
  sgRNA
agatttcccttcccacgtgc

SEQ ID NO: 18662 - DNA, 20 bp, Artificial Sequence
  sgRNA
gctcctgagaccacctgcag

SEQ ID NO: 18663 - DNA, 20 bp, Artificial Sequence
  sgRNA
accttccaccactgtatgag

SEQ ID NO: 18664 - DNA, 20 bp, Artificial Sequence
  sgRNA
cgttcttcctgaccaatgaa

SEQ ID NO: 18665 - DNA, 20 bp, Artificial Sequence
  sgRNA
gagcgagatgctctccgcgg

SEQ ID NO: 18666 - DNA, 20 bp, Artificial Sequence
  sgRNA
ccacgtggccaccctagcgc

SEQ ID NO: 18667 - DNA, 20 bp, Artificial Sequence
  sgRNA
gcgcaagaggatgcgcacgg

SEQ ID NO: 18668 - DNA, 20 bp, Artificial Sequence
  sgRNA
tcgaggacgccaggtcacgt

SEQ ID NO: 18669 - DNA, 20 bp, Artificial Sequence
  sgRNA
ttgctgaacctcctcctctt

SEQ ID NO: 18670 - DNA, 20 bp, Artificial Sequence
  sgRNA
tgtcatccgaagcctccagg

SEQ ID NO: 18671 - DNA, 20 bp, Artificial Sequence
  sgRNA
cggcgcgcgacatcgccacc

SEQ ID NO: 18672 - DNA, 20 bp, Artificial Sequence
  sgRNA
cctagagccttccgctcgag

SEQ ID NO: 18673 - DNA, 20 bp, Artificial Sequence
  sgRNA
gatagggaagcgcaggcgct

SEQ ID NO: 18674 - DNA, 20 bp, Artificial Sequence
  sgRNA
cccaaagactccgccttccc

SEQ ID NO: 18675 - DNA, 20 bp, Artificial Sequence
  sgRNA
cctgaggcccggaggcgccc

SEQ ID NO: 18676 - DNA, 20 bp, Artificial Sequence
  sgRNA
ccatcttcgcagggccgcgg

SEQ ID NO: 18677 - DNA, 20 bp, Artificial Sequence
  sgRNA
ggtccagcctagtttagcca

SEQ ID NO: 18678 - DNA, 20 bp, Artificial Sequence
  sgRNA
gatcttggcgattcttgacc

SEQ ID NO: 18679 - DNA, 20 bp, Artificial Sequence
  sgRNA
ggagttctggtcccgcgcgc

SEQ ID NO: 18680 - DNA, 20 bp, Artificial Sequence
  sgRNA
tttccaccaatgggtaccat

SEQ ID NO: 18681 - DNA, 20 bp, Artificial Sequence
  sgRNA
tgcattccaacatgagtctt

SEQ ID NO: 18682 - DNA, 20 bp, Artificial Sequence
  sgRNA
cattggtggaaaggttatgg

SEQ ID NO: 18683 - DNA, 20 bp, Artificial Sequence
  sgRNA
caaccaggccgctaggcgcc

SEQ ID NO: 18684 - DNA, 20 bp, Artificial Sequence
  sgRNA
gcagagataaggtaacttta

SEQ ID NO: 18685 - DNA, 20 bp, Artificial Sequence
  sgRNA
gagtggagggaggtggataa

SEQ ID NO: 18686 - DNA, 20 bp, Artificial Sequence
  sgRNA
cgtacttgcatatatacatc

SEQ ID NO: 18687 - DNA, 20 bp, Artificial Sequence
  sgRNA
aggctagtatttatactgtg

SEQ ID NO: 18688 - DNA, 20 bp, Artificial Sequence
  sgRNA
aaagtgaactggcaagcagc

SEQ ID NO: 18689 - DNA, 20 bp, Artificial Sequence
  sgRNA
ggagtcatgtgataccaaga

SEQ ID NO: 18690 - DNA, 20 bp, Artificial Sequence
  sgRNA
ttatgacaatgggtagttaa

SEQ ID NO: 18691 - DNA, 20 bp, Artificial Sequence
  sgRNA
gggtcacgcgacgctgatgc

SEQ ID NO: 18692 - DNA, 20 bp, Artificial Sequence
  sgRNA
tggacttggatcaaagtctg

SEQ ID NO: 18693 - DNA, 20 bp, Artificial Sequence
  sgRNA
ggaggcatgacattgccaat

SEQ ID NO: 18694 - DNA, 20 bp, Artificial Sequence
  sgRNA
tctagttcgtgggctaggaa

SEQ ID NO: 18695 - DNA, 20 bp, Artificial Sequence
  sgRNA
gagccgtaagagattgcact

SEQ ID NO: 18696 - DNA, 20 bp, Artificial Sequence
  sgRNA
acacttggctctgtgaccaa

SEQ ID NO: 18697 - DNA, 20 bp, Artificial Sequence
  sgRNA
caggctgaggtaccctgctc

SEQ ID NO: 18698 - DNA, 20 bp, Artificial Sequence
  sgRNA
aacatcatcgggatctaatc

SEQ ID NO: 18699 - DNA, 20 bp, Artificial Sequence
  sgRNA
gtggagaaattctggagttg

SEQ ID NO: 18700 - DNA, 20 bp, Artificial Sequence
  sgRNA
tttaaatcgagttcctgaga

SEQ ID NO: 18701 - DNA, 20 bp, Artificial Sequence
  sgRNA
ggtgaggcccaggtgcggac

SEQ ID NO: 18702 - DNA, 20 bp, Artificial Sequence
  sgRNA
tgccaggaggatattcaaac

SEQ ID NO: 18703 - DNA, 20 bp, Artificial Sequence
  sgRNA
ctcaggagctgttactctag

SEQ ID NO: 18704 - DNA, 20 bp, Artificial Sequence
  sgRNA
tctacctgtcagaacaatgg

SEQ ID NO: 18705 - DNA, 20 bp, Artificial Sequence
  sgRNA
agaattacttgcatgctcag

SEQ ID NO: 18706 - DNA, 20 bp, Artificial Sequence
  sgRNA
gggcccagtgcacacgcagc

SEQ ID NO: 18707 - DNA, 20 bp, Artificial Sequence
  sgRNA
agagtcttgctctgcagaca

SEQ ID NO: 18708 - DNA, 20 bp, Artificial Sequence
  sgRNA
tgctcggctgtcctgcacag

SEQ ID NO: 18709 - DNA, 20 bp, Artificial Sequence
  sgRNA
aggctaagggacagtggaag

SEQ ID NO: 18710 - DNA, 20 bp, Artificial Sequence
  sgRNA
cgcagtgtggtgagcagccc

SEQ ID NO: 18711 - DNA, 20 bp, Artificial Sequence
  sgRNA
cgcagatgcctgccctttag

SEQ ID NO: 18712 - DNA, 20 bp, Artificial Sequence
  sgRNA
gcgtttcctgattcgtcggg

SEQ ID NO: 18713 - DNA, 20 bp, Artificial Sequence
  sgRNA
cccagggcgccacctgccgg

SEQ ID NO: 18714 - DNA, 20 bp, Artificial Sequence
  sgRNA
agggtggagtttgtatccgt

SEQ ID NO: 18715 - DNA, 20 bp, Artificial Sequence
  sgRNA
tagcgccactccactggcgg

SEQ ID NO: 18716 - DNA, 20 bp, Artificial Sequence
  sgRNA
taatcgcggcagtcatcttc

SEQ ID NO: 18717 - DNA, 20 bp, Artificial Sequence
  sgRNA
ccatttgaacttctctccaa

SEQ ID NO: 18718 - DNA, 20 bp, Artificial Sequence
  sgRNA
tagagggcgtggccgtggtc

SEQ ID NO: 18719 - DNA, 20 bp, Artificial Sequence
  sgRNA
ctgcagccggaagcgagtcc

SEQ ID NO: 18720 - DNA, 20 bp, Artificial Sequence
  sgRNA
gaggaggagcctagaatgcc

SEQ ID NO: 18721 - DNA, 20 bp, Artificial Sequence
  sgRNA
gactccttcagagttgagaa

SEQ ID NO: 18722 - DNA, 20 bp, Artificial Sequence
  sgRNA
aagactggcggagataatct

SEQ ID NO: 18723 - DNA, 20 bp, Artificial Sequence
  sgRNA
acaagttattctaactagga

SEQ ID NO: 18724 - DNA, 20 bp, Artificial Sequence
  sgRNA
aggaaacaggagaaatttca

SEQ ID NO: 18725 - DNA, 20 bp, Artificial Sequence
  sgRNA
aagagtgggaaccgtggagc

SEQ ID NO: 18726 - DNA, 20 bp, Artificial Sequence
  sgRNA
gccagggcggaccagagaac

SEQ ID NO: 18727 - DNA, 20 bp, Artificial Sequence
  sgRNA
acagccattgtgtcacgtag

SEQ ID NO: 18728 - DNA, 20 bp, Artificial Sequence
  sgRNA
gtccggcctcaacgcaggag

SEQ ID NO: 18729 - DNA, 20 bp, Artificial Sequence
  sgRNA
ccgctacctctcattggtta

SEQ ID NO: 18730 - DNA, 20 bp, Artificial Sequence
  sgRNA
cacccacttcaagcggcccg

SEQ ID NO: 18731 - DNA, 20 bp, Artificial Sequence
  sgRNA
taccgtaaatctcctaaccc

SEQ ID NO: 18732 - DNA, 20 bp, Artificial Sequence
  sgRNA
agaaactgcctgtagaagtc

SEQ ID NO: 18733 - DNA, 20 bp, Artificial Sequence
  sgRNA
tactgacttccttagaaaca

SEQ ID NO: 18734 - DNA, 20 bp, Artificial Sequence
  sgRNA
tcagttccgcagcttaagga

SEQ ID NO: 18735 - DNA, 20 bp, Artificial Sequence
  sgRNA
agtcgggcgtggctcgaaag

SEQ ID NO: 18736 - DNA, 20 bp, Artificial Sequence
  sgRNA
aacgggaagtgtgcgctgat

SEQ ID NO: 18737 - DNA, 20 bp, Artificial Sequence
  sgRNA
tcccagcacttgggaggcag

SEQ ID NO: 18738 - DNA, 20 bp, Artificial Sequence
  sgRNA
tggaagtctctgtgtagatc

SEQ ID NO: 18739 - DNA, 20 bp, Artificial Sequence
  sgRNA
ctggtgggtctctacatttg

SEQ ID NO: 18740 - DNA, 20 bp, Artificial Sequence
  sgRNA
cccagccagtcctccgctcc

SEQ ID NO: 18741 - DNA, 20 bp, Artificial Sequence
  sgRNA
gggaaggaggaggaagaagg

SEQ ID NO: 18742 - DNA, 20 bp, Artificial Sequence
  sgRNA
cagggaagccggaacctcgc

SEQ ID NO: 18743 - DNA, 20 bp, Artificial Sequence
  sgRNA
acgcaggcgcaggagcatag

SEQ ID NO: 18744 - DNA, 20 bp, Artificial Sequence
  sgRNA
tacggtactttcctcagaca

SEQ ID NO: 18745 - DNA, 20 bp, Artificial Sequence
  sgRNA
ggcttatagtgcagcgtctc

SEQ ID NO: 18746 - DNA, 20 bp, Artificial Sequence
  sgRNA
cctccgagaaggtgcgccgg

SEQ ID NO: 18747 - DNA, 20 bp, Artificial Sequence
  sgRNA
caggtccaatggtgacttaa

SEQ ID NO: 18748 - DNA, 20 bp, Artificial Sequence
  sgRNA
cttggtggcttaggcatcgg

SEQ ID NO: 18749 - DNA, 20 bp, Artificial Sequence
  sgRNA
aatgggagcggcggccaggc

SEQ ID NO: 18750 - DNA, 20 bp, Artificial Sequence
  sgRNA
agggcgcgtgcgcactgcag

SEQ ID NO: 18751 - DNA, 20 bp, Artificial Sequence
  sgRNA
gagcagctccgcggcgcgag

SEQ ID NO: 18752 - DNA, 20 bp, Artificial Sequence
  sgRNA
agaggcttacaatagagctc

SEQ ID NO: 18753 - DNA, 20 bp, Artificial Sequence
  sgRNA
agaagtttcagggctgggct

SEQ ID NO: 18754 - DNA, 20 bp, Artificial Sequence
  sgRNA
ggtctccggaagagcctatg

SEQ ID NO: 18755 - DNA, 20 bp, Artificial Sequence
  sgRNA
ctggtaaggtctttatcttg

SEQ ID NO: 18756 - DNA, 20 bp, Artificial Sequence
  sgRNA
ttgcagctctgcttgtgact

SEQ ID NO: 18757 - DNA, 20 bp, Artificial Sequence
  sgRNA
atctccatagggcatattct

SEQ ID NO: 18758 - DNA, 20 bp, Artificial Sequence
  sgRNA
ccctggatgccgagagacct

SEQ ID NO: 18759 - DNA, 20 bp, Artificial Sequence
  sgRNA
ggtttatggaatgtctgggt

SEQ ID NO: 18760 - DNA, 20 bp, Artificial Sequence
  sgRNA
tcttagggatgaggatgtgg

SEQ ID NO: 18761 - DNA, 20 bp, Artificial Sequence
  sgRNA
acctcaggaaatgccgtgat

SEQ ID NO: 18762 - DNA, 20 bp, Artificial Sequence
  sgRNA
tggagttctggcagtttaat

SEQ ID NO: 18763 - DNA, 20 bp, Artificial Sequence
  sgRNA
cttaggatcatagaggattt

SEQ ID NO: 18764 - DNA, 20 bp, Artificial Sequence
  sgRNA
actgtttgcagactgcgaag

SEQ ID NO: 18765 - DNA, 20 bp, Artificial Sequence
  sgRNA
aaagggtctgccggcttccc

SEQ ID NO: 18766 - DNA, 20 bp, Artificial Sequence
  sgRNA
acagctgagaagtttgcagc

SEQ ID NO: 18767 - DNA, 20 bp, Artificial Sequence
  sgRNA
ccgatccctgtagaccatgt

SEQ ID NO: 18768 - DNA, 20 bp, Artificial Sequence
  sgRNA
cggacaggctcgctcctgat

SEQ ID NO: 18769 - DNA, 20 bp, Artificial Sequence
  sgRNA
gattgggtctttgacagcag

SEQ ID NO: 18770 - DNA, 20 bp, Artificial Sequence
  sgRNA
tccactactcaatactcatg

SEQ ID NO: 18771 - DNA, 20 bp, Artificial Sequence
  sgRNA
tccgtttagcacccataata

SEQ ID NO: 18772 - DNA, 20 bp, Artificial Sequence
  sgRNA
ttagtgaggactttgctatg

SEQ ID NO: 18773 - DNA, 20 bp, Artificial Sequence
  sgRNA
gtctttgggcctaagagaac

SEQ ID NO: 18774 - DNA, 20 bp, Artificial Sequence
  sgRNA
tgcctcctgccggttcaagc

SEQ ID NO: 18775 - DNA, 20 bp, Artificial Sequence
  sgRNA
aattagaccatggaggaaca

SEQ ID NO: 18776 - DNA, 20 bp, Artificial Sequence
  sgRNA
cattggatttagaatgactt

SEQ ID NO: 18777 - DNA, 20 bp, Artificial Sequence
  sgRNA
tatatgtactggacactatt

SEQ ID NO: 18778 - DNA, 20 bp, Artificial Sequence
  sgRNA
tagttcatgggtctgcttca

SEQ ID NO: 18779 - DNA, 20 bp, Artificial Sequence
  sgRNA
ggtgggtagaagattgacag

SEQ ID NO: 18780 - DNA, 20 bp, Artificial Sequence
  sgRNA
atggttggaagctgggttga

SEQ ID NO: 18781 - DNA, 20 bp, Artificial Sequence
  sgRNA
agaaggacagattggtggat

SEQ ID NO: 18782 - DNA, 20 bp, Artificial Sequence
  sgRNA
caaacgcctaccagagagtc

SEQ ID NO: 18783 - DNA, 20 bp, Artificial Sequence
  sgRNA
agttaccggcggcggctaga

SEQ ID NO: 18784 - DNA, 20 bp, Artificial Sequence
  sgRNA
tctgcgcgggaagtagtccg

SEQ ID NO: 18785 - DNA, 20 bp, Artificial Sequence
  sgRNA
aggcgattggctgaatgccg

SEQ ID NO: 18786 - DNA, 20 bp, Artificial Sequence
  sgRNA
cacttggagccggaagcgga

SEQ ID NO: 18787 - DNA, 20 bp, Artificial Sequence
  sgRNA
gtgcgtgcagtctctggaag

SEQ ID NO: 18788 - DNA, 20 bp, Artificial Sequence
  sgRNA
ggacctaagaggcgcggccg

SEQ ID NO: 18789 - DNA, 20 bp, Artificial Sequence
  sgRNA
gcgctctgcctgcccagtgg

SEQ ID NO: 18790 - DNA, 20 bp, Artificial Sequence
  sgRNA
gcggagcaggtggtcacggg

SEQ ID NO: 18791 - DNA, 20 bp, Artificial Sequence
  sgRNA
atctgatactgtttctttag

SEQ ID NO: 18792 - DNA, 20 bp, Artificial Sequence
  sgRNA
cgcgagagttgaggaagttg

SEQ ID NO: 18793 - DNA, 20 bp, Artificial Sequence
  sgRNA
gccttctattggcccagtga

SEQ ID NO: 18794 - DNA, 20 bp, Artificial Sequence
  sgRNA
aatgaacattgacgtcaatg

SEQ ID NO: 18795 - DNA, 20 bp, Artificial Sequence
  sgRNA
gacggtgaaagtccaatgat

SEQ ID NO: 18796 - DNA, 20 bp, Artificial Sequence
  sgRNA
gcgccgcctctgccttataa

SEQ ID NO: 18797 - DNA, 20 bp, Artificial Sequence
  sgRNA
tttgttctgggcagcctaga

SEQ ID NO: 18798 - DNA, 20 bp, Artificial Sequence
  sgRNA
tggattagctcaccagcact

SEQ ID NO: 18799 - DNA, 20 bp, Artificial Sequence
  sgRNA
ttctctgagtcagaagagag

SEQ ID NO: 18800 - DNA, 20 bp, Artificial Sequence
  sgRNA
gggtttgtgcgtgacagtcc

SEQ ID NO: 18801 - DNA, 20 bp, Artificial Sequence
  sgRNA
cggagccgagctgtactaag

SEQ ID NO: 18802 - DNA, 20 bp, Artificial Sequence
  sgRNA
gccaatcagtacgatgggcg

SEQ ID NO: 18803 - DNA, 20 bp, Artificial Sequence
  sgRNA
agtgtgtaagctgtgtgggt

SEQ ID NO: 18804 - DNA, 20 bp, Artificial Sequence
  sgRNA
caaaggagcagtggatctgg

SEQ ID NO: 18805 - DNA, 20 bp, Artificial Sequence
  sgRNA
gaggcctgttcctttctgaa

SEQ ID NO: 18806 - DNA, 20 bp, Artificial Sequence
  sgRNA
cgcagactgcgccgagaccc

SEQ ID NO: 18807 - DNA, 20 bp, Artificial Sequence
  sgRNA
ggcgggctgcgggtcgctcg

SEQ ID NO: 18808 - DNA, 20 bp, Artificial Sequence
  sgRNA
cgcgcctcggacaccggtac

SEQ ID NO: 18809 - DNA, 20 bp, Artificial Sequence
  sgRNA
tgctcatgtcctgacagatg

SEQ ID NO: 18810 - DNA, 20 bp, Artificial Sequence
  sgRNA
atcttgggaaccgattattc

SEQ ID NO: 18811 - DNA, 20 bp, Artificial Sequence
  sgRNA
agccgtgctttaagcttatt

SEQ ID NO: 18812 - DNA, 20 bp, Artificial Sequence
  sgRNA
tgggacctttcggaaacgcc

SEQ ID NO: 18813 - DNA, 20 bp, Artificial Sequence
  sgRNA
ttgaaggctccacatagctc

SEQ ID NO: 18814 - DNA, 20 bp, Artificial Sequence
  sgRNA
gcaacttagcccggcccatc

SEQ ID NO: 18815 - DNA, 20 bp, Artificial Sequence
  sgRNA
ccgcagctctcagacttcta

SEQ ID NO: 18816 - DNA, 20 bp, Artificial Sequence
  sgRNA
gctccgcggcaggttggccc

SEQ ID NO: 18817 - DNA, 20 bp, Artificial Sequence
  sgRNA
gggccgcgcaagtcagaggg

SEQ ID NO: 18818 - DNA, 20 bp, Artificial Sequence
  sgRNA
cgccgtgcggagtccttcct

SEQ ID NO: 18819 - DNA, 20 bp, Artificial Sequence
  sgRNA
ggaggtcctgggtaggacag

SEQ ID NO: 18820 - DNA, 20 bp, Artificial Sequence
  sgRNA
ggcctggtgcgcaggccctt

SEQ ID NO: 18821 - DNA, 20 bp, Artificial Sequence
  sgRNA
cgtcgagtcgctttgcatca

SEQ ID NO: 18822 - DNA, 20 bp, Artificial Sequence
  sgRNA
cgcctgcgcagtctcagtga

SEQ ID NO: 18823 - DNA, 20 bp, Artificial Sequence
  sgRNA
ctctgggaaccagagtcttc

SEQ ID NO: 18824 - DNA, 20 bp, Artificial Sequence
  sgRNA
ttagggctgggtgggcacgg

SEQ ID NO: 18825 - DNA, 20 bp, Artificial Sequence
  sgRNA
ggctctgcatctagtgtgct

SEQ ID NO: 18826 - DNA, 20 bp, Artificial Sequence
  sgRNA
agacttgagcacaggaaggc

SEQ ID NO: 18827 - DNA, 20 bp, Artificial Sequence
  sgRNA
tatcactcctctgcagcaga

SEQ ID NO: 18828 - DNA, 20 bp, Artificial Sequence
  sgRNA
tgagccattgttatcatccc

SEQ ID NO: 18829 - DNA, 20 bp, Artificial Sequence
  sgRNA
cactgagtggcacagccttc

SEQ ID NO: 18830 - DNA, 20 bp, Artificial Sequence
  sgRNA
gagtcctgcgggcgggcgcc

SEQ ID NO: 18831 - DNA, 20 bp, Artificial Sequence
  sgRNA
cgcaggcgatcgctacgcgg

SEQ ID NO: 18832 - DNA, 20 bp, Artificial Sequence
  sgRNA
gcatggactttgcctgttgg

SEQ ID NO: 18833 - DNA, 20 bp, Artificial Sequence
  sgRNA
tctgactctggagtgcttta

SEQ ID NO: 18834 - DNA, 20 bp, Artificial Sequence
  sgRNA
gctgggcatgttaacccaca

SEQ ID NO: 18835 - DNA, 20 bp, Artificial Sequence
  sgRNA
tcagggtaggtgaagggtgt

SEQ ID NO: 18836 - DNA, 20 bp, Artificial Sequence
  sgRNA
gaacgggctgcggctttata

SEQ ID NO: 18837 - DNA, 20 bp, Artificial Sequence
  sgRNA
cagttggcagaccagggagg

SEQ ID NO: 18838 - DNA, 20 bp, Artificial Sequence
  sgRNA
tcgacgtcgccgcccgcgat

SEQ ID NO: 18839 - DNA, 20 bp, Artificial Sequence
  sgRNA
ttcccggccacttctccaat

SEQ ID NO: 18840 - DNA, 20 bp, Artificial Sequence
  sgRNA
attggtcctccgatatcgtg

SEQ ID NO: 18841 - DNA, 20 bp, Artificial Sequence
  sgRNA
ggctaaactgctggcaggtc

SEQ ID NO: 18842 - DNA, 20 bp, Artificial Sequence
  sgRNA
gaagcattctcatagaccag

SEQ ID NO: 18843 - DNA, 20 bp, Artificial Sequence
  sgRNA
agttgctctcagcggctaca

SEQ ID NO: 18844 - DNA, 20 bp, Artificial Sequence
  sgRNA
gcagacacaccttatgagtc

SEQ ID NO: 18845 - DNA, 20 bp, Artificial Sequence
  sgRNA
aaagcttccctcactgctgg

SEQ ID NO: 18846 - DNA, 20 bp, Artificial Sequence
  sgRNA
gaaaggcccgcagtgcagca

SEQ ID NO: 18847 - DNA, 20 bp, Artificial Sequence
  sgRNA
ggaaatagggccgacaccgc

SEQ ID NO: 18848 - DNA, 20 bp, Artificial Sequence
  sgRNA
cgagaccgcgtcgccaagag

SEQ ID NO: 18849 - DNA, 20 bp, Artificial Sequence
  sgRNA
acgcatctgaaaccaccgaa

SEQ ID NO: 18850 - DNA, 20 bp, Artificial Sequence
  sgRNA
agccacgaggaggtctagtt

SEQ ID NO: 18851 - DNA, 20 bp, Artificial Sequence
  sgRNA
cttcttcccagggcgaggtg

SEQ ID NO: 18852 - DNA, 20 bp, Artificial Sequence
  sgRNA
cccgcgtgtcaccgacgcct

SEQ ID NO: 18853 - DNA, 20 bp, Artificial Sequence
  sgRNA
agcctgaagcaagtcccgcg

SEQ ID NO: 18854 - DNA, 20 bp, Artificial Sequence
  sgRNA
gcgcgtagggacgcaggagg

SEQ ID NO: 18855 - DNA, 20 bp, Artificial Sequence
  sgRNA
tccaagtgcgcatgtacaaa

SEQ ID NO: 18856 - DNA, 20 bp, Artificial Sequence
  sgRNA
ttggtccggaaaggtgggtg

SEQ ID NO: 18857 - DNA, 20 bp, Artificial Sequence
  sgRNA
tgtgttcactaagtcttccc

SEQ ID NO: 18858 - DNA, 20 bp, Artificial Sequence
  sgRNA
aacgtaatttcccttcccag

SEQ ID NO: 18859 - DNA, 20 bp, Artificial Sequence
  sgRNA
gatggctgcacacagaggct

SEQ ID NO: 18860 - DNA, 20 bp, Artificial Sequence
  sgRNA
cgtactgcctcgcccttcat

SEQ ID NO: 18861 - DNA, 20 bp, Artificial Sequence
  sgRNA
ccaccactcctcggctgcgc

SEQ ID NO: 18862 - DNA, 20 bp, Artificial Sequence
  sgRNA
gcacttgttgacaaacaatc

SEQ ID NO: 18863 - DNA, 20 bp, Artificial Sequence
  sgRNA
caacgctaagcttactgcgt

SEQ ID NO: 18864 - DNA, 20 bp, Artificial Sequence
  sgRNA
attggttgctggtcttggtg

SEQ ID NO: 18865 - DNA, 20 bp, Artificial Sequence
  sgRNA
aaaccctgcacgtactgcgc

SEQ ID NO: 18866 - DNA, 20 bp, Artificial Sequence
  sgRNA
aatcatgggtgactttgtgc

SEQ ID NO: 18867 - DNA, 20 bp, Artificial Sequence
  sgRNA
gaaccagcccgcgcgttgct

SEQ ID NO: 18868 - DNA, 20 bp, Artificial Sequence
  sgRNA
agcatacggtactgtgagcg

SEQ ID NO: 18869 - DNA, 20 bp, Artificial Sequence
  sgRNA
cagaggcagcaccgagaaac

SEQ ID NO: 18870 - DNA, 20 bp, Artificial Sequence
  sgRNA
aagagattggtaagtcacag

SEQ ID NO: 18871 - DNA, 20 bp, Artificial Sequence
  sgRNA
ctagctttggactccaacac

SEQ ID NO: 18872 - DNA, 20 bp, Artificial Sequence
  sgRNA
aggcagcacatgccggcgtc

SEQ ID NO: 18873 - DNA, 20 bp, Artificial Sequence
  sgRNA
cagacctttagaggctctct

SEQ ID NO: 18874 - DNA, 20 bp, Artificial Sequence
  sgRNA
ctacgaagcctccactcttc

SEQ ID NO: 18875 - DNA, 20 bp, Artificial Sequence
  sgRNA
cttgggctccggctcggctc

SEQ ID NO: 18876 - DNA, 20 bp, Artificial Sequence
  sgRNA
accgtggccgccgctgggcg

SEQ ID NO: 18877 - DNA, 20 bp, Artificial Sequence
  sgRNA
tctggcggcggcaggtgctg

SEQ ID NO: 18878 - DNA, 20 bp, Artificial Sequence
  sgRNA
tttccctcacatggccgcag

SEQ ID NO: 18879 - DNA, 20 bp, Artificial Sequence
  sgRNA
gcgctgtcaggtggccgcac

SEQ ID NO: 18880 - DNA, 20 bp, Artificial Sequence
  sgRNA
atggtctacaatagttcgta

SEQ ID NO: 18881 - DNA, 20 bp, Artificial Sequence
  sgRNA
cgcgcgcggaacatggctga

SEQ ID NO: 18882 - DNA, 20 bp, Artificial Sequence
  sgRNA
ggttctgcggtaggactccc

SEQ ID NO: 18883 - DNA, 20 bp, Artificial Sequence
  sgRNA
gccggcgaggaacccgcgct

SEQ ID NO: 18884 - DNA, 20 bp, Artificial Sequence
  sgRNA
ccgcgcgccttgggactcgg

SEQ ID NO: 18885 - DNA, 20 bp, Artificial Sequence
  sgRNA
gtggagcaaagatgggccgg

SEQ ID NO: 18886 - DNA, 20 bp, Artificial Sequence
  sgRNA
ctatggcgggctgtggagcc

SEQ ID NO: 18887 - DNA, 20 bp, Artificial Sequence
  sgRNA
atcttcactcattagaaatg

SEQ ID NO: 18888 - DNA, 20 bp, Artificial Sequence
  sgRNA
gggagaggaggaaggaagaa

SEQ ID NO: 18889 - DNA, 20 bp, Artificial Sequence
  sgRNA
gttctgtgagtttgaggtct

SEQ ID NO: 18890 - DNA, 20 bp, Artificial Sequence
  sgRNA
ttgacacagatcatggcctt

SEQ ID NO: 18891 - DNA, 20 bp, Artificial Sequence
  sgRNA
ggcgtctctcgcgggctgcc

SEQ ID NO: 18892 - DNA, 20 bp, Artificial Sequence
  sgRNA
ctgcggtccgcgggaggacc

SEQ ID NO: 18893 - DNA, 20 bp, Artificial Sequence
  sgRNA
gcgctgggagttggcgcgcg

SEQ ID NO: 18894 - DNA, 20 bp, Artificial Sequence
  sgRNA
gacaccggtgcgtgtcaacc

SEQ ID NO: 18895 - DNA, 20 bp, Artificial Sequence
  sgRNA
ctccttctcctagactaccc

SEQ ID NO: 18896 - DNA, 20 bp, Artificial Sequence
  sgRNA
ggagctccgccctgagtcat

SEQ ID NO: 18897 - DNA, 20 bp, Artificial Sequence
  sgRNA
atggtaactatgttaaaggt

SEQ ID NO: 18898 - DNA, 20 bp, Artificial Sequence
  sgRNA
actcctatcaatagatagag

SEQ ID NO: 18899 - DNA, 20 bp, Artificial Sequence
  sgRNA
atgctttgtcttctcagtga

SEQ ID NO: 18900 - DNA, 20 bp, Artificial Sequence
  sgRNA
ctaacccgggcagagcggtc

SEQ ID NO: 18901 - DNA, 20 bp, Artificial Sequence
  sgRNA
ctggtgagtctggttaggaa

SEQ ID NO: 18902 - DNA, 20 bp, Artificial Sequence
  sgRNA
ttgcataccatgtgcgcctc

SEQ ID NO: 18903 - DNA, 20 bp, Artificial Sequence
  sgRNA
acaatttagggtcgcaccgc

SEQ ID NO: 18904 - DNA, 20 bp, Artificial Sequence
  sgRNA
aggaggtggctgcactcccg

SEQ ID NO: 18905 - DNA, 20 bp, Artificial Sequence
  sgRNA
gcgggcgacagactgagtga

SEQ ID NO: 18906 - DNA, 20 bp, Artificial Sequence
  sgRNA
ggatgatgtcactgtagatt

SEQ ID NO: 18907 - DNA, 20 bp, Artificial Sequence
  sgRNA
tagatgctgccgtttgcagc

SEQ ID NO: 18908 - DNA, 20 bp, Artificial Sequence
  sgRNA
actggttaatctacctagct

SEQ ID NO: 18909 - DNA, 20 bp, Artificial Sequence
  sgRNA
tggcgtccctctctgggcac

SEQ ID NO: 18910 - DNA, 20 bp, Artificial Sequence
  sgRNA
gggcgcgggcggaggctcgg

SEQ ID NO: 18911 - DNA, 20 bp, Artificial Sequence
  sgRNA
gcgcatcactggcctgcagg

SEQ ID NO: 18912 - DNA, 20 bp, Artificial Sequence
  sgRNA
tagggagctcaaagtccgac

SEQ ID NO: 18913 - DNA, 20 bp, Artificial Sequence
  sgRNA
tgtgcgagctggtgcgaact

SEQ ID NO: 18914 - DNA, 20 bp, Artificial Sequence
  sgRNA
ctaggcgtcccagagcacta

SEQ ID NO: 18915 - DNA, 20 bp, Artificial Sequence
  sgRNA
gaagtggcacccttgggtgc

SEQ ID NO: 18916 - DNA, 20 bp, Artificial Sequence
  sgRNA
gatgcttgagaaagggattc

SEQ ID NO: 18917 - DNA, 20 bp, Artificial Sequence
  sgRNA
tagccctgggtagtccatca

SEQ ID NO: 18918 - DNA, 20 bp, Artificial Sequence
  sgRNA
cacagagtctccgcgggcgc

SEQ ID NO: 18919 - DNA, 20 bp, Artificial Sequence
  sgRNA
aagctcctacctgcgcagcg

SEQ ID NO: 18920 - DNA, 20 bp, Artificial Sequence
  sgRNA
cgccctttcggtctcgccaa

SEQ ID NO: 18921 - DNA, 20 bp, Artificial Sequence
  sgRNA
aagcaatgtattagttagcc

SEQ ID NO: 18922 - DNA, 20 bp, Artificial Sequence
  sgRNA
aaggtgtgtgctgccatgcc

SEQ ID NO: 18923 - DNA, 20 bp, Artificial Sequence
  sgRNA
ggcaggcagatctaagtgtg

SEQ ID NO: 18924 - DNA, 20 bp, Artificial Sequence
  sgRNA
tgggagccaatgccactaaa

SEQ ID NO: 18925 - DNA, 20 bp, Artificial Sequence
  sgRNA
agatgcgaactggcaaccaa

SEQ ID NO: 18926 - DNA, 20 bp, Artificial Sequence
  sgRNA
gcgcatgcgtgcaagaaggg

SEQ ID NO: 18927 - DNA, 20 bp, Artificial Sequence
  sgRNA
ggctttggttctattcactc

SEQ ID NO: 18928 - DNA, 20 bp, Artificial Sequence
  sgRNA
ctctttgctgtcatagccca

SEQ ID NO: 18929 - DNA, 20 bp, Artificial Sequence
  sgRNA
caggccagcagatgagctct

SEQ ID NO: 18930 - DNA, 20 bp, Artificial Sequence
  sgRNA
catgggcagagctgatgatt

SEQ ID NO: 18931 - DNA, 20 bp, Artificial Sequence
  sgRNA
gggatgcctcctgtgaggct

SEQ ID NO: 18932 - DNA, 20 bp, Artificial Sequence
  sgRNA
gctggagatgtagggatggg

SEQ ID NO: 18933 - DNA, 20 bp, Artificial Sequence
  sgRNA
gggagtctcatgctcagatc

SEQ ID NO: 18934 - DNA, 20 bp, Artificial Sequence
  sgRNA
catcaagatccttagggatg

SEQ ID NO: 18935 - DNA, 20 bp, Artificial Sequence
  sgRNA
accgggaagaggtgggagac

SEQ ID NO: 18936 - DNA, 20 bp, Artificial Sequence
  sgRNA
ggtggagatggagataagga

SEQ ID NO: 18937 - DNA, 20 bp, Artificial Sequence
  sgRNA
gtggagagaagacaagaaag

SEQ ID NO: 18938 - DNA, 20 bp, Artificial Sequence
  sgRNA
cgccttgaattctgggcaag

SEQ ID NO: 18939 - DNA, 20 bp, Artificial Sequence
  sgRNA
cttggaatttagatgggagg

SEQ ID NO: 18940 - DNA, 20 bp, Artificial Sequence
  sgRNA
ggattcttaaacttcgtctg

SEQ ID NO: 18941 - DNA, 20 bp, Artificial Sequence
  sgRNA
aactctctctttaaaggaac

SEQ ID NO: 18942 - DNA, 20 bp, Artificial Sequence
  sgRNA
taaacagtatgtgcaactga

SEQ ID NO: 18943 - DNA, 20 bp, Artificial Sequence
  sgRNA
ttcaaggataaccaaggcag

SEQ ID NO: 18944 - DNA, 20 bp, Artificial Sequence
  sgRNA
ttgagctgtagtttgactat

SEQ ID NO: 18945 - DNA, 20 bp, Artificial Sequence
  sgRNA
aaagagaggaagggagggag

SEQ ID NO: 18946 - DNA, 20 bp, Artificial Sequence
  sgRNA
tgtccaacttgatcttgcga

SEQ ID NO: 18947 - DNA, 20 bp, Artificial Sequence
  sgRNA
gctcaaacagcttgcggacg

SEQ ID NO: 18948 - DNA, 20 bp, Artificial Sequence
  sgRNA
cgctttcgtcacatcctagg

SEQ ID NO: 18949 - DNA, 20 bp, Artificial Sequence
  sgRNA
agtgcttagcagtgttccaa

SEQ ID NO: 18950 - DNA, 20 bp, Artificial Sequence
  sgRNA
gcaccaggccaaacatacaa

SEQ ID NO: 18951 - DNA, 20 bp, Artificial Sequence
  sgRNA
cactacaagggaagttcaga

SEQ ID NO: 18952 - DNA, 20 bp, Artificial Sequence
  sgRNA
ggaggcttgcaaagtattgt

SEQ ID NO: 18953 - DNA, 20 bp, Artificial Sequence
  sgRNA
ggcgctccaggattggtcga

SEQ ID NO: 18954 - DNA, 20 bp, Artificial Sequence
  sgRNA
gcgttgtcgcgcgtgattag

SEQ ID NO: 18955 - DNA, 20 bp, Artificial Sequence
  sgRNA
gaggcggaacttgggcgcgc

SEQ ID NO: 18956 - DNA, 20 bp, Artificial Sequence
  sgRNA
gcggttacccagcaaccgac

SEQ ID NO: 18957 - DNA, 20 bp, Artificial Sequence
  sgRNA
tatctttctctgcggaggcg

SEQ ID NO: 18958 - DNA, 20 bp, Artificial Sequence
  sgRNA
ggaactgggtgttcctcacc

SEQ ID NO: 18959 - DNA, 20 bp, Artificial Sequence
  sgRNA
gtgtcacttgaaagttcctg

SEQ ID NO: 18960 - DNA, 20 bp, Artificial Sequence
  sgRNA
atcaagaatgagggtggact

SEQ ID NO: 18961 - DNA, 20 bp, Artificial Sequence
  sgRNA
cccagcgggcggcagcttcg

SEQ ID NO: 18962 - DNA, 20 bp, Artificial Sequence
  sgRNA
ggaacgcgacgccgccaagg

SEQ ID NO: 18963 - DNA, 20 bp, Artificial Sequence
  sgRNA
ggacgcacttagcgggagga

SEQ ID NO: 18964 - DNA, 20 bp, Artificial Sequence
  sgRNA
aaacatctgtggatggcttg

SEQ ID NO: 18965 - DNA, 20 bp, Artificial Sequence
  sgRNA
gagaggagtattatcggagg

SEQ ID NO: 18966 - DNA, 20 bp, Artificial Sequence
  sgRNA
tctgacagaggaatgaaatg

SEQ ID NO: 18967 - DNA, 20 bp, Artificial Sequence
  sgRNA
tcggatcggcgagcgagcgg

SEQ ID NO: 18968 - DNA, 20 bp, Artificial Sequence
  sgRNA
gcaacgcttccagccatgtt

SEQ ID NO: 18969 - DNA, 20 bp, Artificial Sequence
  sgRNA
ggagtacttccgcgacggtc

SEQ ID NO: 18970 - DNA, 20 bp, Artificial Sequence
  sgRNA
ggcactgagctagacacctg

SEQ ID NO: 18971 - DNA, 20 bp, Artificial Sequence
  sgRNA
tgacaaggtctcgccaagcg

SEQ ID NO: 18972 - DNA, 20 bp, Artificial Sequence
  sgRNA
ttctgggacccgagggcttt

SEQ ID NO: 18973 - DNA, 20 bp, Artificial Sequence
  sgRNA
catctacaaaccagtctgtt

SEQ ID NO: 18974 - DNA, 20 bp, Artificial Sequence
  sgRNA
ctgcttagggtggcccaccc

SEQ ID NO: 18975 - DNA, 20 bp, Artificial Sequence
  sgRNA
ggtggcctcctgagacctcc

SEQ ID NO: 18976 - DNA, 20 bp, Artificial Sequence
  sgRNA
taggcggacgtcccaccctc

SEQ ID NO: 18977 - DNA, 20 bp, Artificial Sequence
  sgRNA
gcgtgacggtgctctcggat

SEQ ID NO: 18978 - DNA, 20 bp, Artificial Sequence
  sgRNA
ggttacctaggtaacgttct

SEQ ID NO: 18979 - DNA, 20 bp, Artificial Sequence
  sgRNA
cacaggttctgaactccgga

SEQ ID NO: 18980 - DNA, 20 bp, Artificial Sequence
  sgRNA
ggaaatagaccggaagttcg

SEQ ID NO: 18981 - DNA, 20 bp, Artificial Sequence
  sgRNA
aatacatcgaagctctaaag

SEQ ID NO: 18982 - DNA, 20 bp, Artificial Sequence
  sgRNA
gccggccttcctccatgcct

SEQ ID NO: 18983 - DNA, 20 bp, Artificial Sequence
  sgRNA
tccctaaaggcaattcaagc

SEQ ID NO: 18984 - DNA, 20 bp, Artificial Sequence
  sgRNA
gtgtgtgctctggctttctt

SEQ ID NO: 18985 - DNA, 20 bp, Artificial Sequence
  sgRNA
ttgcgttgtgaaatacatac

SEQ ID NO: 18986 - DNA, 20 bp, Artificial Sequence
  sgRNA
aactgacttgtcaatcgctg

SEQ ID NO: 18987 - DNA, 20 bp, Artificial Sequence
  sgRNA
gatcactttgacacgatgat

SEQ ID NO: 18988 - DNA, 20 bp, Artificial Sequence
  sgRNA
tatgagggtggcaccaaagt

SEQ ID NO: 18989 - DNA, 20 bp, Artificial Sequence
  sgRNA
agcaccctgccattctatag

SEQ ID NO: 18990 - DNA, 20 bp, Artificial Sequence
  sgRNA
gtccttggccacccaggttc

SEQ ID NO: 18991 - DNA, 20 bp, Artificial Sequence
  sgRNA
ggcctgcgcggctagtttac

SEQ ID NO: 18992 - DNA, 20 bp, Artificial Sequence
  sgRNA
ggcgatggaagacagctgcg

SEQ ID NO: 18993 - DNA, 20 bp, Artificial Sequence
  sgRNA
gcggcgggttccctctcgcc

SEQ ID NO: 18994 - DNA, 20 bp, Artificial Sequence
  sgRNA
cttcttaacttgtcctgcga

SEQ ID NO: 18995 - DNA, 20 bp, Artificial Sequence
  sgRNA
gacgcaggccagcgtttagc

SEQ ID NO: 18996 - DNA, 20 bp, Artificial Sequence
  sgRNA
caccgtccacagggtgggcc

SEQ ID NO: 18997 - DNA, 20 bp, Artificial Sequence
  sgRNA
tgcagttgattactgagctg

SEQ ID NO: 18998 - DNA, 20 bp, Artificial Sequence
  sgRNA
acgggccgcaggcgcgtgca

SEQ ID NO: 18999 - DNA, 20 bp, Artificial Sequence
  sgRNA
tgtagtccgagggtgtaaag

SEQ ID NO: 19000 - DNA, 20 bp, Artificial Sequence
  sgRNA
tagaaacttgcactgatgcc

SEQ ID NO: 19001 - DNA, 20 bp, Artificial Sequence
  sgRNA
tctgttaagataaggcaatc

SEQ ID NO: 19002 - DNA, 20 bp, Artificial Sequence
  sgRNA
acagagctaatactttccaa

SEQ ID NO: 19003 - DNA, 20 bp, Artificial Sequence
  sgRNA
gctcccacgggacgcatccg

SEQ ID NO: 19004 - DNA, 20 bp, Artificial Sequence
  sgRNA
aggagggaaacgagtcctca

SEQ ID NO: 19005 - DNA, 20 bp, Artificial Sequence
  sgRNA
cgctgtccgagccgagttcg

SEQ ID NO: 19006 - DNA, 20 bp, Artificial Sequence
  sgRNA
tcagtttctgcaagtgctga

SEQ ID NO: 19007 - DNA, 20 bp, Artificial Sequence
  sgRNA
cgggacgaaaggacaaggcg

SEQ ID NO: 19008 - DNA, 20 bp, Artificial Sequence
  sgRNA
tgggtctcttcctacgcctc

SEQ ID NO: 19009 - DNA, 20 bp, Artificial Sequence
  sgRNA
ttgcggtggccgcagggagg

SEQ ID NO: 19010 - DNA, 20 bp, Artificial Sequence
  sgRNA
gaggaactaactccgaacgc

SEQ ID NO: 19011 - DNA, 20 bp, Artificial Sequence
  sgRNA
tccgccttacagacccttgc

SEQ ID NO: 19012 - DNA, 20 bp, Artificial Sequence
  sgRNA
agcgctagctctgattggtc

SEQ ID NO: 19013 - DNA, 20 bp, Artificial Sequence
  sgRNA
ccctgcctcggagaaggcct

SEQ ID NO: 19014 - DNA, 20 bp, Artificial Sequence
  sgRNA
ttgtgcgctagctgttacct

SEQ ID NO: 19015 - DNA, 20 bp, Artificial Sequence
  sgRNA
ggtagttacaaaggcataga

SEQ ID NO: 19016 - DNA, 20 bp, Artificial Sequence
  sgRNA
tcaacttatggtaatgagct

SEQ ID NO: 19017 - DNA, 20 bp, Artificial Sequence
  sgRNA
acaaagactggtctgtagcc

SEQ ID NO: 19018 - DNA, 20 bp, Artificial Sequence
  sgRNA
caccgcccattggacgcagc

SEQ ID NO: 19019 - DNA, 20 bp, Artificial Sequence
  sgRNA
cgggtaggctcattgcccaa

SEQ ID NO: 19020 - DNA, 20 bp, Artificial Sequence
  sgRNA
gctttgtgattggccagccg

SEQ ID NO: 19021 - DNA, 20 bp, Artificial Sequence
  sgRNA
agcattgcagcagacacaag

SEQ ID NO: 19022 - DNA, 20 bp, Artificial Sequence
  sgRNA
tgaagactacgctgcagact

SEQ ID NO: 19023 - DNA, 20 bp, Artificial Sequence
  sgRNA
actacggatgccgaggaggt

SEQ ID NO: 19024 - DNA, 20 bp, Artificial Sequence
  sgRNA
ttcccaataagaacgaacaa

SEQ ID NO: 19025 - DNA, 20 bp, Artificial Sequence
  sgRNA
gggaccagcatcagtgagtg

SEQ ID NO: 19026 - DNA, 20 bp, Artificial Sequence
  sgRNA
agtgggcgcgctaagagatg

SEQ ID NO: 19027 - DNA, 20 bp, Artificial Sequence
  sgRNA
aggcttagctgaaagtgcag

SEQ ID NO: 19028 - DNA, 20 bp, Artificial Sequence
  sgRNA
cttggttgtcgcctttgtgt

SEQ ID NO: 19029 - DNA, 20 bp, Artificial Sequence
  sgRNA
tgggccgaagagaatgcttc

SEQ ID NO: 19030 - DNA, 20 bp, Artificial Sequence
  sgRNA
cagagtccggccactccttc

SEQ ID NO: 19031 - DNA, 20 bp, Artificial Sequence
  sgRNA
cgatcggtcggcggctagtc

SEQ ID NO: 19032 - DNA, 20 bp, Artificial Sequence
  sgRNA
gatctccgtagtctgtgctg

SEQ ID NO: 19033 - DNA, 20 bp, Artificial Sequence
  sgRNA
ggtgattactcatttggctg

SEQ ID NO: 19034 - DNA, 20 bp, Artificial Sequence
  sgRNA
gagaacgagtacttggctta

SEQ ID NO: 19035 - DNA, 20 bp, Artificial Sequence
  sgRNA
ccgggtcgtcgagcgtgcag

SEQ ID NO: 19036 - DNA, 20 bp, Artificial Sequence
  sgRNA
ttgaactcaaggccactggg

SEQ ID NO: 19037 - DNA, 20 bp, Artificial Sequence
  sgRNA
ctgcgcaatcccgcccacaa

SEQ ID NO: 19038 - DNA, 20 bp, Artificial Sequence
  sgRNA
gggaaaccgctgagcacctc

SEQ ID NO: 19039 - DNA, 20 bp, Artificial Sequence
  sgRNA
agcgctggaattgctttatg

SEQ ID NO: 19040 - DNA, 20 bp, Artificial Sequence
  sgRNA
atacatgacacagcagagtt

SEQ ID NO: 19041 - DNA, 20 bp, Artificial Sequence
  sgRNA
ggtaaataactctagttagc

SEQ ID NO: 19042 - DNA, 20 bp, Artificial Sequence
  sgRNA
taatgtgcttcaggtttgaa

SEQ ID NO: 19043 - DNA, 20 bp, Artificial Sequence
  sgRNA
ggtctagagtaccaaatgaa

SEQ ID NO: 19044 - DNA, 20 bp, Artificial Sequence
  sgRNA
aatatacttagtgacagctc

SEQ ID NO: 19045 - DNA, 20 bp, Artificial Sequence
  sgRNA
ccgacgatgacgtcagactc

SEQ ID NO: 19046 - DNA, 20 bp, Artificial Sequence
  sgRNA
ttgctatggctcccggcgcc

SEQ ID NO: 19047 - DNA, 20 bp, Artificial Sequence
  sgRNA
ggaagcaatgcgtaatcatt

SEQ ID NO: 19048 - DNA, 20 bp, Artificial Sequence
  sgRNA
cagctgcctttatagctgtc

SEQ ID NO: 19049 - DNA, 20 bp, Artificial Sequence
  sgRNA
cactcactgatcctggactg

SEQ ID NO: 19050 - DNA, 20 bp, Artificial Sequence
  sgRNA
agcgggttaaagtgtgcgcc

SEQ ID NO: 19051 - DNA, 20 bp, Artificial Sequence
  sgRNA
gagcagagaaagccagtcta

SEQ ID NO: 19052 - DNA, 20 bp, Artificial Sequence
  sgRNA
gattccacagccaatgagag

SEQ ID NO: 19053 - DNA, 20 bp, Artificial Sequence
  sgRNA
aaagagccacacaaacaggt

SEQ ID NO: 19054 - DNA, 20 bp, Artificial Sequence
  sgRNA
gacagggtgacctgagtcac

SEQ ID NO: 19055 - DNA, 20 bp, Artificial Sequence
  sgRNA
cccagttcttgactgttaac

SEQ ID NO: 19056 - DNA, 20 bp, Artificial Sequence
  sgRNA
tgatgggaatgggcgtgaag

SEQ ID NO: 19057 - DNA, 20 bp, Artificial Sequence
  sgRNA
gagggcctgtcagctcacaa

SEQ ID NO: 19058 - DNA, 20 bp, Artificial Sequence
  sgRNA
agaatctggaagtttacagc

SEQ ID NO: 19059 - DNA, 20 bp, Artificial Sequence
  sgRNA
ggtcatcgctcggctgcctg

SEQ ID NO: 19060 - DNA, 20 bp, Artificial Sequence
  sgRNA
ctacgcatgcgcccaacgcc

SEQ ID NO: 19061 - DNA, 20 bp, Artificial Sequence
  sgRNA
aaagtgtaatccatggccgc

SEQ ID NO: 19062 - DNA, 20 bp, Artificial Sequence
  sgRNA
cgcgccaatcttcaatctca

SEQ ID NO: 19063 - DNA, 20 bp, Artificial Sequence
  sgRNA
tgcaaggcgctaactgcagt

SEQ ID NO: 19064 - DNA, 20 bp, Artificial Sequence
  sgRNA
cgtgtgttgaatcctagtac

SEQ ID NO: 19065 - DNA, 20 bp, Artificial Sequence
  sgRNA
gtggctggaccacaccagtg

SEQ ID NO: 19066 - DNA, 20 bp, Artificial Sequence
  sgRNA
caccggctctaagtagaatc

SEQ ID NO: 19067 - DNA, 20 bp, Artificial Sequence
  sgRNA
ccttctgccaccgtcttaaa

SEQ ID NO: 19068 - DNA, 20 bp, Artificial Sequence
  sgRNA
actcaggccagtaatgcaag

SEQ ID NO: 19069 - DNA, 20 bp, Artificial Sequence
  sgRNA
gcgcgcgcaggcggaacctg

SEQ ID NO: 19070 - DNA, 20 bp, Artificial Sequence
  sgRNA
gtggaccattatctcttccc

SEQ ID NO: 19071 - DNA, 20 bp, Artificial Sequence
  sgRNA
ctaggaaatgggagtaggcg

SEQ ID NO: 19072 - DNA, 20 bp, Artificial Sequence
  sgRNA
tgcacacaagacgaacagat

SEQ ID NO: 19073 - DNA, 20 bp, Artificial Sequence
  sgRNA
gcgaggtgtctgtcccgcag

SEQ ID NO: 19074 - DNA, 20 bp, Artificial Sequence
  sgRNA
ctgagaagggtctaatctga

SEQ ID NO: 19075 - DNA, 20 bp, Artificial Sequence
  sgRNA
atcttgagcctgtgctgccc

SEQ ID NO: 19076 - DNA, 20 bp, Artificial Sequence
  sgRNA
ccgtcccttgtggttgacag

SEQ ID NO: 19077 - DNA, 20 bp, Artificial Sequence
  sgRNA
aatgaccaaagcttataccc

SEQ ID NO: 19078 - DNA, 20 bp, Artificial Sequence
  sgRNA
ggcagcagtggtggtgttgg

SEQ ID NO: 19079 - DNA, 20 bp, Artificial Sequence
  sgRNA
gtttcctctgtgacataggt

SEQ ID NO: 19080 - DNA, 20 bp, Artificial Sequence
  sgRNA
ggagctttgtgcggccgcgg

SEQ ID NO: 19081 - DNA, 20 bp, Artificial Sequence
  sgRNA
gaggtatccagtgcaaggcg

SEQ ID NO: 19082 - DNA, 20 bp, Artificial Sequence
  sgRNA
aacaacgaaggcgcagcaag

SEQ ID NO: 19083 - DNA, 20 bp, Artificial Sequence
  sgRNA
gggtttgccagcctaggcgc

SEQ ID NO: 19084 - DNA, 20 bp, Artificial Sequence
  sgRNA
cgagaggtgggcacggcttg

SEQ ID NO: 19085 - DNA, 20 bp, Artificial Sequence
  sgRNA
atggctcccggaagtgggcg

SEQ ID NO: 19086 - DNA, 20 bp, Artificial Sequence
  sgRNA
tcagtggtctgtgctagcgg

SEQ ID NO: 19087 - DNA, 20 bp, Artificial Sequence
  sgRNA
aaatttcctgatcttgttct

SEQ ID NO: 19088 - DNA, 20 bp, Artificial Sequence
  sgRNA
ttgtcaacatcatcatctcc

SEQ ID NO: 19089 - DNA, 20 bp, Artificial Sequence
  sgRNA
tctgtagaagcaagaatgga

SEQ ID NO: 19090 - DNA, 20 bp, Artificial Sequence
  sgRNA
tagctgggagtgtgagcaag

SEQ ID NO: 19091 - DNA, 20 bp, Artificial Sequence
  sgRNA
aaaccatctgcttccaaacc

SEQ ID NO: 19092 - DNA, 20 bp, Artificial Sequence
  sgRNA
atctttatggctttagactt

SEQ ID NO: 19093 - DNA, 20 bp, Artificial Sequence
  sgRNA
tctctggcctttacagcagc

SEQ ID NO: 19094 - DNA, 20 bp, Artificial Sequence
  sgRNA
atgctgcagtaataatcgca

SEQ ID NO: 19095 - DNA, 20 bp, Artificial Sequence
  sgRNA
ggagcttgggcgaagctttg

SEQ ID NO: 19096 - DNA, 20 bp, Artificial Sequence
  sgRNA
tttaaagggctgggtgagct

SEQ ID NO: 19097 - DNA, 20 bp, Artificial Sequence
  sgRNA
ctgaagcctgcagtttatcc

SEQ ID NO: 19098 - DNA, 20 bp, Artificial Sequence
  sgRNA
tttcagtggagaatgcagta

SEQ ID NO: 19099 - DNA, 20 bp, Artificial Sequence
  sgRNA
tctagacatgtcggcggccc

SEQ ID NO: 19100 - DNA, 20 bp, Artificial Sequence
  sgRNA
cacaggctttccttaggaag

SEQ ID NO: 19101 - DNA, 20 bp, Artificial Sequence
  sgRNA
agggttgcctgcagggattg

SEQ ID NO: 19102 - DNA, 20 bp, Artificial Sequence
  sgRNA
gtcagcgcgctcgagccact

SEQ ID NO: 19103 - DNA, 20 bp, Artificial Sequence
  sgRNA
ggtcgggcggcggaggaaac

SEQ ID NO: 19104 - DNA, 20 bp, Artificial Sequence
  sgRNA
ctattgttgatgaggagccg

SEQ ID NO: 19105 - DNA, 20 bp, Artificial Sequence
  sgRNA
gttgggcgccacctcctcca

SEQ ID NO: 19106 - DNA, 20 bp, Artificial Sequence
  sgRNA
ggttgagctggctccggagt

SEQ ID NO: 19107 - DNA, 20 bp, Artificial Sequence
  sgRNA
gtgaagcggaatataaaggg

SEQ ID NO: 19108 - DNA, 20 bp, Artificial Sequence
  sgRNA
ttggctggagttacaggacc

SEQ ID NO: 19109 - DNA, 20 bp, Artificial Sequence
  sgRNA
tagtctcgcgagaactggct

SEQ ID NO: 19110 - DNA, 20 bp, Artificial Sequence
  sgRNA
tcgcgagagcagcgaaggcc

SEQ ID NO: 19111 - DNA, 20 bp, Artificial Sequence
  sgRNA
aagcagctgtttagccctcc

SEQ ID NO: 19112 - DNA, 20 bp, Artificial Sequence
  sgRNA
gcgacacgccctgaaatccc

SEQ ID NO: 19113 - DNA, 20 bp, Artificial Sequence
  sgRNA
tttagctaatttgttgaacc

SEQ ID NO: 19114 - DNA, 20 bp, Artificial Sequence
  sgRNA
ggctccagagccaaactgcc

SEQ ID NO: 19115 - DNA, 20 bp, Artificial Sequence
  sgRNA
ctctcttctaacctaccaca

SEQ ID NO: 19116 - DNA, 20 bp, Artificial Sequence
  sgRNA
tagtgggacagcgtggactt

SEQ ID NO: 19117 - DNA, 20 bp, Artificial Sequence
  sgRNA
caggcggagctttcgtgctg

SEQ ID NO: 19118 - DNA, 20 bp, Artificial Sequence
  sgRNA
agggaggactacgctgctca

SEQ ID NO: 19119 - DNA, 20 bp, Artificial Sequence
  sgRNA
ctagggaccacgcgtgggcg

SEQ ID NO: 19120 - DNA, 20 bp, Artificial Sequence
  sgRNA
gagctgactgggagatggtg

SEQ ID NO: 19121 - DNA, 20 bp, Artificial Sequence
  sgRNA
cttcaggtctcagcctgaaa

SEQ ID NO: 19122 - DNA, 20 bp, Artificial Sequence
  sgRNA
aatgtcgtgagtattatcag

SEQ ID NO: 19123 - DNA, 20 bp, Artificial Sequence
  sgRNA
agtgctcagacagggaagat

SEQ ID NO: 19124 - DNA, 20 bp, Artificial Sequence
  sgRNA
gacaaatactgttgcagatt

SEQ ID NO: 19125 - DNA, 20 bp, Artificial Sequence
  sgRNA
aacctcttcaattgtagacg

SEQ ID NO: 19126 - DNA, 20 bp, Artificial Sequence
  sgRNA
tgtagtcgagccaggttgcc

SEQ ID NO: 19127 - DNA, 20 bp, Artificial Sequence
  sgRNA
gggaggaagcagcgctaaga

SEQ ID NO: 19128 - DNA, 20 bp, Artificial Sequence
  sgRNA
gcgacaatagcaggacacag

SEQ ID NO: 19129 - DNA, 20 bp, Artificial Sequence
  sgRNA
gagcgacgaggccaggtggg

SEQ ID NO: 19130 - DNA, 20 bp, Artificial Sequence
  sgRNA
atgcagatgaggcgggcgcg

SEQ ID NO: 19131 - DNA, 20 bp, Artificial Sequence
  sgRNA
agctcaggaatgtggcggcg

SEQ ID NO: 19132 - DNA, 20 bp, Artificial Sequence
  sgRNA
gcaatcctccttgcgggttg

SEQ ID NO: 19133 - DNA, 20 bp, Artificial Sequence
  sgRNA
ctcggccacctggaggagcc

SEQ ID NO: 19134 - DNA, 20 bp, Artificial Sequence
  sgRNA
cagcctcacgtgggccggca

SEQ ID NO: 19135 - DNA, 20 bp, Artificial Sequence
  sgRNA
ggaagtgggtgtggctcctg

SEQ ID NO: 19136 - DNA, 20 bp, Artificial Sequence
  sgRNA
aggagggagtatggaaagcc

SEQ ID NO: 19137 - DNA, 20 bp, Artificial Sequence
  sgRNA
tatagccctttgtgatgagg

SEQ ID NO: 19138 - DNA, 20 bp, Artificial Sequence
  sgRNA
ccaggtgatgatgaagaatg

SEQ ID NO: 19139 - DNA, 20 bp, Artificial Sequence
  sgRNA
taagccactcttcatagtgt

SEQ ID NO: 19140 - DNA, 20 bp, Artificial Sequence
  sgRNA
aacagaccagatatcaggtc

SEQ ID NO: 19141 - DNA, 20 bp, Artificial Sequence
  sgRNA
ctggcgctgggcgggtttag

SEQ ID NO: 19142 - DNA, 20 bp, Artificial Sequence
  sgRNA
gctagccagcaccctaatgt

SEQ ID NO: 19143 - DNA, 20 bp, Artificial Sequence
  sgRNA
agtccaaggttgcagatcct

SEQ ID NO: 19144 - DNA, 20 bp, Artificial Sequence
  sgRNA
cgcccttacttgagtcttat

SEQ ID NO: 19145 - DNA, 20 bp, Artificial Sequence
  sgRNA
gtctgaatagaacgcccaaa

SEQ ID NO: 19146 - DNA, 20 bp, Artificial Sequence
  sgRNA
attaaggataagatcccttg

SEQ ID NO: 19147 - DNA, 20 bp, Artificial Sequence
  sgRNA
gcagggtggcgagccgagcc

SEQ ID NO: 19148 - DNA, 20 bp, Artificial Sequence
  sgRNA
gcgtcacccgcagcgtctgg

SEQ ID NO: 19149 - DNA, 20 bp, Artificial Sequence
  sgRNA
gggtccggcgctggccactg

SEQ ID NO: 19150 - DNA, 20 bp, Artificial Sequence
  sgRNA
ggagaaactagaaatctgac

SEQ ID NO: 19151 - DNA, 20 bp, Artificial Sequence
  sgRNA
ttcaaccgaggtagactccc

SEQ ID NO: 19152 - DNA, 20 bp, Artificial Sequence
  sgRNA
gggctgtaagggcttcaccg

SEQ ID NO: 19153 - DNA, 20 bp, Artificial Sequence
  sgRNA
ggatgtcaaatgctcaggat

SEQ ID NO: 19154 - DNA, 20 bp, Artificial Sequence
  sgRNA
aaactgggcggagcgatggt

SEQ ID NO: 19155 - DNA, 20 bp, Artificial Sequence
  sgRNA
tgatgggatactaaatgtgt

SEQ ID NO: 19156 - DNA, 20 bp, Artificial Sequence
  sgRNA
ctgtttgtctaccctgtgtg

SEQ ID NO: 19157 - DNA, 20 bp, Artificial Sequence
  sgRNA
agtgataaggaaatttactc

SEQ ID NO: 19158 - DNA, 20 bp, Artificial Sequence
  sgRNA
tgtgcttgtgaagaagtaga

SEQ ID NO: 19159 - DNA, 20 bp, Artificial Sequence
  sgRNA
agcaacgtgccctgggccac

SEQ ID NO: 19160 - DNA, 20 bp, Artificial Sequence
  sgRNA
ttgtacttcgtccagtacaa

SEQ ID NO: 19161 - DNA, 20 bp, Artificial Sequence
  sgRNA
aacagacttctctcctaaca

SEQ ID NO: 19162 - DNA, 20 bp, Artificial Sequence
  sgRNA
gtccaaactctgtgtacttt

SEQ ID NO: 19163 - DNA, 20 bp, Artificial Sequence
  sgRNA
aaattgcatttatagtccct

SEQ ID NO: 19164 - DNA, 20 bp, Artificial Sequence
  sgRNA
agcgccttggaaccttggcc

SEQ ID NO: 19165 - DNA, 20 bp, Artificial Sequence
  sgRNA
ctatttatagcgcgctaaga

SEQ ID NO: 19166 - DNA, 20 bp, Artificial Sequence
  sgRNA
gctgaagctagactggagga

SEQ ID NO: 19167 - DNA, 20 bp, Artificial Sequence
  sgRNA
gaagcgaagcggttgtgcac

SEQ ID NO: 19168 - DNA, 20 bp, Artificial Sequence
  sgRNA
atgccaggccatgagctcct

SEQ ID NO: 19169 - DNA, 20 bp, Artificial Sequence
  sgRNA
cacccagagcatgttagatg

SEQ ID NO: 19170 - DNA, 20 bp, Artificial Sequence
  sgRNA
gcccagtgcaactcgcgaaa

SEQ ID NO: 19171 - DNA, 20 bp, Artificial Sequence
  sgRNA
atgcctacctggagggagtg

SEQ ID NO: 19172 - DNA, 20 bp, Artificial Sequence
  sgRNA
ggtcggtcggccctgcagag

SEQ ID NO: 19173 - DNA, 20 bp, Artificial Sequence
  sgRNA
cctggcactctttgatgaag

SEQ ID NO: 19174 - DNA, 20 bp, Artificial Sequence
  sgRNA
actctagggcatcccagtcc

SEQ ID NO: 19175 - DNA, 20 bp, Artificial Sequence
  sgRNA
gaagaggatgccgagagcac

SEQ ID NO: 19176 - DNA, 20 bp, Artificial Sequence
  sgRNA
ggcgctggcagccacaggct

SEQ ID NO: 19177 - DNA, 20 bp, Artificial Sequence
  sgRNA
cattcccgagaaacaccctc

SEQ ID NO: 19178 - DNA, 20 bp, Artificial Sequence
  sgRNA
gcacacatgcaacagtagtc

SEQ ID NO: 19179 - DNA, 20 bp, Artificial Sequence
  sgRNA
ggcagagggcagtaagcagt

SEQ ID NO: 19180 - DNA, 20 bp, Artificial Sequence
  sgRNA
cagagggcctgacctttgcc

SEQ ID NO: 19181 - DNA, 20 bp, Artificial Sequence
  sgRNA
tgccatggcgatcttagatg

SEQ ID NO: 19182 - DNA, 20 bp, Artificial Sequence
  sgRNA
gaacgagtaccgcgaggcag

SEQ ID NO: 19183 - DNA, 20 bp, Artificial Sequence
  sgRNA
actgccttgagtgaccgcga

SEQ ID NO: 19184 - DNA, 20 bp, Artificial Sequence
  sgRNA
gaagtgtactgcaccattta

SEQ ID NO: 19185 - DNA, 20 bp, Artificial Sequence
  sgRNA
tacgcaatcgagatgcacgc

SEQ ID NO: 19186 - DNA, 20 bp, Artificial Sequence
  sgRNA
caggcggcaacgcgggatcc

SEQ ID NO: 19187 - DNA, 20 bp, Artificial Sequence
  sgRNA
ctcagggccggtacttccgg

SEQ ID NO: 19188 - DNA, 20 bp, Artificial Sequence
  sgRNA
gttgggctttataagactcc

SEQ ID NO: 19189 - DNA, 20 bp, Artificial Sequence
  sgRNA
ggcctcgataagcggaggcg

SEQ ID NO: 19190 - DNA, 20 bp, Artificial Sequence
  sgRNA
gtacatagctgcactgttcc

SEQ ID NO: 19191 - DNA, 20 bp, Artificial Sequence
  sgRNA
acagatctgtagtagcccag

SEQ ID NO: 19192 - DNA, 20 bp, Artificial Sequence
  sgRNA
accagcctgtgtctccttct

SEQ ID NO: 19193 - DNA, 20 bp, Artificial Sequence
  sgRNA
gggctggagaccggagctgc

SEQ ID NO: 19194 - DNA, 20 bp, Artificial Sequence
  sgRNA
gtcgttatgacaaccgcgtc

SEQ ID NO: 19195 - DNA, 20 bp, Artificial Sequence
  sgRNA
actgaccaattaacgtgaaa

SEQ ID NO: 19196 - DNA, 20 bp, Artificial Sequence
  sgRNA
ccaatagaagctccgggaga

SEQ ID NO: 19197 - DNA, 20 bp, Artificial Sequence
  sgRNA
ggactcgggacagggcctaa

SEQ ID NO: 19198 - DNA, 20 bp, Artificial Sequence
  sgRNA
cactgggcgagggcgtggcc

SEQ ID NO: 19199 - DNA, 20 bp, Artificial Sequence
  sgRNA
ccgccttcactgggaggagg

SEQ ID NO: 19200 - DNA, 20 bp, Artificial Sequence
  sgRNA
caggttgtcatctggtgacc

SEQ ID NO: 19201 - DNA, 20 bp, Artificial Sequence
  sgRNA
ttgaggctcaaccgatgccc

SEQ ID NO: 19202 - DNA, 20 bp, Artificial Sequence
  sgRNA
gtgccgtagcagagctgtct

SEQ ID NO: 19203 - DNA, 20 bp, Artificial Sequence
  sgRNA
tgaatactatattcaggaag

SEQ ID NO: 19204 - DNA, 20 bp, Artificial Sequence
  sgRNA
caaatctctgcttctgactt

SEQ ID NO: 19205 - DNA, 20 bp, Artificial Sequence
  sgRNA
cactgatttaaacagatctt

SEQ ID NO: 19206 - DNA, 20 bp, Artificial Sequence
  sgRNA
tttaacttactgctgtcaag

SEQ ID NO: 19207 - DNA, 20 bp, Artificial Sequence
  sgRNA
ccgtcctgggccacttgtcc

SEQ ID NO: 19208 - DNA, 20 bp, Artificial Sequence
  sgRNA
tttctgatcgtgactgtccc

SEQ ID NO: 19209 - DNA, 20 bp, Artificial Sequence
  sgRNA
gttaacagccgagaacaagt

SEQ ID NO: 19210 - DNA, 20 bp, Artificial Sequence
  sgRNA
gctggcgtaacgatgggatg

SEQ ID NO: 19211 - DNA, 20 bp, Artificial Sequence
  sgRNA
ccggattgtgacgtccagtc

SEQ ID NO: 19212 - DNA, 20 bp, Artificial Sequence
  sgRNA
ctctcatccagttcctagtg

SEQ ID NO: 19213 - DNA, 20 bp, Artificial Sequence
  sgRNA
aattggcggtgttgcttata

SEQ ID NO: 19214 - DNA, 20 bp, Artificial Sequence
  sgRNA
ttctgaaacctaaaccgcac

SEQ ID NO: 19215 - DNA, 20 bp, Artificial Sequence
  sgRNA
acagggagtgtctgagtcag

SEQ ID NO: 19216 - DNA, 20 bp, Artificial Sequence
  sgRNA
actattgtggtcatcacaat

SEQ ID NO: 19217 - DNA, 20 bp, Artificial Sequence
  sgRNA
tgagcataatttcacttgaa

SEQ ID NO: 19218 - DNA, 20 bp, Artificial Sequence
  sgRNA
cggatagaagaaggagccgc

SEQ ID NO: 19219 - DNA, 20 bp, Artificial Sequence
  sgRNA
gagcaggctcggccacatcg

SEQ ID NO: 19220 - DNA, 20 bp, Artificial Sequence
  sgRNA
cagctgccaccggcggacaa

SEQ ID NO: 19221 - DNA, 20 bp, Artificial Sequence
  sgRNA
cccgtcccttgacaggcccg

SEQ ID NO: 19222 - DNA, 20 bp, Artificial Sequence
  sgRNA
gtgcctcattgggccgcccg

SEQ ID NO: 19223 - DNA, 20 bp, Artificial Sequence
  sgRNA
caagcccggccaaccggcgg

SEQ ID NO: 19224 - DNA, 20 bp, Artificial Sequence
  sgRNA
gcgtttcggagcctgagttt

SEQ ID NO: 19225 - DNA, 20 bp, Artificial Sequence
  sgRNA
agggcccagcacattgtgag

SEQ ID NO: 19226 - DNA, 20 bp, Artificial Sequence
  sgRNA
ctgggaggcgggcctaatac

SEQ ID NO: 19227 - DNA, 20 bp, Artificial Sequence
  sgRNA
ggaaatcctgtcactcagcc

SEQ ID NO: 19228 - DNA, 20 bp, Artificial Sequence
  sgRNA
tttcctttccctggttagga

SEQ ID NO: 19229 - DNA, 20 bp, Artificial Sequence
  sgRNA
tctgagctgtatataagtcc

SEQ ID NO: 19230 - DNA, 20 bp, Artificial Sequence
  sgRNA
gcgcgattcctaaaccggag

SEQ ID NO: 19231 - DNA, 20 bp, Artificial Sequence
  sgRNA
accggcctccaccctagttc

SEQ ID NO: 19232 - DNA, 20 bp, Artificial Sequence
  sgRNA
atgccgtagtgaccgactga

SEQ ID NO: 19233 - DNA, 20 bp, Artificial Sequence
  sgRNA
ggacattgccttcccttccc

SEQ ID NO: 19234 - DNA, 20 bp, Artificial Sequence
  sgRNA
ataaatatcaggaagtcttg

SEQ ID NO: 19235 - DNA, 20 bp, Artificial Sequence
  sgRNA
agctaaccatggaggagact

SEQ ID NO: 19236 - DNA, 20 bp, Artificial Sequence
  sgRNA
caagggcaggtattgccgcg

SEQ ID NO: 19237 - DNA, 20 bp, Artificial Sequence
  sgRNA
ttgcctgccctgctgaggcg

SEQ ID NO: 19238 - DNA, 20 bp, Artificial Sequence
  sgRNA
aaccatgctcaccgctcaac

SEQ ID NO: 19239 - DNA, 20 bp, Artificial Sequence
  sgRNA
gacggagggtgggagtctgc

SEQ ID NO: 19240 - DNA, 20 bp, Artificial Sequence
  sgRNA
gagccgctctgggcattggg

SEQ ID NO: 19241 - DNA, 20 bp, Artificial Sequence
  sgRNA
cgcgatgggcgtcgggctgg

SEQ ID NO: 19242 - DNA, 20 bp, Artificial Sequence
  sgRNA
gtttgttaaggaccaggagt

SEQ ID NO: 19243 - DNA, 20 bp, Artificial Sequence
  sgRNA
ccgcccacctggaaccctag

SEQ ID NO: 19244 - DNA, 20 bp, Artificial Sequence
  sgRNA
ggtctattgtgggaaagaag

SEQ ID NO: 19245 - DNA, 20 bp, Artificial Sequence
  sgRNA
tgagttgccatgtgggccag

SEQ ID NO: 19246 - DNA, 20 bp, Artificial Sequence
  sgRNA
ttacctaagagccgtaagca

SEQ ID NO: 19247 - DNA, 20 bp, Artificial Sequence
  sgRNA
tgggatcaatttagttaatg

SEQ ID NO: 19248 - DNA, 20 bp, Artificial Sequence
  sgRNA
cttcccggctttgacataag

SEQ ID NO: 19249 - DNA, 20 bp, Artificial Sequence
  sgRNA
cttcctcgggaaacaccgag

SEQ ID NO: 19250 - DNA, 20 bp, Artificial Sequence
  sgRNA
aagtataaatacgaagggct

SEQ ID NO: 19251 - DNA, 20 bp, Artificial Sequence
  sgRNA
ggcagaccacgtgggaactt

SEQ ID NO: 19252 - DNA, 20 bp, Artificial Sequence
  sgRNA
ggaggtctctgggttacagt

SEQ ID NO: 19253 - DNA, 20 bp, Artificial Sequence
  sgRNA
ttagcttctgtatgggtgaa

SEQ ID NO: 19254 - DNA, 20 bp, Artificial Sequence
  sgRNA
gccactaagaattcagcacc

SEQ ID NO: 19255 - DNA, 20 bp, Artificial Sequence
  sgRNA
acaagctaagatgcctccag

SEQ ID NO: 19256 - DNA, 20 bp, Artificial Sequence
  sgRNA
acttctgctgtgcactgaca

SEQ ID NO: 19257 - DNA, 20 bp, Artificial Sequence
  sgRNA
agtaagttatccgggaccct

SEQ ID NO: 19258 - DNA, 20 bp, Artificial Sequence
  sgRNA
aggagtatatgtttaagcag

SEQ ID NO: 19259 - DNA, 20 bp, Artificial Sequence
  sgRNA
ccaaattaacccattattgt

SEQ ID NO: 19260 - DNA, 20 bp, Artificial Sequence
  sgRNA
ggcgtgcccgtgaaggttgg

SEQ ID NO: 19261 - DNA, 20 bp, Artificial Sequence
  sgRNA
aggactagtcctccagtcca

SEQ ID NO: 19262 - DNA, 20 bp, Artificial Sequence
  sgRNA
gttggcaagcttccctgtaa

SEQ ID NO: 19263 - DNA, 20 bp, Artificial Sequence
  sgRNA
agaaacttgttgaagtagat

SEQ ID NO: 19264 - DNA, 20 bp, Artificial Sequence
  sgRNA
tggagcactcagttccaaat

SEQ ID NO: 19265 - DNA, 20 bp, Artificial Sequence
  sgRNA
ttgtagttcggtggctcatc

SEQ ID NO: 19266 - DNA, 20 bp, Artificial Sequence
  sgRNA
caccagtcgcagggtatcat

SEQ ID NO: 19267 - DNA, 20 bp, Artificial Sequence
  sgRNA
cggcccgaatcacccagcca

SEQ ID NO: 19268 - DNA, 20 bp, Artificial Sequence
  sgRNA
ggcgtagggaccaagaaccg

SEQ ID NO: 19269 - DNA, 20 bp, Artificial Sequence
  sgRNA
ccacttagggattgcccagt

SEQ ID NO: 19270 - DNA, 20 bp, Artificial Sequence
  sgRNA
ccgttggagcacacgagctc

SEQ ID NO: 19271 - DNA, 20 bp, Artificial Sequence
  sgRNA
tgacccggaacatccaccaa

SEQ ID NO: 19272 - DNA, 20 bp, Artificial Sequence
  sgRNA
cgggactgagactcagctgg

SEQ ID NO: 19273 - DNA, 20 bp, Artificial Sequence
  sgRNA
agaagagaagcgcttaggcg

SEQ ID NO: 19274 - DNA, 20 bp, Artificial Sequence
  sgRNA
ggcgcgacacgctctatcaa

SEQ ID NO: 19275 - DNA, 20 bp, Artificial Sequence
  sgRNA
ttacgggctttcgtagcttc

SEQ ID NO: 19276 - DNA, 20 bp, Artificial Sequence
  sgRNA
cgcactaggagccggacgaa

SEQ ID NO: 19277 - DNA, 20 bp, Artificial Sequence
  sgRNA
aatagtgtcaaccagtcacc

SEQ ID NO: 19278 - DNA, 20 bp, Artificial Sequence
  sgRNA
gaaacaggaggaattgaacc

SEQ ID NO: 19279 - DNA, 20 bp, Artificial Sequence
  sgRNA
tacacatcaaatagcctccc

SEQ ID NO: 19280 - DNA, 20 bp, Artificial Sequence
  sgRNA
tgtgtgcaacagtgtccacc

SEQ ID NO: 19281 - DNA, 20 bp, Artificial Sequence
  sgRNA
tgacctcgtattgcctctcc

SEQ ID NO: 19282 - DNA, 20 bp, Artificial Sequence
  sgRNA
ctgtgtccttgagaacgaat

SEQ ID NO: 19283 - DNA, 20 bp, Artificial Sequence
  sgRNA
tcacgtgattcaaacaaaca

SEQ ID NO: 19284 - DNA, 20 bp, Artificial Sequence
  sgRNA
aaagagagcgccactcttat

SEQ ID NO: 19285 - DNA, 20 bp, Artificial Sequence
  sgRNA
acaagtcccattgcgaagag

SEQ ID NO: 19286 - DNA, 20 bp, Artificial Sequence
  sgRNA
ctacactttcaatctgaccc

SEQ ID NO: 19287 - DNA, 20 bp, Artificial Sequence
  sgRNA
cccgtgagagggtacgcgct

SEQ ID NO: 19288 - DNA, 20 bp, Artificial Sequence
  sgRNA
gctgacgcacgccagtgcgc

SEQ ID NO: 19289 - DNA, 20 bp, Artificial Sequence
  sgRNA
gggacctgttgctatatcca

SEQ ID NO: 19290 - DNA, 20 bp, Artificial Sequence
  sgRNA
gcgcagtccgtctgcccgcg

SEQ ID NO: 19291 - DNA, 20 bp, Artificial Sequence
  sgRNA
gaagcacctctccagcgact

SEQ ID NO: 19292 - DNA, 20 bp, Artificial Sequence
  sgRNA
ggattgaaagcagctgtcat

SEQ ID NO: 19293 - DNA, 20 bp, Artificial Sequence
  sgRNA
gcctgaaagaggctgtaatc

SEQ ID NO: 19294 - DNA, 20 bp, Artificial Sequence
  sgRNA
gaacatggactggcccgtcg

SEQ ID NO: 19295 - DNA, 20 bp, Artificial Sequence
  sgRNA
atgcaccaggagtctgaggg

SEQ ID NO: 19296 - DNA, 20 bp, Artificial Sequence
  sgRNA
cgaggaggcggtgccgtaca

SEQ ID NO: 19297 - DNA, 20 bp, Artificial Sequence
  sgRNA
gcaggcaaggagagcgtctt

SEQ ID NO: 19298 - DNA, 20 bp, Artificial Sequence
  sgRNA
cgggacgtggattacgcaac

SEQ ID NO: 19299 - DNA, 20 bp, Artificial Sequence
  sgRNA
gtattactactgctgcatac

SEQ ID NO: 19300 - DNA, 20 bp, Artificial Sequence
  sgRNA
tttgcggatgcgccatctag

SEQ ID NO: 19301 - DNA, 20 bp, Artificial Sequence
  sgRNA
atggcggccgagttcgtgcg

SEQ ID NO: 19302 - DNA, 20 bp, Artificial Sequence
  sgRNA
gttgacgcaggcgccattac

SEQ ID NO: 19303 - DNA, 20 bp, Artificial Sequence
  sgRNA
gcgggccggtgttcgctgat

SEQ ID NO: 19304 - DNA, 20 bp, Artificial Sequence
  sgRNA
gggacgaacttgatcttctt

SEQ ID NO: 19305 - DNA, 20 bp, Artificial Sequence
  sgRNA
tgcagcggctgagtcgtatt

SEQ ID NO: 19306 - DNA, 20 bp, Artificial Sequence
  sgRNA
ttctcttccacgacctctgc

SEQ ID NO: 19307 - DNA, 20 bp, Artificial Sequence
  sgRNA
actacagtgggtccaggagg

SEQ ID NO: 19308 - DNA, 20 bp, Artificial Sequence
  sgRNA
cccactcctcttggagaggt

SEQ ID NO: 19309 - DNA, 20 bp, Artificial Sequence
  sgRNA
tgccacaacagtgtgtgaga

SEQ ID NO: 19310 - DNA, 20 bp, Artificial Sequence
  sgRNA
ggtgagctaggccactggga

SEQ ID NO: 19311 - DNA, 20 bp, Artificial Sequence
  sgRNA
gcgagaatgcagggttgaga

SEQ ID NO: 19312 - DNA, 20 bp, Artificial Sequence
  sgRNA
tcacctgcacagtccagaaa

SEQ ID NO: 19313 - DNA, 20 bp, Artificial Sequence
  sgRNA
aggttaccggagggacacgg

SEQ ID NO: 19314 - DNA, 20 bp, Artificial Sequence
  sgRNA
accaaaggcggtcatccaat

SEQ ID NO: 19315 - DNA, 20 bp, Artificial Sequence
  sgRNA
ttgagggcccgcgcacctat

SEQ ID NO: 19316 - DNA, 20 bp, Artificial Sequence
  sgRNA
agctgaagacactaggtgag

SEQ ID NO: 19317 - DNA, 20 bp, Artificial Sequence
  sgRNA
tagggatgctcaggtcaagc

SEQ ID NO: 19318 - DNA, 20 bp, Artificial Sequence
  sgRNA
ttctgcctttagatgaaatg

SEQ ID NO: 19319 - DNA, 20 bp, Artificial Sequence
  sgRNA
gggaccggagctataacttc

SEQ ID NO: 19320 - DNA, 20 bp, Artificial Sequence
  sgRNA
aatacaactcctcccttagg

SEQ ID NO: 19321 - DNA, 20 bp, Artificial Sequence
  sgRNA
agtcttatatagattcctgg

SEQ ID NO: 19322 - DNA, 20 bp, Artificial Sequence
  sgRNA
gggcgcccgagcgatctcct

SEQ ID NO: 19323 - DNA, 20 bp, Artificial Sequence
  sgRNA
ttgcgttcggcccagcgacc

SEQ ID NO: 19324 - DNA, 20 bp, Artificial Sequence
  sgRNA
ctgagcggagcgcaaagtcg

SEQ ID NO: 19325 - DNA, 20 bp, Artificial Sequence
  sgRNA
acccaaagctggtttcctaa

SEQ ID NO: 19326 - DNA, 20 bp, Artificial Sequence
  sgRNA
tttcctaacggtggctgcag

SEQ ID NO: 19327 - DNA, 20 bp, Artificial Sequence
  sgRNA
gcattaaatgctgggaaagc

SEQ ID NO: 19328 - DNA, 20 bp, Artificial Sequence
  sgRNA
ggctctgagggatgaggaca

SEQ ID NO: 19329 - DNA, 20 bp, Artificial Sequence
  sgRNA
gggctgtttatgctgtgatg

SEQ ID NO: 19330 - DNA, 20 bp, Artificial Sequence
  sgRNA
cccgcaggtactttcagcgc

SEQ ID NO: 19331 - DNA, 20 bp, Artificial Sequence
  sgRNA
ggcgggagattctatcttgg

SEQ ID NO: 19332 - DNA, 20 bp, Artificial Sequence
  sgRNA
gtggacttgtctttatcgcc

SEQ ID NO: 19333 - DNA, 20 bp, Artificial Sequence
  sgRNA
tcgcaagtcacgcccatcag

SEQ ID NO: 19334 - DNA, 20 bp, Artificial Sequence
  sgRNA
tggtacaagggtgcgcagcg

SEQ ID NO: 19335 - DNA, 20 bp, Artificial Sequence
  sgRNA
gtttagagcacccagaaccc

SEQ ID NO: 19336 - DNA, 20 bp, Artificial Sequence
  sgRNA
cttcggtgcctagcgggtgc

SEQ ID NO: 19337 - DNA, 20 bp, Artificial Sequence
  sgRNA
gcagccctgcccagattaag

SEQ ID NO: 19338 - DNA, 20 bp, Artificial Sequence
  sgRNA
ggtcaacgtgaggaatttag

SEQ ID NO: 19339 - DNA, 20 bp, Artificial Sequence
  sgRNA
aagcgtaaggctcacaagca

SEQ ID NO: 19340 - DNA, 20 bp, Artificial Sequence
  sgRNA
cgggcggagcccattgtgtg

SEQ ID NO: 19341 - DNA, 20 bp, Artificial Sequence
  sgRNA
ctgtagccacaccgtcagaa

SEQ ID NO: 19342 - DNA, 20 bp, Artificial Sequence
  sgRNA
aaagatgtatgccaagacgg

SEQ ID NO: 19343 - DNA, 20 bp, Artificial Sequence
  sgRNA
ggatggacttcctacgtcac

SEQ ID NO: 19344 - DNA, 20 bp, Artificial Sequence
  sgRNA
ctttatagaagcgctgtgaa

SEQ ID NO: 19345 - DNA, 20 bp, Artificial Sequence
  sgRNA
aatgaattgttcctggtagt

SEQ ID NO: 19346 - DNA, 20 bp, Artificial Sequence
  sgRNA
aactgttcatctaaccacaa

SEQ ID NO: 19347 - DNA, 20 bp, Artificial Sequence
  sgRNA
gaaggaactaaccagaactc

SEQ ID NO: 19348 - DNA, 20 bp, Artificial Sequence
  sgRNA
tacggcggtgggcacgcggg

SEQ ID NO: 19349 - DNA, 20 bp, Artificial Sequence
  sgRNA
gtgtggttcctaaccggacg

SEQ ID NO: 19350 - DNA, 20 bp, Artificial Sequence
  sgRNA
gcagtagtccgtcggagcga

SEQ ID NO: 19351 - DNA, 20 bp, Artificial Sequence
  sgRNA
agcaataatgagttgtcatc

SEQ ID NO: 19352 - DNA, 20 bp, Artificial Sequence
  sgRNA
gaactctacatatgagcacc

SEQ ID NO: 19353 - DNA, 20 bp, Artificial Sequence
  sgRNA
aaatctgaagcaactcctcc

SEQ ID NO: 19354 - DNA, 20 bp, Artificial Sequence
  sgRNA
aagttacagagccaaacaca

SEQ ID NO: 19355 - DNA, 20 bp, Artificial Sequence
  sgRNA
gtggagcctgcttatcagtg

SEQ ID NO: 19356 - DNA, 20 bp, Artificial Sequence
  sgRNA
ctgcgtctgctccttgtgtt

SEQ ID NO: 19357 - DNA, 20 bp, Artificial Sequence
  sgRNA
acttcggcccgcagcttgcg

SEQ ID NO: 19358 - DNA, 20 bp, Artificial Sequence
  sgRNA
aggcgcgcgctcgcacctcg

SEQ ID NO: 19359 - DNA, 20 bp, Artificial Sequence
  sgRNA
gtgcaggcggcccgcggccg

SEQ ID NO: 19360 - DNA, 20 bp, Artificial Sequence
  sgRNA
gggcttcattccttggatgt

SEQ ID NO: 19361 - DNA, 20 bp, Artificial Sequence
  sgRNA
gaggctgtggatgtataagc

SEQ ID NO: 19362 - DNA, 20 bp, Artificial Sequence
  sgRNA
ctctcaaagtccactgttgg

SEQ ID NO: 19363 - DNA, 20 bp, Artificial Sequence
  sgRNA
cggccgggcctgggaccagg

SEQ ID NO: 19364 - DNA, 20 bp, Artificial Sequence
  sgRNA
agcgcgcacgcccagagctc

SEQ ID NO: 19365 - DNA, 20 bp, Artificial Sequence
  sgRNA
gggagcgcggcagcactgcg

SEQ ID NO: 19366 - DNA, 20 bp, Artificial Sequence
  sgRNA
ggacccaagcagcactggtg

SEQ ID NO: 19367 - DNA, 20 bp, Artificial Sequence
  sgRNA
gtgaacacaagcagaatggg

SEQ ID NO: 19368 - DNA, 20 bp, Artificial Sequence
  sgRNA
ttcagcccaaatgcagcatg

SEQ ID NO: 19369 - DNA, 20 bp, Artificial Sequence
  sgRNA
ggaggattcgggagggatga

SEQ ID NO: 19370 - DNA, 20 bp, Artificial Sequence
  sgRNA
cgccgaatccgggttgaccg

SEQ ID NO: 19371 - DNA, 20 bp, Artificial Sequence
  sgRNA
gggtgcggaggtcctgtgcc

SEQ ID NO: 19372 - DNA, 20 bp, Artificial Sequence
  sgRNA
gggctttcactgcttcctgc

SEQ ID NO: 19373 - DNA, 20 bp, Artificial Sequence
  sgRNA
agcggcctgggccgcgcagg

SEQ ID NO: 19374 - DNA, 20 bp, Artificial Sequence
  sgRNA
cggcgctccgctcagctccg

SEQ ID NO: 19375 - DNA, 20 bp, Artificial Sequence
  sgRNA
tgagttactcaactattgag

SEQ ID NO: 19376 - DNA, 20 bp, Artificial Sequence
  sgRNA
gactggcctggtccgcaaag

SEQ ID NO: 19377 - DNA, 20 bp, Artificial Sequence
  sgRNA
gagactcgtaggcacgattg

SEQ ID NO: 19378 - DNA, 20 bp, Artificial Sequence
  sgRNA
gggagggagggagctggtgg

SEQ ID NO: 19379 - DNA, 20 bp, Artificial Sequence
  sgRNA
agcgcggagggagggaggaa

SEQ ID NO: 19380 - DNA, 20 bp, Artificial Sequence
  sgRNA
ggtggtggtggtggtggtgg

SEQ ID NO: 19381 - DNA, 20 bp, Artificial Sequence
  sgRNA
gccagccgtcggtgccgtgc

SEQ ID NO: 19382 - DNA, 20 bp, Artificial Sequence
  sgRNA
cctgtcacctagtgcagccc

SEQ ID NO: 19383 - DNA, 20 bp, Artificial Sequence
  sgRNA
ctcaagtgcacagtccatcc

SEQ ID NO: 19384 - DNA, 20 bp, Artificial Sequence
  sgRNA
cgatctccaccctgcagccc

SEQ ID NO: 19385 - DNA, 20 bp, Artificial Sequence
  sgRNA
ggtcatcctaggaccactgc

SEQ ID NO: 19386 - DNA, 20 bp, Artificial Sequence
  sgRNA
acaggctttgaacaattgcc

SEQ ID NO: 19387 - DNA, 20 bp, Artificial Sequence
  sgRNA
acttgtctaagctgccaaac

SEQ ID NO: 19388 - DNA, 20 bp, Artificial Sequence
  sgRNA
agtcctgccacaataccttc

SEQ ID NO: 19389 - DNA, 20 bp, Artificial Sequence
  sgRNA
ggcagaaggattaatctaat

SEQ ID NO: 19390 - DNA, 20 bp, Artificial Sequence
  sgRNA
cgtgaatgtttacataaccc

SEQ ID NO: 19391 - DNA, 20 bp, Artificial Sequence
  sgRNA
aaggttaagtaagacaggcc

SEQ ID NO: 19392 - DNA, 20 bp, Artificial Sequence
  sgRNA
cggcagtgcctttccttaat

SEQ ID NO: 19393 - DNA, 20 bp, Artificial Sequence
  sgRNA
agtttagagggtctgggtgc

SEQ ID NO: 19394 - DNA, 20 bp, Artificial Sequence
  sgRNA
aagggagtgtgcggagtcta

SEQ ID NO: 19395 - DNA, 20 bp, Artificial Sequence
  sgRNA
gctgacgctgctattagtct

SEQ ID NO: 19396 - DNA, 20 bp, Artificial Sequence
  sgRNA
tactggttgtttactttcaa

SEQ ID NO: 19397 - DNA, 20 bp, Artificial Sequence
  sgRNA
actgcaattattagattgag

SEQ ID NO: 19398 - DNA, 20 bp, Artificial Sequence
  sgRNA
ggaatgcaatgttaattctg

SEQ ID NO: 19399 - DNA, 20 bp, Artificial Sequence
  sgRNA
taactgtgcgcagtgttcaa

SEQ ID NO: 19400 - DNA, 20 bp, Artificial Sequence
  sgRNA
tcgtcctatgcctgagcggc

SEQ ID NO: 19401 - DNA, 20 bp, Artificial Sequence
  sgRNA
gttactagtgtgacaaaggc

SEQ ID NO: 19402 - DNA, 20 bp, Artificial Sequence
  sgRNA
gggaacctagccgggaaaga

SEQ ID NO: 19403 - DNA, 20 bp, Artificial Sequence
  sgRNA
gcgccagcatttggagcggg

SEQ ID NO: 19404 - DNA, 20 bp, Artificial Sequence
  sgRNA
cgcgaggcgcgctgtaggcg

SEQ ID NO: 19405 - DNA, 20 bp, Artificial Sequence
  sgRNA
gagtcttgaccaatcgacaa

SEQ ID NO: 19406 - DNA, 20 bp, Artificial Sequence
  sgRNA
cgtgttgcagccttgaggcg

SEQ ID NO: 19407 - DNA, 20 bp, Artificial Sequence
  sgRNA
ccaattgacgtggcgttact

SEQ ID NO: 19408 - DNA, 20 bp, Artificial Sequence
  sgRNA
actctggtgcacgtttagcc

SEQ ID NO: 19409 - DNA, 20 bp, Artificial Sequence
  sgRNA
ccacttagagacccaaagaa

SEQ ID NO: 19410 - DNA, 20 bp, Artificial Sequence
  sgRNA
tctgagacacatgcagtaag

SEQ ID NO: 19411 - DNA, 20 bp, Artificial Sequence
  sgRNA
cattgtgacgtcgcgcctgg

SEQ ID NO: 19412 - DNA, 20 bp, Artificial Sequence
  sgRNA
cacgggactcggactgcgac

SEQ ID NO: 19413 - DNA, 20 bp, Artificial Sequence
  sgRNA
gtggcggcttcgcctagcgt

SEQ ID NO: 19414 - DNA, 20 bp, Artificial Sequence
  sgRNA
gggtcttggattggttagag

SEQ ID NO: 19415 - DNA, 20 bp, Artificial Sequence
  sgRNA
aaggcaacagcttggcgcca

SEQ ID NO: 19416 - DNA, 20 bp, Artificial Sequence
  sgRNA
acaacagcagtctgattggc

SEQ ID NO: 19417 - DNA, 20 bp, Artificial Sequence
  sgRNA
cagcagccaagggaaggcag

SEQ ID NO: 19418 - DNA, 20 bp, Artificial Sequence
  sgRNA
gctaataaattgtcctgctc

SEQ ID NO: 19419 - DNA, 20 bp, Artificial Sequence
  sgRNA
aatctctgtaatgcacgatg

SEQ ID NO: 19420 - DNA, 20 bp, Artificial Sequence
  sgRNA
gtgaccggtgccctggcttc

SEQ ID NO: 19421 - DNA, 20 bp, Artificial Sequence
  sgRNA
gggctcagcagcgtcgggct

SEQ ID NO: 19422 - DNA, 20 bp, Artificial Sequence
  sgRNA
tttctgtaacaccacttgct

SEQ ID NO: 19423 - DNA, 20 bp, Artificial Sequence
  sgRNA
gggttcctcacgaagcccag

SEQ ID NO: 19424 - DNA, 20 bp, Artificial Sequence
  sgRNA
gggcgtaggagaggcgggtg

SEQ ID NO: 19425 - DNA, 20 bp, Artificial Sequence
  sgRNA
gtgtgcgaatgcctgtgtgg

SEQ ID NO: 19426 - DNA, 20 bp, Artificial Sequence
  sgRNA
gcggaggctccgataggcgg

SEQ ID NO: 19427 - DNA, 20 bp, Artificial Sequence
  sgRNA
cttgcttctccgtggcgccc

SEQ ID NO: 19428 - DNA, 20 bp, Artificial Sequence
  sgRNA
cgtcggccttcgcagcctat

SEQ ID NO: 19429 - DNA, 20 bp, Artificial Sequence
  sgRNA
atttgagaggcgtaacgttg

SEQ ID NO: 19430 - DNA, 20 bp, Artificial Sequence
  sgRNA
atcacccacaatttatgacc

SEQ ID NO: 19431 - DNA, 20 bp, Artificial Sequence
  sgRNA
gaatcggaaagcctgcccat

SEQ ID NO: 19432 - DNA, 20 bp, Artificial Sequence
  sgRNA
gacgagggctacggcaccgg

SEQ ID NO: 19433 - DNA, 20 bp, Artificial Sequence
  sgRNA
agtagcgtggtgtcgagcgg

SEQ ID NO: 19434 - DNA, 20 bp, Artificial Sequence
  sgRNA
gggagcagcgcgacctccgg

SEQ ID NO: 19435 - DNA, 20 bp, Artificial Sequence
  sgRNA
tcttccggctgtgggccgcg

SEQ ID NO: 19436 - DNA, 20 bp, Artificial Sequence
  sgRNA
gacgccgccagctgaaggcc

SEQ ID NO: 19437 - DNA, 20 bp, Artificial Sequence
  sgRNA
gagagagagagggtcgagtc

SEQ ID NO: 19438 - DNA, 20 bp, Artificial Sequence
  sgRNA
gaccggttattgttggcaac

SEQ ID NO: 19439 - DNA, 20 bp, Artificial Sequence
  sgRNA
gcctccagaaagcctcggag

SEQ ID NO: 19440 - DNA, 20 bp, Artificial Sequence
  sgRNA
ttgtgccgcgttcccacgcc

SEQ ID NO: 19441 - DNA, 20 bp, Artificial Sequence
  sgRNA
aggagcaggtaataagcagg

SEQ ID NO: 19442 - DNA, 20 bp, Artificial Sequence
  sgRNA
accatcctccatgcatatgg

SEQ ID NO: 19443 - DNA, 20 bp, Artificial Sequence
  sgRNA
ccggagctctggatgtagac

SEQ ID NO: 19444 - DNA, 20 bp, Artificial Sequence
  sgRNA
gacaccttcccaaacagcag

SEQ ID NO: 19445 - DNA, 20 bp, Artificial Sequence
  sgRNA
gctgaagagagctaggaccc

SEQ ID NO: 19446 - DNA, 20 bp, Artificial Sequence
  sgRNA
tcacatagcagtactgtaca

SEQ ID NO: 19447 - DNA, 20 bp, Artificial Sequence
  sgRNA
cgcgcctaccaggagctcac

SEQ ID NO: 19448 - DNA, 20 bp, Artificial Sequence
  sgRNA
gacggaagcaggaacctacc

SEQ ID NO: 19449 - DNA, 20 bp, Artificial Sequence
  sgRNA
cggccgtcgatttgtcaaat

SEQ ID NO: 19450 - DNA, 20 bp, Artificial Sequence
  sgRNA
cctatgtcataatgtagcca

SEQ ID NO: 19451 - DNA, 20 bp, Artificial Sequence
  sgRNA
ctgagccaacactattcatt

SEQ ID NO: 19452 - DNA, 20 bp, Artificial Sequence
  sgRNA
gaggcaatattcatgggctg

SEQ ID NO: 19453 - DNA, 20 bp, Artificial Sequence
  sgRNA
gcactagtaaatagttcaat

SEQ ID NO: 19454 - DNA, 20 bp, Artificial Sequence
  sgRNA
ttcagggtttagtaaactct

SEQ ID NO: 19455 - DNA, 20 bp, Artificial Sequence
  sgRNA
tgtaaactcttctacaggac

SEQ ID NO: 19456 - DNA, 20 bp, Artificial Sequence
  sgRNA
tcgagtgaccattgtggaaa

SEQ ID NO: 19457 - DNA, 20 bp, Artificial Sequence
  sgRNA
ctggcctttagcctgcgcag

SEQ ID NO: 19458 - DNA, 20 bp, Artificial Sequence
  sgRNA
ctcaaagggagtgacactat

SEQ ID NO: 19459 - DNA, 20 bp, Artificial Sequence
  sgRNA
ctgcgggacacctccttgtc

SEQ ID NO: 19460 - DNA, 20 bp, Artificial Sequence
  sgRNA
ttgacgtcaactccgtgcct

SEQ ID NO: 19461 - DNA, 20 bp, Artificial Sequence
  sgRNA
cgtggtgagggcccaaagcg

SEQ ID NO: 19462 - DNA, 20 bp, Artificial Sequence
  sgRNA
cattgtcaggattcctccca

SEQ ID NO: 19463 - DNA, 20 bp, Artificial Sequence
  sgRNA
ctgtgcaacaacacacagca

SEQ ID NO: 19464 - DNA, 20 bp, Artificial Sequence
  sgRNA
aacaagcctctactctaagt

SEQ ID NO: 19465 - DNA, 20 bp, Artificial Sequence
  sgRNA
gcggctgctctatgcgaccg

SEQ ID NO: 19466 - DNA, 20 bp, Artificial Sequence
  sgRNA
tgtccctgggatggtagagc

SEQ ID NO: 19467 - DNA, 20 bp, Artificial Sequence
  sgRNA
tgattcgctgtcgcgctctg

SEQ ID NO: 19468 - DNA, 20 bp, Artificial Sequence
  sgRNA
gcacagaattccatccagaa

SEQ ID NO: 19469 - DNA, 20 bp, Artificial Sequence
  sgRNA
aaatcatttcagtgtgtcct

SEQ ID NO: 19470 - DNA, 20 bp, Artificial Sequence
  sgRNA
ctgctctgtttgcttacttc

SEQ ID NO: 19471 - DNA, 20 bp, Artificial Sequence
  sgRNA
gaaacactggtcccagcttt

SEQ ID NO: 19472 - DNA, 20 bp, Artificial Sequence
  sgRNA
taccttgacacaggataaca

SEQ ID NO: 19473 - DNA, 20 bp, Artificial Sequence
  sgRNA
gacaagctttctggagtcta

SEQ ID NO: 19474 - DNA, 20 bp, Artificial Sequence
  sgRNA
tactttcagagctggagtgg

SEQ ID NO: 19475 - DNA, 20 bp, Artificial Sequence
  sgRNA
cacagagtgggtgctagcag

SEQ ID NO: 19476 - DNA, 20 bp, Artificial Sequence
  sgRNA
tagttagctctccaatctgg

SEQ ID NO: 19477 - DNA, 20 bp, Artificial Sequence
  sgRNA
attaacttggtctgcccgat

SEQ ID NO: 19478 - DNA, 20 bp, Artificial Sequence
  sgRNA
gctctgcctgttctcagagc

SEQ ID NO: 19479 - DNA, 20 bp, Artificial Sequence
  sgRNA
accagcagagtcttctggag

SEQ ID NO: 19480 - DNA, 20 bp, Artificial Sequence
  sgRNA
gtgttccgggataggcatcc

SEQ ID NO: 19481 - DNA, 20 bp, Artificial Sequence
  sgRNA
gttaacccgaagttaactgg

SEQ ID NO: 19482 - DNA, 20 bp, Artificial Sequence
  sgRNA
ctgggcaagtatctttagcc

SEQ ID NO: 19483 - DNA, 20 bp, Artificial Sequence
  sgRNA
ttcagggtttgagcttgacc

SEQ ID NO: 19484 - DNA, 20 bp, Artificial Sequence
  sgRNA
agcatcataacaacagagtc

SEQ ID NO: 19485 - DNA, 20 bp, Artificial Sequence
  sgRNA
ggacatgctaacagtgtttg

SEQ ID NO: 19486 - DNA, 20 bp, Artificial Sequence
  sgRNA
gctgctgagtgctagggctg

SEQ ID NO: 19487 - DNA, 20 bp, Artificial Sequence
  sgRNA
gcctgaatcacccagtcttg

SEQ ID NO: 19488 - DNA, 20 bp, Artificial Sequence
  sgRNA
tatcccatggccttggatgg

SEQ ID NO: 19489 - DNA, 20 bp, Artificial Sequence
  sgRNA
cagatgtgaggccacaagcc

SEQ ID NO: 19490 - DNA, 20 bp, Artificial Sequence
  sgRNA
ggtgggagagcaagcggcaa

SEQ ID NO: 19491 - DNA, 20 bp, Artificial Sequence
  sgRNA
cattactaaatggttctcgc

SEQ ID NO: 19492 - DNA, 20 bp, Artificial Sequence
  sgRNA
tggaggcgttccttgtttga

SEQ ID NO: 19493 - DNA, 20 bp, Artificial Sequence
  sgRNA
gacgcttgggaacctgcagg

SEQ ID NO: 19494 - DNA, 20 bp, Artificial Sequence
  sgRNA
gggactgaataacacagaag

SEQ ID NO: 19495 - DNA, 20 bp, Artificial Sequence
  sgRNA
aaacaaacatttctgtgtgc

SEQ ID NO: 19496 - DNA, 20 bp, Artificial Sequence
  sgRNA
ttacatttctctgatgtgca

SEQ ID NO: 19497 - DNA, 20 bp, Artificial Sequence
  sgRNA
aagacaggcaaacaacagcc

SEQ ID NO: 19498 - DNA, 20 bp, Artificial Sequence
  sgRNA
gtggatttgggacgaactgc

SEQ ID NO: 19499 - DNA, 20 bp, Artificial Sequence
  sgRNA
tttcacgagttactgctaaa

SEQ ID NO: 19500 - DNA, 20 bp, Artificial Sequence
  sgRNA
ttgcgcagccaatgaaacgg

SEQ ID NO: 19501 - DNA, 20 bp, Artificial Sequence
  sgRNA
gtacccatcaggcgcgaccc

SEQ ID NO: 19502 - DNA, 20 bp, Artificial Sequence
  sgRNA
cggattcagtaggaacgaac

SEQ ID NO: 19503 - DNA, 20 bp, Artificial Sequence
  sgRNA
agggtgggcctgtgactgtg

SEQ ID NO: 19504 - DNA, 20 bp, Artificial Sequence
  sgRNA
gattagcggctaagtttact

SEQ ID NO: 19505 - DNA, 20 bp, Artificial Sequence
  sgRNA
gggcagatgctggattcata

SEQ ID NO: 19506 - DNA, 20 bp, Artificial Sequence
  sgRNA
gacattggaacaagaactac

SEQ ID NO: 19507 - DNA, 20 bp, Artificial Sequence
  sgRNA
ttaggcccagaccggaaatg

SEQ ID NO: 19508 - DNA, 20 bp, Artificial Sequence
  sgRNA
gggctgaagtggtaagggag

SEQ ID NO: 19509 - DNA, 20 bp, Artificial Sequence
  sgRNA
gcgcgcccacttccgctcca

SEQ ID NO: 19510 - DNA, 20 bp, Artificial Sequence
  sgRNA
gtttaaacaggagacgctct

SEQ ID NO: 19511 - DNA, 20 bp, Artificial Sequence
  sgRNA
ccttcccggtcagaggcgag

SEQ ID NO: 19512 - DNA, 20 bp, Artificial Sequence
  sgRNA
ggatttaagcgttccgcctg

SEQ ID NO: 19513 - DNA, 20 bp, Artificial Sequence
  sgRNA
tgaatgtgaaatacccacac

SEQ ID NO: 19514 - DNA, 20 bp, Artificial Sequence
  sgRNA
ctgtgtctgggcctacactg

SEQ ID NO: 19515 - DNA, 20 bp, Artificial Sequence
  sgRNA
cagctcatggtttgagaatt

SEQ ID NO: 19516 - DNA, 20 bp, Artificial Sequence
  sgRNA
gcatgctgggtagaggtgaa

SEQ ID NO: 19517 - DNA, 20 bp, Artificial Sequence
  sgRNA
gctgggagtgatgagtttgt

SEQ ID NO: 19518 - DNA, 20 bp, Artificial Sequence
  sgRNA
gcgtcctgtgctggagactc

SEQ ID NO: 19519 - DNA, 20 bp, Artificial Sequence
  sgRNA
cagcccaggatgaacctgaa

SEQ ID NO: 19520 - DNA, 20 bp, Artificial Sequence
  sgRNA
tggctttggtctcaagtcga

SEQ ID NO: 19521 - DNA, 20 bp, Artificial Sequence
  sgRNA
gctaatccctagcgtctctg

SEQ ID NO: 19522 - DNA, 20 bp, Artificial Sequence
  sgRNA
ccggtctccattctgccgtg

SEQ ID NO: 19523 - DNA, 20 bp, Artificial Sequence
  sgRNA
ggacctccatgctggaggcg

SEQ ID NO: 19524 - DNA, 20 bp, Artificial Sequence
  sgRNA
gggccatgtcctgagcttgg

SEQ ID NO: 19525 - DNA, 20 bp, Artificial Sequence
  sgRNA
cgcaacgtgctactgatagt

SEQ ID NO: 19526 - DNA, 20 bp, Artificial Sequence
  sgRNA
ccggaaccgcttaccctgac

SEQ ID NO: 19527 - DNA, 20 bp, Artificial Sequence
  sgRNA
attgtgcagcaggccagtcc

SEQ ID NO: 19528 - DNA, 20 bp, Artificial Sequence
  sgRNA
actcacgcgcaatgtggcaa

SEQ ID NO: 19529 - DNA, 20 bp, Artificial Sequence
  sgRNA
acccgctgctgccgctcaca

SEQ ID NO: 19530 - DNA, 20 bp, Artificial Sequence
  sgRNA
aggcgcagggtctgagtccc

SEQ ID NO: 19531 - DNA, 20 bp, Artificial Sequence
  sgRNA
ccatgacctcgaaagctcaa

SEQ ID NO: 19532 - DNA, 20 bp, Artificial Sequence
  sgRNA
ggcaaacactccctagaagc

SEQ ID NO: 19533 - DNA, 20 bp, Artificial Sequence
  sgRNA
ccaagggagagtctcagcac

SEQ ID NO: 19534 - DNA, 20 bp, Artificial Sequence
  sgRNA
tgaagaagaatccaagcttg

SEQ ID NO: 19535 - DNA, 20 bp, Artificial Sequence
  sgRNA
cacagagccctattcatgcc

SEQ ID NO: 19536 - DNA, 20 bp, Artificial Sequence
  sgRNA
aacatggtctgccaagggcc

SEQ ID NO: 19537 - DNA, 20 bp, Artificial Sequence
  sgRNA
gaagtgctcaagggtcccgg

SEQ ID NO: 19538 - DNA, 20 bp, Artificial Sequence
  sgRNA
ttgatccgtggaagtgaatc

SEQ ID NO: 19539 - DNA, 20 bp, Artificial Sequence
  sgRNA
gggttcttgtcggtcatccg

SEQ ID NO: 19540 - DNA, 20 bp, Artificial Sequence
  sgRNA
ttgtgcttggtggcgagagg

SEQ ID NO: 19541 - DNA, 20 bp, Artificial Sequence
  sgRNA
gagagcaatcccagcaggga

SEQ ID NO: 19542 - DNA, 20 bp, Artificial Sequence
  sgRNA
aaatttgcgatctttacaga

SEQ ID NO: 19543 - DNA, 20 bp, Artificial Sequence
  sgRNA
ggaaccgccctcggcacgca

SEQ ID NO: 19544 - DNA, 20 bp, Artificial Sequence
  sgRNA
ctacgtaggcgtcggatccc

SEQ ID NO: 19545 - DNA, 20 bp, Artificial Sequence
  sgRNA
cgcatgctcgcggctaccct

SEQ ID NO: 19546 - DNA, 20 bp, Artificial Sequence
  sgRNA
ggctgcggcgtgaggtaagg

SEQ ID NO: 19547 - DNA, 20 bp, Artificial Sequence
  sgRNA
tcaggagtcaaggtctcgcg

SEQ ID NO: 19548 - DNA, 20 bp, Artificial Sequence
  sgRNA
aggttgaattcggtaaggat

SEQ ID NO: 19549 - DNA, 20 bp, Artificial Sequence
  sgRNA
gggtggccaacgtgtggtct

SEQ ID NO: 19550 - DNA, 20 bp, Artificial Sequence
  sgRNA
ggaccttcattgggacatga

SEQ ID NO: 19551 - DNA, 20 bp, Artificial Sequence
  sgRNA
tgaagagagataaagatcca

SEQ ID NO: 19552 - DNA, 20 bp, Artificial Sequence
  sgRNA
tctatggtgccttgtttgcc

SEQ ID NO: 19553 - DNA, 20 bp, Artificial Sequence
  sgRNA
atcctcatccttccgaacat

SEQ ID NO: 19554 - DNA, 20 bp, Artificial Sequence
  sgRNA
tctttgcgggagatttattg

SEQ ID NO: 19555 - DNA, 20 bp, Artificial Sequence
  sgRNA
tgaaagacaagttacagcca

SEQ ID NO: 19556 - DNA, 20 bp, Artificial Sequence
  sgRNA
cactcccaaagcgctttgtc

SEQ ID NO: 19557 - DNA, 20 bp, Artificial Sequence
  sgRNA
gcccgcagactccttatttg

SEQ ID NO: 19558 - DNA, 20 bp, Artificial Sequence
  sgRNA
aatccgatcgggctgggacc

SEQ ID NO: 19559 - DNA, 20 bp, Artificial Sequence
  sgRNA
cgcatgcgcagtctagtcgc

SEQ ID NO: 19560 - DNA, 20 bp, Artificial Sequence
  sgRNA
ccagggcttgcgctccaaac

SEQ ID NO: 19561 - DNA, 20 bp, Artificial Sequence
  sgRNA
cgcctgcacccgaagccgag

SEQ ID NO: 19562 - DNA, 20 bp, Artificial Sequence
  sgRNA
tgggacttgttaacagcgct

SEQ ID NO: 19563 - DNA, 20 bp, Artificial Sequence
  sgRNA
ttcacccatccgggaaactg

SEQ ID NO: 19564 - DNA, 20 bp, Artificial Sequence
  sgRNA
acccagagggcctgagggcg

SEQ ID NO: 19565 - DNA, 20 bp, Artificial Sequence
  sgRNA
cctaaaggataatgtaagaa

SEQ ID NO: 19566 - DNA, 20 bp, Artificial Sequence
  sgRNA
aggctgtgttgcaatcgctg

SEQ ID NO: 19567 - DNA, 20 bp, Artificial Sequence
  sgRNA
gggctacaggttagggcgac

SEQ ID NO: 19568 - DNA, 20 bp, Artificial Sequence
  sgRNA
cagagtagttgtcccgggcc

SEQ ID NO: 19569 - DNA, 20 bp, Artificial Sequence
  sgRNA
ggtggtgcaacttccgtccc

SEQ ID NO: 19570 - DNA, 20 bp, Artificial Sequence
  sgRNA
agaagatgggctctgctgca

SEQ ID NO: 19571 - DNA, 20 bp, Artificial Sequence
  sgRNA
cacccggcctgcaatacgga

SEQ ID NO: 19572 - DNA, 20 bp, Artificial Sequence
  sgRNA
tggtggaacatggaatgctg

SEQ ID NO: 19573 - DNA, 20 bp, Artificial Sequence
  sgRNA
tatccttcccatttgattcc

SEQ ID NO: 19574 - DNA, 20 bp, Artificial Sequence
  sgRNA
actcaagctagttaaggctt

SEQ ID NO: 19575 - DNA, 20 bp, Artificial Sequence
  sgRNA
cattacatcatctcttggcc

SEQ ID NO: 19576 - DNA, 20 bp, Artificial Sequence
  sgRNA
gagcattagcttatttagag

SEQ ID NO: 19577 - DNA, 20 bp, Artificial Sequence
  sgRNA
gggaagtctgacccgaaggc

SEQ ID NO: 19578 - DNA, 20 bp, Artificial Sequence
  sgRNA
agacgaactcacagggaatg

SEQ ID NO: 19579 - DNA, 20 bp, Artificial Sequence
  sgRNA
tttaatcaagcagaacaggg

SEQ ID NO: 19580 - DNA, 20 bp, Artificial Sequence
  sgRNA
acagggagagaaagcgaatc

SEQ ID NO: 19581 - DNA, 20 bp, Artificial Sequence
  sgRNA
gagggattaagggctgcagc

SEQ ID NO: 19582 - DNA, 20 bp, Artificial Sequence
  sgRNA
ggaccctcaggcagttcctc

SEQ ID NO: 19583 - DNA, 20 bp, Artificial Sequence
  sgRNA
agtccacttccggtgcgttc

SEQ ID NO: 19584 - DNA, 20 bp, Artificial Sequence
  sgRNA
tctaaaggatttctccgctg

SEQ ID NO: 19585 - DNA, 20 bp, Artificial Sequence
  sgRNA
gaattacgaaggtctcggcg

SEQ ID NO: 19586 - DNA, 20 bp, Artificial Sequence
  sgRNA
cgagatctcatgtttcctaa

SEQ ID NO: 19587 - DNA, 20 bp, Artificial Sequence
  sgRNA
ggaggaagctctcgtccttt

SEQ ID NO: 19588 - DNA, 20 bp, Artificial Sequence
  sgRNA
tcccaccgggcagccaacca

SEQ ID NO: 19589 - DNA, 20 bp, Artificial Sequence
  sgRNA
gctcgttccttctctcctat

SEQ ID NO: 19590 - DNA, 20 bp, Artificial Sequence
  sgRNA
aaagaattgagggagggaga

SEQ ID NO: 19591 - DNA, 20 bp, Artificial Sequence
  sgRNA
cacgcgcgggcgtcccatcc

SEQ ID NO: 19592 - DNA, 20 bp, Artificial Sequence
  sgRNA
tgggtgcaggatcacgacag

SEQ ID NO: 19593 - DNA, 20 bp, Artificial Sequence
  sgRNA
cgtgacgtgccctaacagcc

SEQ ID NO: 19594 - DNA, 20 bp, Artificial Sequence
  sgRNA
gtaaccgtacatggtgggtg

SEQ ID NO: 19595 - DNA, 20 bp, Artificial Sequence
  sgRNA
aacttagctcaagcagcact

SEQ ID NO: 19596 - DNA, 20 bp, Artificial Sequence
  sgRNA
ttgtgctccttgccctctat

SEQ ID NO: 19597 - DNA, 20 bp, Artificial Sequence
  sgRNA
cgcgcgcggaacatggctga

SEQ ID NO: 19598 - DNA, 20 bp, Artificial Sequence
  sgRNA
ggttctgcggtaggactccc

SEQ ID NO: 19599 - DNA, 20 bp, Artificial Sequence
  sgRNA
gccggcgaggaacccgcgct

SEQ ID NO: 19600 - DNA, 20 bp, Artificial Sequence
  sgRNA
ttgagtaggtgtagccttgt

SEQ ID NO: 19601 - DNA, 20 bp, Artificial Sequence
  sgRNA
ccctctataccaggttgtga

SEQ ID NO: 19602 - DNA, 20 bp, Artificial Sequence
  sgRNA
aggtatgtcagtgtggatgt

SEQ ID NO: 19603 - DNA, 20 bp, Artificial Sequence
  sgRNA
ctcctttctggccgttacca

SEQ ID NO: 19604 - DNA, 20 bp, Artificial Sequence
  sgRNA
cgagagtctgcgattctggc

SEQ ID NO: 19605 - DNA, 20 bp, Artificial Sequence
  sgRNA
cagaagccagaacccgtgtc

SEQ ID NO: 19606 - DNA, 20 bp, Artificial Sequence
  sgRNA
agagccaaagggttaggaac

SEQ ID NO: 19607 - DNA, 20 bp, Artificial Sequence
  sgRNA
gaagagtcacgtttcggaga

SEQ ID NO: 19608 - DNA, 20 bp, Artificial Sequence
  sgRNA
gcggtccctcaatgacgcac

SEQ ID NO: 19609 - DNA, 20 bp, Artificial Sequence
  sgRNA
gattacaggcataccacgac

SEQ ID NO: 19610 - DNA, 20 bp, Artificial Sequence
  sgRNA
aggccagcgtcctgggtgtc

SEQ ID NO: 19611 - DNA, 20 bp, Artificial Sequence
  sgRNA
actcctgtacacttcccgac

SEQ ID NO: 19612 - DNA, 20 bp, Artificial Sequence
  sgRNA
gcgcagctgcttgaggaggg

SEQ ID NO: 19613 - DNA, 20 bp, Artificial Sequence
  sgRNA
tgagcgggaggcggagccgg

SEQ ID NO: 19614 - DNA, 20 bp, Artificial Sequence
  sgRNA
ggaagtaagcggccgtggcg

SEQ ID NO: 19615 - DNA, 20 bp, Artificial Sequence
  sgRNA
taagccctcattgatcaggg

SEQ ID NO: 19616 - DNA, 20 bp, Artificial Sequence
  sgRNA
ttaaatgatctctgaggtct

SEQ ID NO: 19617 - DNA, 20 bp, Artificial Sequence
  sgRNA
gcctttgtcacatgtagggc

SEQ ID NO: 19618 - DNA, 20 bp, Artificial Sequence
  sgRNA
ggatgcctgcatgaacctgc

SEQ ID NO: 19619 - DNA, 20 bp, Artificial Sequence
  sgRNA
atgagacgcgtgcagttgcg

SEQ ID NO: 19620 - DNA, 20 bp, Artificial Sequence
  sgRNA
cgcgccgggaagcacagcgc

SEQ ID NO: 19621 - DNA, 20 bp, Artificial Sequence
  sgRNA
gctcctctgttagtgtgttg

SEQ ID NO: 19622 - DNA, 20 bp, Artificial Sequence
  sgRNA
caaacgtggccgcctgaggg

SEQ ID NO: 19623 - DNA, 20 bp, Artificial Sequence
  sgRNA
ggttcgggcaccgaccgagc

SEQ ID NO: 19624 - DNA, 20 bp, Artificial Sequence
  sgRNA
acccagcgttatggaggctc

SEQ ID NO: 19625 - DNA, 20 bp, Artificial Sequence
  sgRNA
ccatcttagatggcgcgaga

SEQ ID NO: 19626 - DNA, 20 bp, Artificial Sequence
  sgRNA
cggtcccgcctgccagctac

SEQ ID NO: 19627 - DNA, 20 bp, Artificial Sequence
  sgRNA
agtttccggcaacaggaacg

SEQ ID NO: 19628 - DNA, 20 bp, Artificial Sequence
  sgRNA
actatggctgctgggaccca

SEQ ID NO: 19629 - DNA, 20 bp, Artificial Sequence
  sgRNA
gtcttcaggttctatggacc

SEQ ID NO: 19630 - DNA, 20 bp, Artificial Sequence
  sgRNA
tgggttctgagacacgccca

SEQ ID NO: 19631 - DNA, 20 bp, Artificial Sequence
  sgRNA
cagtggcgacgggcacaaga

SEQ ID NO: 19632 - DNA, 20 bp, Artificial Sequence
  sgRNA
tgtggtggagcccgatctcc

SEQ ID NO: 19633 - DNA, 20 bp, Artificial Sequence
  sgRNA
gggcattgtcctgagtggga

SEQ ID NO: 19634 - DNA, 20 bp, Artificial Sequence
  sgRNA
attgacgggctctttctccg

SEQ ID NO: 19635 - DNA, 20 bp, Artificial Sequence
  sgRNA
tttcagccgggaagagaacg

SEQ ID NO: 19636 - DNA, 20 bp, Artificial Sequence
  sgRNA
caggcgcaatccgtatgagc

SEQ ID NO: 19637 - DNA, 20 bp, Artificial Sequence
  sgRNA
ctggctgggcagatcttccc

SEQ ID NO: 19638 - DNA, 20 bp, Artificial Sequence
  sgRNA
cggcgaccgggatcgaccgt

SEQ ID NO: 19639 - DNA, 20 bp, Artificial Sequence
  sgRNA
gagcaggcgcactcgcgcca

SEQ ID NO: 19640 - DNA, 20 bp, Artificial Sequence
  sgRNA
cgccgtgcggagtccttcct

SEQ ID NO: 19641 - DNA, 20 bp, Artificial Sequence
  sgRNA
ggaggtcctgggtaggacag

SEQ ID NO: 19642 - DNA, 20 bp, Artificial Sequence
  sgRNA
ggcctggtgcgcaggccctt

SEQ ID NO: 19643 - DNA, 20 bp, Artificial Sequence
  sgRNA
ggcaagcgctggcagccgag

SEQ ID NO: 19644 - DNA, 20 bp, Artificial Sequence
  sgRNA
gaagggcaggccggtggccg

SEQ ID NO: 19645 - DNA, 20 bp, Artificial Sequence
  sgRNA
gacctctgggccaacgttcc

SEQ ID NO: 19646 - DNA, 20 bp, Artificial Sequence
  sgRNA
gggcccggcagaaacctggg

SEQ ID NO: 19647 - DNA, 20 bp, Artificial Sequence
  sgRNA
gttgttgttgtggtgcgcgc

SEQ ID NO: 19648 - DNA, 20 bp, Artificial Sequence
  sgRNA
attatattgtatgggattgg

SEQ ID NO: 19649 - DNA, 20 bp, Artificial Sequence
  sgRNA
ggtccaggtcttgctaagag

SEQ ID NO: 19650 - DNA, 20 bp, Artificial Sequence
  sgRNA
aggaggactgcaaatgcggg

SEQ ID NO: 19651 - DNA, 20 bp, Artificial Sequence
  sgRNA
tccaggctcgggatctgcct

SEQ ID NO: 19652 - DNA, 20 bp, Artificial Sequence
  sgRNA
gatccaccttggctaagggc

SEQ ID NO: 19653 - DNA, 20 bp, Artificial Sequence
  sgRNA
tcgggcggcggaagtggatt

SEQ ID NO: 19654 - DNA, 20 bp, Artificial Sequence
  sgRNA
cgcgcggcagattcgaagct

SEQ ID NO: 19655 - DNA, 20 bp, Artificial Sequence
  sgRNA
aaagaggtactgaagttcat

SEQ ID NO: 19656 - DNA, 20 bp, Artificial Sequence
  sgRNA
gaagacacactcctgcagag

SEQ ID NO: 19657 - DNA, 20 bp, Artificial Sequence
  sgRNA
tttgctttgttgacaaggag

SEQ ID NO: 19658 - DNA, 20 bp, Artificial Sequence
  sgRNA
ttcttgcatttgaccaatcc

SEQ ID NO: 19659 - DNA, 20 bp, Artificial Sequence
  sgRNA
aaactaagccactctcacag

SEQ ID NO: 19660 - DNA, 20 bp, Artificial Sequence
  sgRNA
atgcaagcagttagttgcac

SEQ ID NO: 19661 - DNA, 20 bp, Artificial Sequence
  sgRNA
cgcgtagaaagacgtcttcc

SEQ ID NO: 19662 - DNA, 20 bp, Artificial Sequence
  sgRNA
ccgctgacaattcttaactt

SEQ ID NO: 19663 - DNA, 20 bp, Artificial Sequence
  sgRNA
gagggtaacgaagactgggc

SEQ ID NO: 19664 - DNA, 20 bp, Artificial Sequence
  sgRNA
ggactcgggaactgtgaacc

SEQ ID NO: 19665 - DNA, 20 bp, Artificial Sequence
  sgRNA
tctgagggcgggacccatgc

SEQ ID NO: 19666 - DNA, 20 bp, Artificial Sequence
  sgRNA
gggacggagctcggatggtg

SEQ ID NO: 19667 - DNA, 20 bp, Artificial Sequence
  sgRNA
tgtgcccttacatcatcgac

SEQ ID NO: 19668 - DNA, 20 bp, Artificial Sequence
  sgRNA
ccctcgcagcacgggattgt

SEQ ID NO: 19669 - DNA, 20 bp, Artificial Sequence
  sgRNA
cggaacgacctttgcgggcc

SEQ ID NO: 19670 - DNA, 20 bp, Artificial Sequence
  sgRNA
gcgggaatcgatagccaatc

SEQ ID NO: 19671 - DNA, 20 bp, Artificial Sequence
  sgRNA
agagcgagggttctcctact

SEQ ID NO: 19672 - DNA, 20 bp, Artificial Sequence
  sgRNA
ggaagagaggaggcgctaga

SEQ ID NO: 19673 - DNA, 20 bp, Artificial Sequence
  sgRNA
gcgaagttgaagggtggtcg

SEQ ID NO: 19674 - DNA, 20 bp, Artificial Sequence
  sgRNA
tgagaccctaggacgtgctc

SEQ ID NO: 19675 - DNA, 20 bp, Artificial Sequence
  sgRNA
gggtgcacgcgctctcgctg

SEQ ID NO: 19676 - DNA, 20 bp, Artificial Sequence
  sgRNA
tcgagcggagcgtccgatcc

SEQ ID NO: 19677 - DNA, 20 bp, Artificial Sequence
  sgRNA
aggaaacgcgaagcgccctg

SEQ ID NO: 19678 - DNA, 20 bp, Artificial Sequence
  sgRNA
ggtggtgtctaggtcgctaa

SEQ ID NO: 19679 - DNA, 20 bp, Artificial Sequence
  sgRNA
tgagagacggcttcagccaa

SEQ ID NO: 19680 - DNA, 20 bp, Artificial Sequence
  sgRNA
tgcgcccgcccaatagcgca

SEQ ID NO: 19681 - DNA, 20 bp, Artificial Sequence
  sgRNA
tgagcgggtgagtctcaaga

SEQ ID NO: 19682 - DNA, 20 bp, Artificial Sequence
  sgRNA
aaacaaggcggccgacgagg

SEQ ID NO: 19683 - DNA, 20 bp, Artificial Sequence
  sgRNA
acagaggcgggcggcgttgc

SEQ ID NO: 19684 - DNA, 20 bp, Artificial Sequence
  sgRNA
gggcgagtcgcccgccggct

SEQ ID NO: 19685 - DNA, 20 bp, Artificial Sequence
  sgRNA
gactacaggcagcagtgtat

SEQ ID NO: 19686 - DNA, 20 bp, Artificial Sequence
  sgRNA
cgaggccgctttctttgctg

SEQ ID NO: 19687 - DNA, 20 bp, Artificial Sequence
  sgRNA
caagccacacttcccacata

SEQ ID NO: 19688 - DNA, 20 bp, Artificial Sequence
  sgRNA
aaggctgcgcggccgcgtgg

SEQ ID NO: 19689 - DNA, 20 bp, Artificial Sequence
  sgRNA
tataagggcggccgtcgccg

SEQ ID NO: 19690 - DNA, 20 bp, Artificial Sequence
  sgRNA
ccgcgcgccgcccggagccg

SEQ ID NO: 19691 - DNA, 20 bp, Artificial Sequence
  sgRNA
tgcgacgcccgaggtcacag

SEQ ID NO: 19692 - DNA, 20 bp, Artificial Sequence
  sgRNA
gagggcgcggccggtcgacg

SEQ ID NO: 19693 - DNA, 20 bp, Artificial Sequence
  sgRNA
ccctccgcagagggacagag

SEQ ID NO: 19694 - DNA, 20 bp, Artificial Sequence
  sgRNA
ttgtgaccacaacaggcggt

SEQ ID NO: 19695 - DNA, 20 bp, Artificial Sequence
  sgRNA
tatacccaactataggcatg

SEQ ID NO: 19696 - DNA, 20 bp, Artificial Sequence
  sgRNA
tgaaatgaagagtgagttct

SEQ ID NO: 19697 - DNA, 20 bp, Artificial Sequence
  sgRNA
ggtcgacgccatcttgaatg

SEQ ID NO: 19698 - DNA, 20 bp, Artificial Sequence
  sgRNA
gggtctttcctcgtagccag

SEQ ID NO: 19699 - DNA, 20 bp, Artificial Sequence
  sgRNA
ctggaagagccgctcacctg

SEQ ID NO: 19700 - DNA, 20 bp, Artificial Sequence
  sgRNA
cccagtaggctgtggcccag

SEQ ID NO: 19701 - DNA, 20 bp, Artificial Sequence
  sgRNA
aaggaaccagattagtgtgc

SEQ ID NO: 19702 - DNA, 20 bp, Artificial Sequence
  sgRNA
ttgtagtttgcatgtgtccg

SEQ ID NO: 19703 - DNA, 20 bp, Artificial Sequence
  sgRNA
acgtttatggcggtgttgct

SEQ ID NO: 19704 - DNA, 20 bp, Artificial Sequence
  sgRNA
cactggaccagagttgggcg

SEQ ID NO: 19705 - DNA, 20 bp, Artificial Sequence
  sgRNA
tttgggctcatgaaaggttt

SEQ ID NO: 19706 - DNA, 20 bp, Artificial Sequence
  sgRNA
aactaagagatctctaatct

SEQ ID NO: 19707 - DNA, 20 bp, Artificial Sequence
  sgRNA
cagtattggtttctgtggcc

SEQ ID NO: 19708 - DNA, 20 bp, Artificial Sequence
  sgRNA
gcacagccaatggagagacc

SEQ ID NO: 19709 - DNA, 20 bp, Artificial Sequence
  sgRNA
gtcaacagcgagcgagcagc

SEQ ID NO: 19710 - DNA, 20 bp, Artificial Sequence
  sgRNA
cagctaggctcgctcgctca

SEQ ID NO: 19711 - DNA, 20 bp, Artificial Sequence
  sgRNA
tggaatgagaatgagtatga

SEQ ID NO: 19712 - DNA, 20 bp, Artificial Sequence
  sgRNA
ggattagccctacccaatgc

SEQ ID NO: 19713 - DNA, 20 bp, Artificial Sequence
  sgRNA
ctagcactaggatgtggctt

SEQ ID NO: 19714 - DNA, 20 bp, Artificial Sequence
  sgRNA
taatctgtgggcctgagggt

SEQ ID NO: 19715 - DNA, 20 bp, Artificial Sequence
  sgRNA
ttccaccaagagcgtgcgtc

SEQ ID NO: 19716 - DNA, 20 bp, Artificial Sequence
  sgRNA
acatctaccacagcgtagag

SEQ ID NO: 19717 - DNA, 20 bp, Artificial Sequence
  sgRNA
tcgtagtctttctggcttgc

SEQ ID NO: 19718 - DNA, 20 bp, Artificial Sequence
  sgRNA
gcctcggagtgtggcgtata

SEQ ID NO: 19719 - DNA, 20 bp, Artificial Sequence
  sgRNA
gccgcagctcaatcacagcg

SEQ ID NO: 19720 - DNA, 20 bp, Artificial Sequence
  sgRNA
atgacagtttctggtttcgc

SEQ ID NO: 19721 - DNA, 20 bp, Artificial Sequence
  sgRNA
gtgtgggatgaaatcagttc

SEQ ID NO: 19722 - DNA, 20 bp, Artificial Sequence
  sgRNA
gaccatccctttctatatag

SEQ ID NO: 19723 - DNA, 20 bp, Artificial Sequence
  sgRNA
gaactgcgagcacaccaccc

SEQ ID NO: 19724 - DNA, 20 bp, Artificial Sequence
  sgRNA
tgcgcggttgctaagcgacg

SEQ ID NO: 19725 - DNA, 20 bp, Artificial Sequence
  sgRNA
cggtccgcagggagaccacg

SEQ ID NO: 19726 - DNA, 20 bp, Artificial Sequence
  sgRNA
cacgtcgctcagggcttaga

SEQ ID NO: 19727 - DNA, 20 bp, Artificial Sequence
  sgRNA
cgcccaccgaaactccacag

SEQ ID NO: 19728 - DNA, 20 bp, Artificial Sequence
  sgRNA
gcaagtcacagagcacaaca

SEQ ID NO: 19729 - DNA, 20 bp, Artificial Sequence
  sgRNA
tctgtccatttccggttgcc

SEQ ID NO: 19730 - DNA, 20 bp, Artificial Sequence
  sgRNA
gttggtatttaaggctgggc

SEQ ID NO: 19731 - DNA, 20 bp, Artificial Sequence
  sgRNA
cgcgtgcgcgggagcccacg

SEQ ID NO: 19732 - DNA, 20 bp, Artificial Sequence
  sgRNA
tagccgggaacaggcacaga

SEQ ID NO: 19733 - DNA, 20 bp, Artificial Sequence
  sgRNA
ggaagaaaggaattcggctg

SEQ ID NO: 19734 - DNA, 20 bp, Artificial Sequence
  sgRNA
ggacgcggcgcgagtgccac

SEQ ID NO: 19735 - DNA, 20 bp, Artificial Sequence
  sgRNA
acaggcatccgggaacttgg

SEQ ID NO: 19736 - DNA, 20 bp, Artificial Sequence
  sgRNA
taacggccggcctgagtccc

SEQ ID NO: 19737 - DNA, 20 bp, Artificial Sequence
  sgRNA
aacatggattccgttgtaga

SEQ ID NO: 19738 - DNA, 20 bp, Artificial Sequence
  sgRNA
ccggcaacacgagctcccat

SEQ ID NO: 19739 - DNA, 20 bp, Artificial Sequence
  sgRNA
gggtgcaggtcgtgcacggc

SEQ ID NO: 19740 - DNA, 20 bp, Artificial Sequence
  sgRNA
gttacataaccgcgggcggg

SEQ ID NO: 19741 - DNA, 20 bp, Artificial Sequence
  sgRNA
ctcttggtcacaaagcagct

SEQ ID NO: 19742 - DNA, 20 bp, Artificial Sequence
  sgRNA
agtgaggtagagcactcagt

SEQ ID NO: 19743 - DNA, 20 bp, Artificial Sequence
  sgRNA
attgggagatgatctgagag

SEQ ID NO: 19744 - DNA, 20 bp, Artificial Sequence
  sgRNA
ccaacaaaccagagctggcc

SEQ ID NO: 19745 - DNA, 20 bp, Artificial Sequence
  sgRNA
cccacctactagggtgtcgc

SEQ ID NO: 19746 - DNA, 20 bp, Artificial Sequence
  sgRNA
ggcgcgatgacgtacggcgc

SEQ ID NO: 19747 - DNA, 20 bp, Artificial Sequence
  sgRNA
cgcgcttgcggcccgctgat

SEQ ID NO: 19748 - DNA, 20 bp, Artificial Sequence
  sgRNA
ccgggcgcgcggtcactccg

SEQ ID NO: 19749 - DNA, 20 bp, Artificial Sequence
  sgRNA
cgcctggtctcccacattcc

SEQ ID NO: 19750 - DNA, 20 bp, Artificial Sequence
  sgRNA
aacatggagagagtgttaga

SEQ ID NO: 19751 - DNA, 20 bp, Artificial Sequence
  sgRNA
gaaaggaaactgtgtttaaa

SEQ ID NO: 19752 - DNA, 20 bp, Artificial Sequence
  sgRNA
aacaatcacagatgaagtca

SEQ ID NO: 19753 - DNA, 20 bp, Artificial Sequence
  sgRNA
tttcttggcattgagagtcc

SEQ ID NO: 19754 - DNA, 20 bp, Artificial Sequence
  sgRNA
ggaagcagcggtctgagcct

SEQ ID NO: 19755 - DNA, 20 bp, Artificial Sequence
  sgRNA
tatataagttagggctgaca

SEQ ID NO: 19756 - DNA, 20 bp, Artificial Sequence
  sgRNA
ggtttggtttgttcttccca

SEQ ID NO: 19757 - DNA, 20 bp, Artificial Sequence
  sgRNA
atggaggaaggtgtatgcgg

SEQ ID NO: 19758 - DNA, 20 bp, Artificial Sequence
  sgRNA
gcagcggcagcgctgcttta

SEQ ID NO: 19759 - DNA, 20 bp, Artificial Sequence
  sgRNA
cagtgggtcgggtagccttc

SEQ ID NO: 19760 - DNA, 20 bp, Artificial Sequence
  sgRNA
caggtttaccgcgtgcagcc

SEQ ID NO: 19761 - DNA, 20 bp, Artificial Sequence
  sgRNA
ccctacggcgcagcctatta

SEQ ID NO: 19762 - DNA, 20 bp, Artificial Sequence
  sgRNA
tagggcttccagatctgtgt

SEQ ID NO: 19763 - DNA, 20 bp, Artificial Sequence
  sgRNA
ccctctcttccaagtggcct

SEQ ID NO: 19764 - DNA, 20 bp, Artificial Sequence
  sgRNA
ggatcagctgctctgtcttg

SEQ ID NO: 19765 - DNA, 20 bp, Artificial Sequence
  sgRNA
gagatcgcttacagcaggcc

SEQ ID NO: 19766 - DNA, 20 bp, Artificial Sequence
  sgRNA
acacaaagatggcaccgccc

SEQ ID NO: 19767 - DNA, 20 bp, Artificial Sequence
  sgRNA
cgcctcgtatttcctggatc

SEQ ID NO: 19768 - DNA, 20 bp, Artificial Sequence
  sgRNA
actggtttcaccactccagt

SEQ ID NO: 19769 - DNA, 20 bp, Artificial Sequence
  sgRNA
gtaggctagaacaatataaa

SEQ ID NO: 19770 - DNA, 20 bp, Artificial Sequence
  sgRNA
gttccaacagcagctagaaa

SEQ ID NO: 19771 - DNA, 20 bp, Artificial Sequence
  sgRNA
tctctggcccaccgccctcc

SEQ ID NO: 19772 - DNA, 20 bp, Artificial Sequence
  sgRNA
aaacccaaggccggcctcct

SEQ ID NO: 19773 - DNA, 20 bp, Artificial Sequence
  sgRNA
ccagcgactcccggcggcgg

SEQ ID NO: 19774 - DNA, 20 bp, Artificial Sequence
  sgRNA
ctccagatatcgcgagaaga

SEQ ID NO: 19775 - DNA, 20 bp, Artificial Sequence
  sgRNA
agcggcttcccttccagacg

SEQ ID NO: 19776 - DNA, 20 bp, Artificial Sequence
  sgRNA
gaggctgacctcgtctggaa

SEQ ID NO: 19777 - DNA, 20 bp, Artificial Sequence
  sgRNA
tataaggatatgccctatgg

SEQ ID NO: 19778 - DNA, 20 bp, Artificial Sequence
  sgRNA
tggtgaggtatggaggaagg

SEQ ID NO: 19779 - DNA, 20 bp, Artificial Sequence
  sgRNA
gtctcagccggcccatgtag

SEQ ID NO: 19780 - DNA, 20 bp, Artificial Sequence
  sgRNA
ggccaggccgcggttcgtga

SEQ ID NO: 19781 - DNA, 20 bp, Artificial Sequence
  sgRNA
tggtcgcggctgctgaagct

SEQ ID NO: 19782 - DNA, 20 bp, Artificial Sequence
  sgRNA
tcgtggtcgcggcgacgtcg

SEQ ID NO: 19783 - DNA, 20 bp, Artificial Sequence
  sgRNA
gctgaaggcttggtaaggtc

SEQ ID NO: 19784 - DNA, 20 bp, Artificial Sequence
  sgRNA
acctgagttagaatttacgc

SEQ ID NO: 19785 - DNA, 20 bp, Artificial Sequence
  sgRNA
cctagcctaagggccaatcc

SEQ ID NO: 19786 - DNA, 20 bp, Artificial Sequence
  sgRNA
tgggctacggatgctcgggt

SEQ ID NO: 19787 - DNA, 20 bp, Artificial Sequence
  sgRNA
cggccaatccgaaggcgtgt

SEQ ID NO: 19788 - DNA, 20 bp, Artificial Sequence
  sgRNA
tggagctcgcggtggctacc

SEQ ID NO: 19789 - DNA, 20 bp, Artificial Sequence
  sgRNA
tttaatcggtgtgggcataa

SEQ ID NO: 19790 - DNA, 20 bp, Artificial Sequence
  sgRNA
gttgcaagtgtgggcgggtg

SEQ ID NO: 19791 - DNA, 20 bp, Artificial Sequence
  sgRNA
ttctctgtagttactgaact

SEQ ID NO: 19792 - DNA, 20 bp, Artificial Sequence
  sgRNA
cgaagctcgcgctcagaaag

SEQ ID NO: 19793 - DNA, 20 bp, Artificial Sequence
  sgRNA
caagcactagccgagcgcag

SEQ ID NO: 19794 - DNA, 20 bp, Artificial Sequence
  sgRNA
aatagcgcgtgatcagggtg

SEQ ID NO: 19795 - DNA, 20 bp, Artificial Sequence
  sgRNA
gcggcggaggtgaacgcgcg

SEQ ID NO: 19796 - DNA, 20 bp, Artificial Sequence
  sgRNA
tggaaccttggaatggtttg

SEQ ID NO: 19797 - DNA, 20 bp, Artificial Sequence
  sgRNA
tgattcatggatcgcggtga

SEQ ID NO: 19798 - DNA, 20 bp, Artificial Sequence
  sgRNA
ccaccagatcctgttaagaa

SEQ ID NO: 19799 - DNA, 20 bp, Artificial Sequence
  sgRNA
ggcaagaggcagagcattgt

SEQ ID NO: 19800 - DNA, 20 bp, Artificial Sequence
  sgRNA
ctctccggcatctctagttt

SEQ ID NO: 19801 - DNA, 20 bp, Artificial Sequence
  sgRNA
cgacctagtccctgcctaaa

SEQ ID NO: 19802 - DNA, 20 bp, Artificial Sequence
  sgRNA
tcagtcacagcctggcttat

SEQ ID NO: 19803 - DNA, 20 bp, Artificial Sequence
  sgRNA
acagtagcaaatatatcaag

SEQ ID NO: 19804 - DNA, 20 bp, Artificial Sequence
  sgRNA
agacgccatggccgacttcc

SEQ ID NO: 19805 - DNA, 20 bp, Artificial Sequence
  sgRNA
aaggcgctctccgtgcaggg

SEQ ID NO: 19806 - DNA, 20 bp, Artificial Sequence
  sgRNA
gtgcgtgctaagtgtgctcc

SEQ ID NO: 19807 - DNA, 20 bp, Artificial Sequence
  sgRNA
ctgctgggtttcacagggca

SEQ ID NO: 19808 - DNA, 20 bp, Artificial Sequence
  sgRNA
agggatcctgcagctgtcag

SEQ ID NO: 19809 - DNA, 20 bp, Artificial Sequence
  sgRNA
aaagggcggccacaggcgag

SEQ ID NO: 19810 - DNA, 20 bp, Artificial Sequence
  sgRNA
gcggtaaaggtactcagaga

SEQ ID NO: 19811 - DNA, 20 bp, Artificial Sequence
  sgRNA
tctttgctgcagttgcagca

SEQ ID NO: 19812 - DNA, 20 bp, Artificial Sequence
  sgRNA
aatctgcaaagcccttgatg

SEQ ID NO: 19813 - DNA, 20 bp, Artificial Sequence
  sgRNA
tttggcccaggcccttctcc

SEQ ID NO: 19814 - DNA, 20 bp, Artificial Sequence
  sgRNA
ctcgggcttagcgataagcc

SEQ ID NO: 19815 - DNA, 20 bp, Artificial Sequence
  sgRNA
gctaagtgatgcaggaagtg

SEQ ID NO: 19816 - DNA, 20 bp, Artificial Sequence
  sgRNA
gggatgacgaatcgaatcgg

SEQ ID NO: 19817 - DNA, 20 bp, Artificial Sequence
  sgRNA
gggttgctgcagactcattc

SEQ ID NO: 19818 - DNA, 20 bp, Artificial Sequence
  sgRNA
ggtctgctacggagacagcc

SEQ ID NO: 19819 - DNA, 20 bp, Artificial Sequence
  sgRNA
caggtggcttagggcgacgg

SEQ ID NO: 19820 - DNA, 20 bp, Artificial Sequence
  sgRNA
tgctccttgagtatcttccc

SEQ ID NO: 19821 - DNA, 20 bp, Artificial Sequence
  sgRNA
tttaagaggctgctccaccg

SEQ ID NO: 19822 - DNA, 20 bp, Artificial Sequence
  sgRNA
ccagagggcacaacgctccc

SEQ ID NO: 19823 - DNA, 20 bp, Artificial Sequence
  sgRNA
aggagtttcagccctgcaag

SEQ ID NO: 19824 - DNA, 20 bp, Artificial Sequence
  sgRNA
tggcgaagccttgtgggtag

SEQ ID NO: 19825 - DNA, 20 bp, Artificial Sequence
  sgRNA
aaggccggaggattctgatc

SEQ ID NO: 19826 - DNA, 20 bp, Artificial Sequence
  sgRNA
atttctcgaagctgttcctt

SEQ ID NO: 19827 - DNA, 20 bp, Artificial Sequence
  sgRNA
cccggagacagaaatgggaa

SEQ ID NO: 19828 - DNA, 20 bp, Artificial Sequence
  sgRNA
tcacagttagaggcaatttg

SEQ ID NO: 19829 - DNA, 20 bp, Artificial Sequence
  sgRNA
ttagctggacagcacccaag

SEQ ID NO: 19830 - DNA, 20 bp, Artificial Sequence
  sgRNA
gatttgccaagaaaggactt

SEQ ID NO: 19831 - DNA, 20 bp, Artificial Sequence
  sgRNA
tgagaatggcagagcgcctt

SEQ ID NO: 19832 - DNA, 20 bp, Artificial Sequence
  sgRNA
ccgcaacgaggagcaatgag

SEQ ID NO: 19833 - DNA, 20 bp, Artificial Sequence
  sgRNA
ctcccaaggctggagtccgg

SEQ ID NO: 19834 - DNA, 20 bp, Artificial Sequence
  sgRNA
tacccatcacactcagcctc

SEQ ID NO: 19835 - DNA, 20 bp, Artificial Sequence
  sgRNA
cggtctcctctagtgaacgc

SEQ ID NO: 19836 - DNA, 20 bp, Artificial Sequence
  sgRNA
cccagatgcacacaggaccc

SEQ ID NO: 19837 - DNA, 20 bp, Artificial Sequence
  sgRNA
actcacgaaacattacaaac

SEQ ID NO: 19838 - DNA, 20 bp, Artificial Sequence
  sgRNA
gaggttggaaacgattgttc

SEQ ID NO: 19839 - DNA, 20 bp, Artificial Sequence
  sgRNA
taggtagaatgtaagaacat

SEQ ID NO: 19840 - DNA, 20 bp, Artificial Sequence
  sgRNA
ggttgagctggctccggagt

SEQ ID NO: 19841 - DNA, 20 bp, Artificial Sequence
  sgRNA
gtgaagcggaatataaaggg

SEQ ID NO: 19842 - DNA, 20 bp, Artificial Sequence
  sgRNA
gcgccgattggccgcgccat

SEQ ID NO: 19843 - DNA, 20 bp, Artificial Sequence
  sgRNA
tcagctgtcattcgggagcg

SEQ ID NO: 19844 - DNA, 20 bp, Artificial Sequence
  sgRNA
ctttcctagttggcgccaaa

SEQ ID NO: 19845 - DNA, 20 bp, Artificial Sequence
  sgRNA
ggtcacgccctctctcggtg

SEQ ID NO: 19846 - DNA, 20 bp, Artificial Sequence
  sgRNA
cttcaactgggaatcattcc

SEQ ID NO: 19847 - DNA, 20 bp, Artificial Sequence
  sgRNA
agcaagccctaataggaccc

SEQ ID NO: 19848 - DNA, 20 bp, Artificial Sequence
  sgRNA
gcagcaagcagcttcttgcc

SEQ ID NO: 19849 - DNA, 20 bp, Artificial Sequence
  sgRNA
tgtcagttgggagggtgaac

SEQ ID NO: 19850 - DNA, 20 bp, Artificial Sequence
  sgRNA
aatcgatatctgcaccaagc

SEQ ID NO: 19851 - DNA, 20 bp, Artificial Sequence
  sgRNA
ggagcaaatgggatatttgt

SEQ ID NO: 19852 - DNA, 20 bp, Artificial Sequence
  sgRNA
aggtttcaggaacagtggta

SEQ ID NO: 19853 - DNA, 20 bp, Artificial Sequence
  sgRNA
caataaacatgttggccctg

SEQ ID NO: 19854 - DNA, 20 bp, Artificial Sequence
  sgRNA
gggaggagggcagtgggttt

SEQ ID NO: 19855 - DNA, 20 bp, Artificial Sequence
  sgRNA
gagcgccggccctactagcc

SEQ ID NO: 19856 - DNA, 20 bp, Artificial Sequence
  sgRNA
gcttataaaggcccgcaggc

SEQ ID NO: 19857 - DNA, 20 bp, Artificial Sequence
  sgRNA
ccgggtcaccggcaccagcc

SEQ ID NO: 19858 - DNA, 20 bp, Artificial Sequence
  sgRNA
ctatagggaggcaggtctga

SEQ ID NO: 19859 - DNA, 20 bp, Artificial Sequence
  sgRNA
ccctggctgcaaggtaatat

SEQ ID NO: 19860 - DNA, 20 bp, Artificial Sequence
  sgRNA
ccggcacccggcggccgcgg

SEQ ID NO: 19861 - DNA, 20 bp, Artificial Sequence
  sgRNA
tggactaggactcctgtata

SEQ ID NO: 19862 - DNA, 20 bp, Artificial Sequence
  sgRNA
tgggctgggcgggcataagc

SEQ ID NO: 19863 - DNA, 20 bp, Artificial Sequence
  sgRNA
tttggcagggagaagcagtt

SEQ ID NO: 19864 - DNA, 20 bp, Artificial Sequence
  sgRNA
agtctccattcatccgttgc

SEQ ID NO: 19865 - DNA, 20 bp, Artificial Sequence
  sgRNA
acaaacttgtacagtcacta

SEQ ID NO: 19866 - DNA, 20 bp, Artificial Sequence
  sgRNA
acccaaccttctaaagtcca

SEQ ID NO: 19867 - DNA, 20 bp, Artificial Sequence
  sgRNA
aatcacgctcatcgacctat

SEQ ID NO: 19868 - DNA, 20 bp, Artificial Sequence
  sgRNA
gacaaagatctgaacgttat

SEQ ID NO: 19869 - DNA, 20 bp, Artificial Sequence
  sgRNA
ctaagttgtgtggttcataa

SEQ ID NO: 19870 - DNA, 20 bp, Artificial Sequence
  sgRNA
tgggagccaatgccactaaa

SEQ ID NO: 19871 - DNA, 20 bp, Artificial Sequence
  sgRNA
aaatcttacgatctcgcgag

SEQ ID NO: 19872 - DNA, 20 bp, Artificial Sequence
  sgRNA
agacacagagtttaagcttt

SEQ ID NO: 19873 - DNA, 20 bp, Artificial Sequence
  sgRNA
gcagccagtggtgacgagat

SEQ ID NO: 19874 - DNA, 20 bp, Artificial Sequence
  sgRNA
ggaagagaaatccatcaccg

SEQ ID NO: 19875 - DNA, 20 bp, Artificial Sequence
  sgRNA
ctagtgcctagcttattccg

SEQ ID NO: 19876 - DNA, 20 bp, Artificial Sequence
  sgRNA
cgtgtgttcctgctcactcc

SEQ ID NO: 19877 - DNA, 20 bp, Artificial Sequence
  sgRNA
cctaagcctctccagggtcc

SEQ ID NO: 19878 - DNA, 20 bp, Artificial Sequence
  sgRNA
tgatcccacacatatgcagg

SEQ ID NO: 19879 - DNA, 20 bp, Artificial Sequence
  sgRNA
ggagtcagtcgtggatcagg

SEQ ID NO: 19880 - DNA, 20 bp, Artificial Sequence
  sgRNA
acagttctgcaggaaacggg

SEQ ID NO: 19881 - DNA, 20 bp, Artificial Sequence
  sgRNA
agagtggagaactgggatct

SEQ ID NO: 19882 - DNA, 20 bp, Artificial Sequence
  sgRNA
tgatcagatcatgcccttag

SEQ ID NO: 19883 - DNA, 20 bp, Artificial Sequence
  sgRNA
tttcatcatgatgtattgtg

SEQ ID NO: 19884 - DNA, 20 bp, Artificial Sequence
  sgRNA
tcgtgggcggagtcccggag

SEQ ID NO: 19885 - DNA, 20 bp, Artificial Sequence
  sgRNA
gcgagggcggagcttgtggg

SEQ ID NO: 19886 - DNA, 20 bp, Artificial Sequence
  sgRNA
tgggcgtagcgcgcagctgc

SEQ ID NO: 19887 - DNA, 20 bp, Artificial Sequence
  sgRNA
cgcctcgggcgacacattct

SEQ ID NO: 19888 - DNA, 20 bp, Artificial Sequence
  sgRNA
ggcggagggtggcgggctac

SEQ ID NO: 19889 - DNA, 20 bp, Artificial Sequence
  sgRNA
tgggtgcctccgggcggcgg

SEQ ID NO: 19890 - DNA, 20 bp, Artificial Sequence
  sgRNA
cggatggtgggttgtggcgc

SEQ ID NO: 19891 - DNA, 20 bp, Artificial Sequence
  sgRNA
ctggtcggaggcggcggtaa

SEQ ID NO: 19892 - DNA, 20 bp, Artificial Sequence
  sgRNA
actgcgcatcattgtgacag

SEQ ID NO: 19893 - DNA, 20 bp, Artificial Sequence
  sgRNA
tgggtacctattaatgcggg

SEQ ID NO: 19894 - DNA, 20 bp, Artificial Sequence
  sgRNA
actgcttagctatgtagccc

SEQ ID NO: 19895 - DNA, 20 bp, Artificial Sequence
  sgRNA
gctcgcagaggactctcagc

SEQ ID NO: 19896 - DNA, 20 bp, Artificial Sequence
  sgRNA
cttcccggcccgccctctat

SEQ ID NO: 19897 - DNA, 20 bp, Artificial Sequence
  sgRNA
agagacaggagcttcagttg

SEQ ID NO: 19898 - DNA, 20 bp, Artificial Sequence
  sgRNA
tagcaaagaaccagacagaa

SEQ ID NO: 19899 - DNA, 20 bp, Artificial Sequence
  sgRNA
gcctttcttgctaagaattg

SEQ ID NO: 19900 - DNA, 20 bp, Artificial Sequence
  sgRNA
aaatttcgagcagagaccca

SEQ ID NO: 19901 - DNA, 20 bp, Artificial Sequence
  sgRNA
ttgcatagattcttgtgtat

SEQ ID NO: 19902 - DNA, 20 bp, Artificial Sequence
  sgRNA
tttggaacggttatgtgcag

SEQ ID NO: 19903 - DNA, 20 bp, Artificial Sequence
  sgRNA
aagcagcttcccaaggtagg

SEQ ID NO: 19904 - DNA, 20 bp, Artificial Sequence
  sgRNA
tcgcgaatgtgcttcccttt

SEQ ID NO: 19905 - DNA, 20 bp, Artificial Sequence
  sgRNA
cggcgtttatttgcggaccg

SEQ ID NO: 19906 - DNA, 20 bp, Artificial Sequence
  sgRNA
cgcagatcgctccatctgtg

SEQ ID NO: 19907 - DNA, 20 bp, Artificial Sequence
  sgRNA
tcccgcgggaccggaatgcg

SEQ ID NO: 19908 - DNA, 20 bp, Artificial Sequence
  sgRNA
gccggaagctgccgggagaa

SEQ ID NO: 19909 - DNA, 20 bp, Artificial Sequence
  sgRNA
ccgagtttgtgaagggcctg

SEQ ID NO: 19910 - DNA, 20 bp, Artificial Sequence
  sgRNA
ggcggctaccaagtcggctg

SEQ ID NO: 19911 - DNA, 20 bp, Artificial Sequence
  sgRNA
gcgataaggtggccgaatgc

SEQ ID NO: 19912 - DNA, 20 bp, Artificial Sequence
  sgRNA
cccgacctccgcagagagac

SEQ ID NO: 19913 - DNA, 20 bp, Artificial Sequence
  sgRNA
agagatctacctctgtttcc

SEQ ID NO: 19914 - DNA, 20 bp, Artificial Sequence
  sgRNA
ttgtgaggccactcagcaag

SEQ ID NO: 19915 - DNA, 20 bp, Artificial Sequence
  sgRNA
agtttgaggcctattcaaac

SEQ ID NO: 19916 - DNA, 20 bp, Artificial Sequence
  sgRNA
ggatggaaatttcatagctt

SEQ ID NO: 19917 - DNA, 20 bp, Artificial Sequence
  sgRNA
gtgctcacttgttcgttgag

SEQ ID NO: 19918 - DNA, 20 bp, Artificial Sequence
  sgRNA
tacagtgcgtggctcatcgg

SEQ ID NO: 19919 - DNA, 20 bp, Artificial Sequence
  sgRNA
cccgccgccagctgtaggga

SEQ ID NO: 19920 - DNA, 20 bp, Artificial Sequence
  sgRNA
agccggcccagagctctgag

SEQ ID NO: 19921 - DNA, 20 bp, Artificial Sequence
  sgRNA
tttcagcgcaccatgtgccg

SEQ ID NO: 19922 - DNA, 20 bp, Artificial Sequence
  sgRNA
gcccgctggagagcgacccg

SEQ ID NO: 19923 - DNA, 20 bp, Artificial Sequence
  sgRNA
tcgttctccggccgcggagc

SEQ ID NO: 19924 - DNA, 20 bp, Artificial Sequence
  sgRNA
acgcgtcgagcatgagcagt

SEQ ID NO: 19925 - DNA, 20 bp, Artificial Sequence
  sgRNA
ggagagagcctgtgtcagtg

SEQ ID NO: 19926 - DNA, 20 bp, Artificial Sequence
  sgRNA
gtgggaatgaaccggctggg

SEQ ID NO: 19927 - DNA, 20 bp, Artificial Sequence
  sgRNA
ggtgttgtactgtctggttc

SEQ ID NO: 19928 - DNA, 20 bp, Artificial Sequence
  sgRNA
tgagctgcttcaggaccgct

SEQ ID NO: 19929 - DNA, 20 bp, Artificial Sequence
  sgRNA
gacatcagaggcctgtgctg

SEQ ID NO: 19930 - DNA, 20 bp, Artificial Sequence
  sgRNA
agtcagttctccagcactcg

SEQ ID NO: 19931 - DNA, 20 bp, Artificial Sequence
  sgRNA
cgggaaattgcaacagtact

SEQ ID NO: 19932 - DNA, 20 bp, Artificial Sequence
  sgRNA
cgggagttacgggaaagcgc

SEQ ID NO: 19933 - DNA, 20 bp, Artificial Sequence
  sgRNA
ttggcactcctgggacccac

SEQ ID NO: 19934 - DNA, 20 bp, Artificial Sequence
  sgRNA
gcaatttccaggcggccact

SEQ ID NO: 19935 - DNA, 20 bp, Artificial Sequence
  sgRNA
gtgggaagcggagagccacg

SEQ ID NO: 19936 - DNA, 20 bp, Artificial Sequence
  sgRNA
aaagatagcctctggagctt

SEQ ID NO: 19937 - DNA, 20 bp, Artificial Sequence
  sgRNA
acttgatgttgtccaatcag

SEQ ID NO: 19938 - DNA, 20 bp, Artificial Sequence
  sgRNA
gagttaccagatcccttacc

SEQ ID NO: 19939 - DNA, 20 bp, Artificial Sequence
  sgRNA
tggtagtagtttctatccat

SEQ ID NO: 19940 - DNA, 20 bp, Artificial Sequence
  sgRNA
ggacgaacagacacgtgctg

SEQ ID NO: 19941 - DNA, 20 bp, Artificial Sequence
  sgRNA
gggacaaacctagagcgaca

SEQ ID NO: 19942 - DNA, 20 bp, Artificial Sequence
  sgRNA
cttcccacacgcgccctgcc

SEQ ID NO: 19943 - DNA, 20 bp, Artificial Sequence
  sgRNA
ggtgtgccgcccgggagccc

SEQ ID NO: 19944 - DNA, 20 bp, Artificial Sequence
  sgRNA
agcaggctggtggcggtccc

SEQ ID NO: 19945 - DNA, 20 bp, Artificial Sequence
  sgRNA
tctgtcctaataaggaaagt

SEQ ID NO: 19946 - DNA, 20 bp, Artificial Sequence
  sgRNA
gggcgggcccgactagggag

SEQ ID NO: 19947 - DNA, 20 bp, Artificial Sequence
  sgRNA
gcttctcggcggcgcagtgg

SEQ ID NO: 19948 - DNA, 20 bp, Artificial Sequence
  sgRNA
gcacatcgccctccttcctg

SEQ ID NO: 19949 - DNA, 20 bp, Artificial Sequence
  sgRNA
ggaaagtgtggtggccgccc

SEQ ID NO: 19950 - DNA, 20 bp, Artificial Sequence
  sgRNA
ggattcatcggaggcacgac

SEQ ID NO: 19951 - DNA, 20 bp, Artificial Sequence
  sgRNA
gagtgacgccaccctctgat

SEQ ID NO: 19952 - DNA, 20 bp, Artificial Sequence
  sgRNA
actttgagttcccgaagccc

SEQ ID NO: 19953 - DNA, 20 bp, Artificial Sequence
  sgRNA
caagcctaagggatctagcc

SEQ ID NO: 19954 - DNA, 20 bp, Artificial Sequence
  sgRNA
tgatagggaatgcattctcc

SEQ ID NO: 19955 - DNA, 20 bp, Artificial Sequence
  sgRNA
ctagctaggactgccatgtc

SEQ ID NO: 19956 - DNA, 20 bp, Artificial Sequence
  sgRNA
cggaaagtaagagtttgcgc

SEQ ID NO: 19957 - DNA, 20 bp, Artificial Sequence
  sgRNA
cacagaacagtactcactcc

SEQ ID NO: 19958 - DNA, 20 bp, Artificial Sequence
  sgRNA
aatcacgaggccgttgctcg

SEQ ID NO: 19959 - DNA, 20 bp, Artificial Sequence
  sgRNA
gcgattataaatccagctca

SEQ ID NO: 19960 - DNA, 20 bp, Artificial Sequence
  sgRNA
aggcagtcagacacctgcaa

SEQ ID NO: 19961 - DNA, 20 bp, Artificial Sequence
  sgRNA
gaggcggaacttgggcgcgc

SEQ ID NO: 19962 - DNA, 20 bp, Artificial Sequence
  sgRNA
gcggttacccagcaaccgac

SEQ ID NO: 19963 - DNA, 20 bp, Artificial Sequence
  sgRNA
tatctttctctgcggaggcg

SEQ ID NO: 19964 - DNA, 20 bp, Artificial Sequence
  sgRNA
catgcaagtgggatcttggc

SEQ ID NO: 19965 - DNA, 20 bp, Artificial Sequence
  sgRNA
gacttcaaccgcgtagcttt

SEQ ID NO: 19966 - DNA, 20 bp, Artificial Sequence
  sgRNA
cggaagtcatacacagagcg

SEQ ID NO: 19967 - DNA, 20 bp, Artificial Sequence
  sgRNA
ttcggcacggcagtgacagt

SEQ ID NO: 19968 - DNA, 20 bp, Artificial Sequence
  sgRNA
aacccattgcctttgaagcc

SEQ ID NO: 19969 - DNA, 20 bp, Artificial Sequence
  sgRNA
ggtcgcgctccagaggagct

SEQ ID NO: 19970 - DNA, 20 bp, Artificial Sequence
  sgRNA
tggcgtccctctctgggcac

SEQ ID NO: 19971 - DNA, 20 bp, Artificial Sequence
  sgRNA
gggcgcgggcggaggctcgg

SEQ ID NO: 19972 - DNA, 20 bp, Artificial Sequence
  sgRNA
gcgcatcactggcctgcagg

SEQ ID NO: 19973 - DNA, 20 bp, Artificial Sequence
  sgRNA
ttaccaggcgacactgtcac

SEQ ID NO: 19974 - DNA, 20 bp, Artificial Sequence
  sgRNA
tcgggtgctcagtgtcggca

SEQ ID NO: 19975 - DNA, 20 bp, Artificial Sequence
  sgRNA
ggaagcgccgagtttccgtg

SEQ ID NO: 19976 - DNA, 20 bp, Artificial Sequence
  sgRNA
tgctggatgtagcctagaac

SEQ ID NO: 19977 - DNA, 20 bp, Artificial Sequence
  sgRNA
gcgccgagcgcctgaagact

SEQ ID NO: 19978 - DNA, 20 bp, Artificial Sequence
  sgRNA
ccctccgtaatcgctccgat

SEQ ID NO: 19979 - DNA, 20 bp, Artificial Sequence
  sgRNA
gggtcacgggcacaggtgag

SEQ ID NO: 19980 - DNA, 20 bp, Artificial Sequence
  sgRNA
aggtcgggaagtgcacgcag

SEQ ID NO: 19981 - DNA, 20 bp, Artificial Sequence
  sgRNA
ctcaagggacccagaataga

SEQ ID NO: 19982 - DNA, 20 bp, Artificial Sequence
  sgRNA
tgggacgcccaccatgtgac

SEQ ID NO: 19983 - DNA, 20 bp, Artificial Sequence
  sgRNA
ggacagactacccgcccaga

SEQ ID NO: 19984 - DNA, 20 bp, Artificial Sequence
  sgRNA
ctggccagcagtctgggcgg

SEQ ID NO: 19985 - DNA, 20 bp, Artificial Sequence
  sgRNA
cctaagggaacccggagcct

SEQ ID NO: 19986 - DNA, 20 bp, Artificial Sequence
  sgRNA
gattgggtctgaagaagata

SEQ ID NO: 19987 - DNA, 20 bp, Artificial Sequence
  sgRNA
gaaggcaggcctccgaattc

SEQ ID NO: 19988 - DNA, 20 bp, Artificial Sequence
  sgRNA
tgtagtatccttcgccaatc

SEQ ID NO: 19989 - DNA, 20 bp, Artificial Sequence
  sgRNA
cctcgcctccaacgttgctt

SEQ ID NO: 19990 - DNA, 20 bp, Artificial Sequence
  sgRNA
tagaggtaggtccaacccgg

SEQ ID NO: 19991 - DNA, 20 bp, Artificial Sequence
  sgRNA
tactggaggtgatttattat

SEQ ID NO: 19992 - DNA, 20 bp, Artificial Sequence
  sgRNA
acatttgcctacaatataag

SEQ ID NO: 19993 - DNA, 20 bp, Artificial Sequence
  sgRNA
tttaacctcttgaccctaaa

SEQ ID NO: 19994 - DNA, 20 bp, Artificial Sequence
  sgRNA
ctgggtatcccaaagtccag

SEQ ID NO: 19995 - DNA, 20 bp, Artificial Sequence
  sgRNA
ctttgaagacctaagaacag

SEQ ID NO: 19996 - DNA, 20 bp, Artificial Sequence
  sgRNA
agagagttgcagctgacgca

SEQ ID NO: 19997 - DNA, 20 bp, Artificial Sequence
  sgRNA
ccaggtgccagctggttatg

SEQ ID NO: 19998 - DNA, 20 bp, Artificial Sequence
  sgRNA
ggcaaccagtagcagaactg

SEQ ID NO: 19999 - DNA, 20 bp, Artificial Sequence
  sgRNA
gcagaactggaccagggtga

SEQ ID NO: 20000 - DNA, 20 bp, Artificial Sequence
  sgRNA
gggagcaggaaggatgcaga

SEQ ID NO: 20001 - DNA, 20 bp, Artificial Sequence
  sgRNA
agagagagagagctcattga

SEQ ID NO: 20002 - DNA, 20 bp, Artificial Sequence
  sgRNA
tgttatgcagacagactaga

SEQ ID NO: 20003 - DNA, 20 bp, Artificial Sequence
  sgRNA
tcgagcgctgcgcctgaggg

SEQ ID NO: 20004 - DNA, 20 bp, Artificial Sequence
  sgRNA
cttgcgagagctggaggcgg

SEQ ID NO: 20005 - DNA, 20 bp, Artificial Sequence
  sgRNA
gatagtctccaaactcactt

SEQ ID NO: 20006 - DNA, 20 bp, Artificial Sequence
  sgRNA
tgttgtagaactacctttcc

SEQ ID NO: 20007 - DNA, 20 bp, Artificial Sequence
  sgRNA
tcccagcagtcgtgtgaccc

SEQ ID NO: 20008 - DNA, 20 bp, Artificial Sequence
  sgRNA
gtgcgccgggagtaggtgag

SEQ ID NO: 20009 - DNA, 20 bp, Artificial Sequence
  sgRNA
taaagaaccagacctcttgg

SEQ ID NO: 20010 - DNA, 20 bp, Artificial Sequence
  sgRNA
cgcccacctacagaccggac

SEQ ID NO: 20011 - DNA, 20 bp, Artificial Sequence
  sgRNA
ggcgggaccattcggcaccg

SEQ ID NO: 20012 - DNA, 20 bp, Artificial Sequence
  sgRNA
aatcctcccgcagaaattgc

SEQ ID NO: 20013 - DNA, 20 bp, Artificial Sequence
  sgRNA
ttgcgtctcttgcgtcaaga

SEQ ID NO: 20014 - DNA, 20 bp, Artificial Sequence
  sgRNA
taaatcgctcccagctcgaa

SEQ ID NO: 20015 - DNA, 20 bp, Artificial Sequence
  sgRNA
tggtgggagttgcaagccgc

SEQ ID NO: 20016 - DNA, 20 bp, Artificial Sequence
  sgRNA
ccgactaagtagcagctcaa

SEQ ID NO: 20017 - DNA, 20 bp, Artificial Sequence
  sgRNA
ctgagctagggcttccaccc

SEQ ID NO: 20018 - DNA, 20 bp, Artificial Sequence
  sgRNA
actgttgcaggctgggctct

SEQ ID NO: 20019 - DNA, 20 bp, Artificial Sequence
  sgRNA
cgagccgaagaagccgcgtt

SEQ ID NO: 20020 - DNA, 20 bp, Artificial Sequence
  sgRNA
ccaccgcctttgaacgctgg

SEQ ID NO: 20021 - DNA, 20 bp, Artificial Sequence
  sgRNA
cagccacaatgaagtaccca

SEQ ID NO: 20022 - DNA, 20 bp, Artificial Sequence
  sgRNA
ctggagagcactcagaccgc

SEQ ID NO: 20023 - DNA, 20 bp, Artificial Sequence
  sgRNA
gagacgcctaatacatggac

SEQ ID NO: 20024 - DNA, 20 bp, Artificial Sequence
  sgRNA
aacggcgtgcgccaggcggg

SEQ ID NO: 20025 - DNA, 20 bp, Artificial Sequence
  sgRNA
tccggaagcttctgcagtgt

SEQ ID NO: 20026 - DNA, 20 bp, Artificial Sequence
  sgRNA
tagatcagggagcgttggtc

SEQ ID NO: 20027 - DNA, 20 bp, Artificial Sequence
  sgRNA
cccgggccggagcccgtagg

SEQ ID NO: 20028 - DNA, 20 bp, Artificial Sequence
  sgRNA
gagcacctgggctttcgcgg

SEQ ID NO: 20029 - DNA, 20 bp, Artificial Sequence
  sgRNA
tggagtcgcaaagtggctgc

SEQ ID NO: 20030 - DNA, 20 bp, Artificial Sequence
  sgRNA
taaagggtgtgtgtgttggg

SEQ ID NO: 20031 - DNA, 20 bp, Artificial Sequence
  sgRNA
cacagaggaaagtaaattat

SEQ ID NO: 20032 - DNA, 20 bp, Artificial Sequence
  sgRNA
acacacttgtcaagcctgct

SEQ ID NO: 20033 - DNA, 20 bp, Artificial Sequence
  sgRNA
ctgtcatcgaggtcgcaaag

SEQ ID NO: 20034 - DNA, 20 bp, Artificial Sequence
  sgRNA
tgccctcctgtcaagcgctt

SEQ ID NO: 20035 - DNA, 20 bp, Artificial Sequence
  sgRNA
ggtcgccggcctgtgtggca

SEQ ID NO: 20036 - DNA, 20 bp, Artificial Sequence
  sgRNA
gggaagctaatcactacttc

SEQ ID NO: 20037 - DNA, 20 bp, Artificial Sequence
  sgRNA
taggtggcgcgccgagcgcc

SEQ ID NO: 20038 - DNA, 20 bp, Artificial Sequence
  sgRNA
tcctccacttcccgcagcag

SEQ ID NO: 20039 - DNA, 20 bp, Artificial Sequence
  sgRNA
ctagttcttaggcagatgga

SEQ ID NO: 20040 - DNA, 20 bp, Artificial Sequence
  sgRNA
tactatggaaatcagagtac

SEQ ID NO: 20041 - DNA, 20 bp, Artificial Sequence
  sgRNA
gccctcagcttcggctgccc

SEQ ID NO: 20042 - DNA, 20 bp, Artificial Sequence
  sgRNA
aggcatgtctccaccaaata

SEQ ID NO: 20043 - DNA, 20 bp, Artificial Sequence
  sgRNA
cgcagctctcatgatggtcg

SEQ ID NO: 20044 - DNA, 20 bp, Artificial Sequence
  sgRNA
gcaggccatgtcaactcacc

SEQ ID NO: 20045 - DNA, 20 bp, Artificial Sequence
  sgRNA
tgccgccgtcgttagggcgc

SEQ ID NO: 20046 - DNA, 20 bp, Artificial Sequence
  sgRNA
ggctcctagcaacagcatcc

SEQ ID NO: 20047 - DNA, 20 bp, Artificial Sequence
  sgRNA
caggcctacgtcagcgcgct

SEQ ID NO: 20048 - DNA, 20 bp, Artificial Sequence
  sgRNA
ctgcttcagtgacacgatct

SEQ ID NO: 20049 - DNA, 20 bp, Artificial Sequence
  sgRNA
ggaggcgagaggctcctccc

SEQ ID NO: 20050 - DNA, 20 bp, Artificial Sequence
  sgRNA
atcgagggagggcggacggc

SEQ ID NO: 20051 - DNA, 20 bp, Artificial Sequence
  sgRNA
tccctccctacgggacagaa

SEQ ID NO: 20052 - DNA, 20 bp, Artificial Sequence
  sgRNA
gaaccggcctgagcatgcgt

SEQ ID NO: 20053 - DNA, 20 bp, Artificial Sequence
  sgRNA
aaagagacgcgcgaggacac

SEQ ID NO: 20054 - DNA, 20 bp, Artificial Sequence
  sgRNA
gcagaacccaccaaagcgct

SEQ ID NO: 20055 - DNA, 20 bp, Artificial Sequence
  sgRNA
agatccttagatcctggctc

SEQ ID NO: 20056 - DNA, 20 bp, Artificial Sequence
  sgRNA
acgcgctccctagcccggac

SEQ ID NO: 20057 - DNA, 20 bp, Artificial Sequence
  sgRNA
gggaagctgagtactttctg

SEQ ID NO: 20058 - DNA, 20 bp, Artificial Sequence
  sgRNA
atgcttctgtctccacctcc

SEQ ID NO: 20059 - DNA, 20 bp, Artificial Sequence
  sgRNA
ataagggaccacaggcccac

SEQ ID NO: 20060 - DNA, 20 bp, Artificial Sequence
  sgRNA
atggctgattcctccaccta

SEQ ID NO: 20061 - DNA, 20 bp, Artificial Sequence
  sgRNA
agagaatctgggaaggcaag

SEQ ID NO: 20062 - DNA, 20 bp, Artificial Sequence
  sgRNA
atctactaatttactggctc

SEQ ID NO: 20063 - DNA, 20 bp, Artificial Sequence
  sgRNA
agggtcaagagatttgataa

SEQ ID NO: 20064 - DNA, 20 bp, Artificial Sequence
  sgRNA
tgtgccacacaagttaaact

SEQ ID NO: 20065 - DNA, 20 bp, Artificial Sequence
  sgRNA
tactgagaacgaacgcatgg

SEQ ID NO: 20066 - DNA, 20 bp, Artificial Sequence
  sgRNA
cgggccggccggcagcccgg

SEQ ID NO: 20067 - DNA, 20 bp, Artificial Sequence
  sgRNA
ggagggcgggcggcggcgct

SEQ ID NO: 20068 - DNA, 20 bp, Artificial Sequence
  sgRNA
ggcgctgtgcgcgacctggc

SEQ ID NO: 20069 - DNA, 20 bp, Artificial Sequence
  sgRNA
gccctccgcagcgtgaacag

SEQ ID NO: 20070 - DNA, 20 bp, Artificial Sequence
  sgRNA
ctgcatgctttgcaccaatt

SEQ ID NO: 20071 - DNA, 20 bp, Artificial Sequence
  sgRNA
gttggatgtgctaagccacg

SEQ ID NO: 20072 - DNA, 20 bp, Artificial Sequence
  sgRNA
cagcactttctgtcccgctg

SEQ ID NO: 20073 - DNA, 20 bp, Artificial Sequence
  sgRNA
aaataagctgaacgctgaca

SEQ ID NO: 20074 - DNA, 20 bp, Artificial Sequence
  sgRNA
tgagtaaatatttccctacg

SEQ ID NO: 20075 - DNA, 20 bp, Artificial Sequence
  sgRNA
taatcaatgctatttggctg

SEQ ID NO: 20076 - DNA, 20 bp, Artificial Sequence
  sgRNA
catctccgtccctgacgccc

SEQ ID NO: 20077 - DNA, 20 bp, Artificial Sequence
  sgRNA
taaataaattcacggcggtg

SEQ ID NO: 20078 - DNA, 20 bp, Artificial Sequence
  sgRNA
ttcctccagctaacgccaag

SEQ ID NO: 20079 - DNA, 20 bp, Artificial Sequence
  sgRNA
tcaaggcgctccagaaaccg

SEQ ID NO: 20080 - DNA, 20 bp, Artificial Sequence
  sgRNA
cgaccctttgtgatgtcacc

SEQ ID NO: 20081 - DNA, 20 bp, Artificial Sequence
  sgRNA
gacatgcagatgaggtgggc

SEQ ID NO: 20082 - DNA, 20 bp, Artificial Sequence
  sgRNA
gcccgctagaggctgacaga

SEQ ID NO: 20083 - DNA, 20 bp, Artificial Sequence
  sgRNA
ccaggctccacgaaggtaca

SEQ ID NO: 20084 - DNA, 20 bp, Artificial Sequence
  sgRNA
agtacgcgactcttcttccc

SEQ ID NO: 20085 - DNA, 20 bp, Artificial Sequence
  sgRNA
acgggaaccacgcgccgcta

SEQ ID NO: 20086 - DNA, 20 bp, Artificial Sequence
  sgRNA
taaattagccagcccggttt

SEQ ID NO: 20087 - DNA, 20 bp, Artificial Sequence
  sgRNA
ggtcaggatgggatttgaac

SEQ ID NO: 20088 - DNA, 20 bp, Artificial Sequence
  sgRNA
atacacgcactccctttggg

SEQ ID NO: 20089 - DNA, 20 bp, Artificial Sequence
  sgRNA
gaagagacccttcttgagaa

SEQ ID NO: 20090 - DNA, 20 bp, Artificial Sequence
  sgRNA
agagggttgggtgagttcag

SEQ ID NO: 20091 - DNA, 20 bp, Artificial Sequence
  sgRNA
gtaaggtggcgatctgggcc

SEQ ID NO: 20092 - DNA, 20 bp, Artificial Sequence
  sgRNA
tcggtgggagtggatgatca

SEQ ID NO: 20093 - DNA, 20 bp, Artificial Sequence
  sgRNA
tggtgttctgtgcaaccaat

SEQ ID NO: 20094 - DNA, 20 bp, Artificial Sequence
  sgRNA
aagcaacagcccaaaggttt

SEQ ID NO: 20095 - DNA, 20 bp, Artificial Sequence
  sgRNA
cccactccggtgaacgggcg

SEQ ID NO: 20096 - DNA, 20 bp, Artificial Sequence
  sgRNA
gagagatggaggatgccggc

SEQ ID NO: 20097 - DNA, 20 bp, Artificial Sequence
  sgRNA
gacgtctctgcggacactca

SEQ ID NO: 20098 - DNA, 20 bp, Artificial Sequence
  sgRNA
gacccgagcgtttccggccc

SEQ ID NO: 20099 - DNA, 20 bp, Artificial Sequence
  sgRNA
tgctccacatcgaaaccaat

SEQ ID NO: 20100 - DNA, 20 bp, Artificial Sequence
  sgRNA
aagtgctttgccgctgttgc

SEQ ID NO: 20101 - DNA, 20 bp, Artificial Sequence
  sgRNA
gttgctaggcaatagggtga

SEQ ID NO: 20102 - DNA, 20 bp, Artificial Sequence
  sgRNA
gtgagtgttgccaaagcttc

SEQ ID NO: 20103 - DNA, 20 bp, Artificial Sequence
  sgRNA
actcattctctgcttgcgtc

SEQ ID NO: 20104 - DNA, 20 bp, Artificial Sequence
  sgRNA
aacacaggtaaacaggcagg

SEQ ID NO: 20105 - DNA, 20 bp, Artificial Sequence
  sgRNA
tttcccattcaccctgttag

SEQ ID NO: 20106 - DNA, 20 bp, Artificial Sequence
  sgRNA
tatcaccaagcaacaggccc

SEQ ID NO: 20107 - DNA, 20 bp, Artificial Sequence
  sgRNA
tcaataaggcacaggaatgg

SEQ ID NO: 20108 - DNA, 20 bp, Artificial Sequence
  sgRNA
gtcactagcataaccatgcc

SEQ ID NO: 20109 - DNA, 20 bp, Artificial Sequence
  sgRNA
ttggctgagtcgggcacgtc

SEQ ID NO: 20110 - DNA, 20 bp, Artificial Sequence
  sgRNA
cttgggttgcttgtcgagaa

SEQ ID NO: 20111 - DNA, 20 bp, Artificial Sequence
  sgRNA
gtgtctcggttagcaagaag

SEQ ID NO: 20112 - DNA, 20 bp, Artificial Sequence
  sgRNA
cccacctccgctatcttaat

SEQ ID NO: 20113 - DNA, 20 bp, Artificial Sequence
  sgRNA
ggcaatccctgccattgctc

SEQ ID NO: 20114 - DNA, 20 bp, Artificial Sequence
  sgRNA
gagctctcctagtagctgct

SEQ ID NO: 20115 - DNA, 20 bp, Artificial Sequence
  sgRNA
agctgcacgtgtgtcagcgc

SEQ ID NO: 20116 - DNA, 20 bp, Artificial Sequence
  sgRNA
agagaacagctttccgtggc

SEQ ID NO: 20117 - DNA, 20 bp, Artificial Sequence
  sgRNA
aggtgaataatcaacaatcg

SEQ ID NO: 20118 - DNA, 20 bp, Artificial Sequence
  sgRNA
ccgaggcgcgctcccacccg

SEQ ID NO: 20119 - DNA, 20 bp, Artificial Sequence
  sgRNA
gcgccctggcgccgagcgtg

SEQ ID NO: 20120 - DNA, 20 bp, Artificial Sequence
  sgRNA
gcgcggcacgagctgcccgc

SEQ ID NO: 20121 - DNA, 20 bp, Artificial Sequence
  sgRNA
taagcgacgttcctagttca

SEQ ID NO: 20122 - DNA, 20 bp, Artificial Sequence
  sgRNA
gagacttgtttgtctgggcc

SEQ ID NO: 20123 - DNA, 20 bp, Artificial Sequence
  sgRNA
aaggaaacccaggctgtgtc

SEQ ID NO: 20124 - DNA, 20 bp, Artificial Sequence
  sgRNA
aagccagctcaagagccctt

SEQ ID NO: 20125 - DNA, 20 bp, Artificial Sequence
  sgRNA
agtaagtactgagcaaggct

SEQ ID NO: 20126 - DNA, 20 bp, Artificial Sequence
  sgRNA
caggaactgactgaggctcc

SEQ ID NO: 20127 - DNA, 20 bp, Artificial Sequence
  sgRNA
gtgcctctcacaggctggtg

SEQ ID NO: 20128 - DNA, 20 bp, Artificial Sequence
  sgRNA
ctactgccttccatgagctt

SEQ ID NO: 20129 - DNA, 20 bp, Artificial Sequence
  sgRNA
gggtgtagcagtgcagcctg

SEQ ID NO: 20130 - DNA, 20 bp, Artificial Sequence
  sgRNA
aggctggaggcggcgcgcgc

SEQ ID NO: 20131 - DNA, 20 bp, Artificial Sequence
  sgRNA
ggcgagagggacgacgaggg

SEQ ID NO: 20132 - DNA, 20 bp, Artificial Sequence
  sgRNA
agggaaggtggcagggagag

SEQ ID NO: 20133 - DNA, 20 bp, Artificial Sequence
  sgRNA
tttcacgttattccgcccag

SEQ ID NO: 20134 - DNA, 20 bp, Artificial Sequence
  sgRNA
aggcggtgaggcgttggact

SEQ ID NO: 20135 - DNA, 20 bp, Artificial Sequence
  sgRNA
actcaccagctaccaagccc

SEQ ID NO: 20136 - DNA, 20 bp, Artificial Sequence
  sgRNA
cctcacagtgcagaggtgaa

SEQ ID NO: 20137 - DNA, 20 bp, Artificial Sequence
  sgRNA
aatgaagaggtcagatgact

SEQ ID NO: 20138 - DNA, 20 bp, Artificial Sequence
  sgRNA
actgacccagagtcaaacag

SEQ ID NO: 20139 - DNA, 20 bp, Artificial Sequence
  sgRNA
cgagaggtgggcacggcttg

SEQ ID NO: 20140 - DNA, 20 bp, Artificial Sequence
  sgRNA
atggctcccggaagtgggcg

SEQ ID NO: 20141 - DNA, 20 bp, Artificial Sequence
  sgRNA
tcagtggtctgtgctagcgg

SEQ ID NO: 20142 - DNA, 20 bp, Artificial Sequence
  sgRNA
tgctaggtggaaggagcgtg

SEQ ID NO: 20143 - DNA, 20 bp, Artificial Sequence
  sgRNA
ccctcacccgcggttcagag

SEQ ID NO: 20144 - DNA, 20 bp, Artificial Sequence
  sgRNA
tccctggatcacgtgtgttc

SEQ ID NO: 20145 - DNA, 20 bp, Artificial Sequence
  sgRNA
cgttaacagcgctcgggact

SEQ ID NO: 20146 - DNA, 20 bp, Artificial Sequence
  sgRNA
agggtcactgcgaaacttcg

SEQ ID NO: 20147 - DNA, 20 bp, Artificial Sequence
  sgRNA
tgcgcagttgactgccgccc

SEQ ID NO: 20148 - DNA, 20 bp, Artificial Sequence
  sgRNA
gactcagaggattatataag

SEQ ID NO: 20149 - DNA, 20 bp, Artificial Sequence
  sgRNA
aaatctcagtccactctaag

SEQ ID NO: 20150 - DNA, 20 bp, Artificial Sequence
  sgRNA
gcgtgacaccagggcgttcc

SEQ ID NO: 20151 - DNA, 20 bp, Artificial Sequence
  sgRNA
gctggcaagttcccggaccg

SEQ ID NO: 20152 - DNA, 20 bp, Artificial Sequence
  sgRNA
gatctgtgagctggcgcacg

SEQ ID NO: 20153 - DNA, 20 bp, Artificial Sequence
  sgRNA
tccggtctgctggatgccct

SEQ ID NO: 20154 - DNA, 20 bp, Artificial Sequence
  sgRNA
aagttgcatggtccagggag

SEQ ID NO: 20155 - DNA, 20 bp, Artificial Sequence
  sgRNA
ttccctctgaggaggcggcc

SEQ ID NO: 20156 - DNA, 20 bp, Artificial Sequence
  sgRNA
gaagaactcgagggcacaga

SEQ ID NO: 20157 - DNA, 20 bp, Artificial Sequence
  sgRNA
attggtcagaactctggagg

SEQ ID NO: 20158 - DNA, 20 bp, Artificial Sequence
  sgRNA
attggttcaggccggagaag

SEQ ID NO: 20159 - DNA, 20 bp, Artificial Sequence
  sgRNA
tgaagctcagggagctattt

SEQ ID NO: 20160 - DNA, 20 bp, Artificial Sequence
  sgRNA
ggcagcatgccacgcctccc

SEQ ID NO: 20161 - DNA, 20 bp, Artificial Sequence
  sgRNA
gggatttaaagcctggctca

SEQ ID NO: 20162 - DNA, 20 bp, Artificial Sequence
  sgRNA
ggagatacaaatttctgacc

SEQ ID NO: 20163 - DNA, 20 bp, Artificial Sequence
  sgRNA
ttctgctgaagacataaata

SEQ ID NO: 20164 - DNA, 20 bp, Artificial Sequence
  sgRNA
atggagatcttgaggaatag

SEQ ID NO: 20165 - DNA, 20 bp, Artificial Sequence
  sgRNA
tccgtttcatattcggaaag

SEQ ID NO: 20166 - DNA, 20 bp, Artificial Sequence
  sgRNA
tatgtcaaatgtgtgtaagg

SEQ ID NO: 20167 - DNA, 20 bp, Artificial Sequence
  sgRNA
cttagcactctcagtataag

SEQ ID NO: 20168 - DNA, 20 bp, Artificial Sequence
  sgRNA
gggtgtggttcagagaataa

SEQ ID NO: 20169 - DNA, 20 bp, Artificial Sequence
  sgRNA
gcagataggagggaagactt

SEQ ID NO: 20170 - DNA, 20 bp, Artificial Sequence
  sgRNA
ctctttaatgtctgactgct

SEQ ID NO: 20171 - DNA, 20 bp, Artificial Sequence
  sgRNA
gggtctccgcagactgcttt

SEQ ID NO: 20172 - DNA, 20 bp, Artificial Sequence
  sgRNA
cggacgtccctgacatcagg

SEQ ID NO: 20173 - DNA, 20 bp, Artificial Sequence
  sgRNA
ctggctagaaccaagagagc

SEQ ID NO: 20174 - DNA, 20 bp, Artificial Sequence
  sgRNA
gacgggacttgttatgggcg

SEQ ID NO: 20175 - DNA, 20 bp, Artificial Sequence
  sgRNA
aggtactagacaaacgaaca

SEQ ID NO: 20176 - DNA, 20 bp, Artificial Sequence
  sgRNA
tcagtgaacggacacttcac

SEQ ID NO: 20177 - DNA, 20 bp, Artificial Sequence
  sgRNA
cagaagaccctttcccatca

SEQ ID NO: 20178 - DNA, 20 bp, Artificial Sequence
  sgRNA
taaatattgacctgtacatc

SEQ ID NO: 20179 - DNA, 20 bp, Artificial Sequence
  sgRNA
actgaacacaagctgaacgg

SEQ ID NO: 20180 - DNA, 20 bp, Artificial Sequence
  sgRNA
gctgaaatctgaagattctg

SEQ ID NO: 20181 - DNA, 20 bp, Artificial Sequence
  sgRNA
actgtcatgtcaagaccatg

SEQ ID NO: 20182 - DNA, 20 bp, Artificial Sequence
  sgRNA
ataactgaccaaatgacaca

SEQ ID NO: 20183 - DNA, 20 bp, Artificial Sequence
  sgRNA
ggccgcatggctaggcaggc

SEQ ID NO: 20184 - DNA, 20 bp, Artificial Sequence
  sgRNA
gcgaggccggacggccgtct

SEQ ID NO: 20185 - DNA, 20 bp, Artificial Sequence
  sgRNA
cccgctcaggccgttgtggc

SEQ ID NO: 20186 - DNA, 20 bp, Artificial Sequence
  sgRNA
gtactgctccctaagctcta

SEQ ID NO: 20187 - DNA, 20 bp, Artificial Sequence
  sgRNA
cttgctcccagcagaactgg

SEQ ID NO: 20188 - DNA, 20 bp, Artificial Sequence
  sgRNA
acatgaaactaatacggaaa

SEQ ID NO: 20189 - DNA, 20 bp, Artificial Sequence
  sgRNA
agcgcgtcgtagcggaagcc

SEQ ID NO: 20190 - DNA, 20 bp, Artificial Sequence
  sgRNA
gtccgaatacgcttagaggg

SEQ ID NO: 20191 - DNA, 20 bp, Artificial Sequence
  sgRNA
gggccacgaatctggcccgc

SEQ ID NO: 20192 - DNA, 20 bp, Artificial Sequence
  sgRNA
ggcgatccggagcattccgt

SEQ ID NO: 20193 - DNA, 20 bp, Artificial Sequence
  sgRNA
aggctgtccagcagcgggcg

SEQ ID NO: 20194 - DNA, 20 bp, Artificial Sequence
  sgRNA
gagctcgggccgcagctccc

SEQ ID NO: 20195 - DNA, 20 bp, Artificial Sequence
  sgRNA
ccaagcgcaccactacaccc

SEQ ID NO: 20196 - DNA, 20 bp, Artificial Sequence
  sgRNA
gggagcgtacagctggtcgg

SEQ ID NO: 20197 - DNA, 20 bp, Artificial Sequence
  sgRNA
atggcctggcccgggcgttg

SEQ ID NO: 20198 - DNA, 20 bp, Artificial Sequence
  sgRNA
tcaacacatgtgtcctctgg

SEQ ID NO: 20199 - DNA, 20 bp, Artificial Sequence
  sgRNA
ttgttctcggctgggaacac

SEQ ID NO: 20200 - DNA, 20 bp, Artificial Sequence
  sgRNA
cagagcatttacattcggct

SEQ ID NO: 20201 - DNA, 20 bp, Artificial Sequence
  sgRNA
gggtcgcgttccacgttcat

SEQ ID NO: 20202 - DNA, 20 bp, Artificial Sequence
  sgRNA
ggtagaccaatgaaagtgaa

SEQ ID NO: 20203 - DNA, 20 bp, Artificial Sequence
  sgRNA
acgcttggatgattggctgc

SEQ ID NO: 20204 - DNA, 20 bp, Artificial Sequence
  sgRNA
agtctttcttagtgatgatt

SEQ ID NO: 20205 - DNA, 20 bp, Artificial Sequence
  sgRNA
tcaggcgagctgggacttcc

SEQ ID NO: 20206 - DNA, 20 bp, Artificial Sequence
  sgRNA
gctgactcataccacatgag

SEQ ID NO: 20207 - DNA, 20 bp, Artificial Sequence
  sgRNA
cccgtctggaacttagagga

SEQ ID NO: 20208 - DNA, 20 bp, Artificial Sequence
  sgRNA
gggaggcctctttccttccc

SEQ ID NO: 20209 - DNA, 20 bp, Artificial Sequence
  sgRNA
ctaaggaacgcagcagtttc

SEQ ID NO: 20210 - DNA, 20 bp, Artificial Sequence
  sgRNA
agcacggtgagcagctttat

SEQ ID NO: 20211 - DNA, 20 bp, Artificial Sequence
  sgRNA
cctaccgtgcgcgcatccct

SEQ ID NO: 20212 - DNA, 20 bp, Artificial Sequence
  sgRNA
acagccgtaaccaagagcca

SEQ ID NO: 20213 - DNA, 20 bp, Artificial Sequence
  sgRNA
acctgagatcggagttagtt

SEQ ID NO: 20214 - DNA, 20 bp, Artificial Sequence
  sgRNA
gatggtgggattgaacaccg

SEQ ID NO: 20215 - DNA, 20 bp, Artificial Sequence
  sgRNA
tctggaaagctaccgagagc

SEQ ID NO: 20216 - DNA, 20 bp, Artificial Sequence
  sgRNA
tcctctgtctttgcacagac

SEQ ID NO: 20217 - DNA, 20 bp, Artificial Sequence
  sgRNA
ggacgcttggttctcagccc

SEQ ID NO: 20218 - DNA, 20 bp, Artificial Sequence
  sgRNA
tgtctagcccgactgccctg

SEQ ID NO: 20219 - DNA, 20 bp, Artificial Sequence
  sgRNA
tccttcgcagtcctggacgc

SEQ ID NO: 20220 - DNA, 20 bp, Artificial Sequence
  sgRNA
cctggccgcttccgctcccg

SEQ ID NO: 20221 - DNA, 20 bp, Artificial Sequence
  sgRNA
tttgctctttctgtttctca

SEQ ID NO: 20222 - DNA, 20 bp, Artificial Sequence
  sgRNA
gacagggagaggagggaagg

SEQ ID NO: 20223 - DNA, 20 bp, Artificial Sequence
  sgRNA
atcagcgcatgcgcactgtc

SEQ ID NO: 20224 - DNA, 20 bp, Artificial Sequence
  sgRNA
ctgatttggcgcgctgccct

SEQ ID NO: 20225 - DNA, 20 bp, Artificial Sequence
  sgRNA
ggtggcaattccgctccgtc

SEQ ID NO: 20226 - DNA, 20 bp, Artificial Sequence
  sgRNA
cactgctagagactcgattc

SEQ ID NO: 20227 - DNA, 20 bp, Artificial Sequence
  sgRNA
actagttctcttgcgcgcct

SEQ ID NO: 20228 - DNA, 20 bp, Artificial Sequence
  sgRNA
agttccacacgagggacgca

SEQ ID NO: 20229 - DNA, 20 bp, Artificial Sequence
  sgRNA
ggaggttaggtcccattcag

SEQ ID NO: 20230 - DNA, 20 bp, Artificial Sequence
  sgRNA
cggctgataatggacgcttc

SEQ ID NO: 20231 - DNA, 20 bp, Artificial Sequence
  sgRNA
cctacggaagccctcggcac

SEQ ID NO: 20232 - DNA, 20 bp, Artificial Sequence
  sgRNA
gcactcacctccgcgcaatc

SEQ ID NO: 20233 - DNA, 20 bp, Artificial Sequence
  sgRNA
ctccttccagctctagagag

SEQ ID NO: 20234 - DNA, 20 bp, Artificial Sequence
  sgRNA
cccaccgaacccgagcatgc

SEQ ID NO: 20235 - DNA, 20 bp, Artificial Sequence
  sgRNA
attagcaacctgacagaacc

SEQ ID NO: 20236 - DNA, 20 bp, Artificial Sequence
  sgRNA
actacccacgcgtgttctct

SEQ ID NO: 20237 - DNA, 20 bp, Artificial Sequence
  sgRNA
ggcgcgtggccaatcaagcc

SEQ ID NO: 20238 - DNA, 20 bp, Artificial Sequence
  sgRNA
cctctgtcctggccgcttcg

SEQ ID NO: 20239 - DNA, 20 bp, Artificial Sequence
  sgRNA
agccacgctgggcggcgctg

SEQ ID NO: 20240 - DNA, 20 bp, Artificial Sequence
  sgRNA
tgggctggcggcaatctggt

SEQ ID NO: 20241 - DNA, 20 bp, Artificial Sequence
  sgRNA
ggcggtgcgctctgagtcac

SEQ ID NO: 20242 - DNA, 20 bp, Artificial Sequence
  sgRNA
ccgggtgacccagcaggtcg

SEQ ID NO: 20243 - DNA, 20 bp, Artificial Sequence
  sgRNA
ttgtgaagggtatttcccat

SEQ ID NO: 20244 - DNA, 20 bp, Artificial Sequence
  sgRNA
atttatagacctgcgggaaa

SEQ ID NO: 20245 - DNA, 20 bp, Artificial Sequence
  sgRNA
taatctacctgagctggcag

SEQ ID NO: 20246 - DNA, 20 bp, Artificial Sequence
  sgRNA
ctctcgaagagggcgtgtcc

SEQ ID NO: 20247 - DNA, 20 bp, Artificial Sequence
  sgRNA
tcacgaggcgctggcggcgt

SEQ ID NO: 20248 - DNA, 20 bp, Artificial Sequence
  sgRNA
cgggagcgccgctcagccaa

SEQ ID NO: 20249 - DNA, 20 bp, Artificial Sequence
  sgRNA
gctgtcatctgtgggagctc

SEQ ID NO: 20250 - DNA, 20 bp, Artificial Sequence
  sgRNA
ttggcatgtaggacacatgt

SEQ ID NO: 20251 - DNA, 20 bp, Artificial Sequence
  sgRNA
gcggtctccaccgtggccag

SEQ ID NO: 20252 - DNA, 20 bp, Artificial Sequence
  sgRNA
cagcaggtgcgggctgggat

SEQ ID NO: 20253 - DNA, 20 bp, Artificial Sequence
  sgRNA
ggtccgggttgtaagggtcc

SEQ ID NO: 20254 - DNA, 20 bp, Artificial Sequence
  sgRNA
gtgtgacgagcctggaggag

SEQ ID NO: 20255 - DNA, 20 bp, Artificial Sequence
  sgRNA
gagaacgccctagagcctgg

SEQ ID NO: 20256 - DNA, 20 bp, Artificial Sequence
  sgRNA
tgtagaagaggccgagcctg

SEQ ID NO: 20257 - DNA, 20 bp, Artificial Sequence
  sgRNA
ggcaagctgggcgctttagg

SEQ ID NO: 20258 - DNA, 20 bp, Artificial Sequence
  sgRNA
gggacgttggttccctgcac

SEQ ID NO: 20259 - DNA, 20 bp, Artificial Sequence
  sgRNA
gcgtcactcaacaggtctgt

SEQ ID NO: 20260 - DNA, 20 bp, Artificial Sequence
  sgRNA
cgttccctgtagagttctag

SEQ ID NO: 20261 - DNA, 20 bp, Artificial Sequence
  sgRNA
gagcccaagtccctgtgtgg

SEQ ID NO: 20262 - DNA, 20 bp, Artificial Sequence
  sgRNA
cagaggccaacctgtcctct

SEQ ID NO: 20263 - DNA, 20 bp, Artificial Sequence
  sgRNA
gcatggcaaccgctctctga

SEQ ID NO: 20264 - DNA, 20 bp, Artificial Sequence
  sgRNA
cgtagcgcggtcaggaagcc

SEQ ID NO: 20265 - DNA, 20 bp, Artificial Sequence
  sgRNA
acatcccgtgggagggcgag

SEQ ID NO: 20266 - DNA, 20 bp, Artificial Sequence
  sgRNA
gtcggaccaatcgtagccgg

SEQ ID NO: 20267 - DNA, 20 bp, Artificial Sequence
  sgRNA
gaaacaatagctcctaatag

SEQ ID NO: 20268 - DNA, 20 bp, Artificial Sequence
  sgRNA
gtggttctgccgcaatggca

SEQ ID NO: 20269 - DNA, 20 bp, Artificial Sequence
  sgRNA
atgaactattatagctcaag

SEQ ID NO: 20270 - DNA, 20 bp, Artificial Sequence
  sgRNA
ggccgcggagggcggactcg

SEQ ID NO: 20271 - DNA, 20 bp, Artificial Sequence
  sgRNA
gagggtttgtaggacagcac

SEQ ID NO: 20272 - DNA, 20 bp, Artificial Sequence
  sgRNA
gggcgctgcgagccggcgct

SEQ ID NO: 20273 - DNA, 20 bp, Artificial Sequence
  sgRNA
ggttgttgtctccggcttgg

SEQ ID NO: 20274 - DNA, 20 bp, Artificial Sequence
  sgRNA
tgcctgcctgctatagggcc

SEQ ID NO: 20275 - DNA, 20 bp, Artificial Sequence
  sgRNA
tgaagcggaggctgcttccc

SEQ ID NO: 20276 - DNA, 20 bp, Artificial Sequence
  sgRNA
cagacgcgagagctgggcgg

SEQ ID NO: 20277 - DNA, 20 bp, Artificial Sequence
  sgRNA
caattggtccctccgagagg

SEQ ID NO: 20278 - DNA, 20 bp, Artificial Sequence
  sgRNA
cgagcacgacaagagcgcct

SEQ ID NO: 20279 - DNA, 20 bp, Artificial Sequence
  sgRNA
tggccaatttatgacgcctc

SEQ ID NO: 20280 - DNA, 20 bp, Artificial Sequence
  sgRNA
aggcgggtgggatccagggc

SEQ ID NO: 20281 - DNA, 20 bp, Artificial Sequence
  sgRNA
gcgtgcaggctgagctgcta

SEQ ID NO: 20282 - DNA, 20 bp, Artificial Sequence
  sgRNA
ccaggactgggcgctgagtg

SEQ ID NO: 20283 - DNA, 20 bp, Artificial Sequence
  sgRNA
gccgcggctggctgagcccg

SEQ ID NO: 20284 - DNA, 20 bp, Artificial Sequence
  sgRNA
gggactggccgggtcggtgc

SEQ ID NO: 20285 - DNA, 20 bp, Artificial Sequence
  sgRNA
ggctaataatagactgatta

SEQ ID NO: 20286 - DNA, 20 bp, Artificial Sequence
  sgRNA
tgactcgtcttgttctattt

SEQ ID NO: 20287 - DNA, 20 bp, Artificial Sequence
  sgRNA
gttattaggaccaattaaga

SEQ ID NO: 20288 - DNA, 20 bp, Artificial Sequence
  sgRNA
aaaggatagcaatggcatgc

SEQ ID NO: 20289 - DNA, 20 bp, Artificial Sequence
  sgRNA
ctgcagagccgtcatcagcc

SEQ ID NO: 20290 - DNA, 20 bp, Artificial Sequence
  sgRNA
ccgcctcaggtttctgaccc

SEQ ID NO: 20291 - DNA, 20 bp, Artificial Sequence
  sgRNA
cgctgggcgggcccgtattg

SEQ ID NO: 20292 - DNA, 20 bp, Artificial Sequence
  sgRNA
cagagtcgctgattggtcag

SEQ ID NO: 20293 - DNA, 20 bp, Artificial Sequence
  sgRNA
ccgttggcccggtctggtct

SEQ ID NO: 20294 - DNA, 20 bp, Artificial Sequence
  sgRNA
gaaactctgaaatgtctcaa

SEQ ID NO: 20295 - DNA, 20 bp, Artificial Sequence
  sgRNA
aaatgagctaagactgggtc

SEQ ID NO: 20296 - DNA, 20 bp, Artificial Sequence
  sgRNA
aaacttctgcctccaatgca

SEQ ID NO: 20297 - DNA, 20 bp, Artificial Sequence
  sgRNA
gttcaatcgataaacatctg

SEQ ID NO: 20298 - DNA, 20 bp, Artificial Sequence
  sgRNA
cttattcgaggctagagctc

SEQ ID NO: 20299 - DNA, 20 bp, Artificial Sequence
  sgRNA
tttgttcttacgagacgaga

SEQ ID NO: 20300 - DNA, 20 bp, Artificial Sequence
  sgRNA
ctgagcatgcgtgctgcgcg

SEQ ID NO: 20301 - DNA, 20 bp, Artificial Sequence
  sgRNA
gggaaatgtagtctcaacgc

SEQ ID NO: 20302 - DNA, 20 bp, Artificial Sequence
  sgRNA
ctgacggccgctgggcacgc

SEQ ID NO: 20303 - DNA, 20 bp, Artificial Sequence
  sgRNA
ctggccatgtggctgtataa

SEQ ID NO: 20304 - DNA, 20 bp, Artificial Sequence
  sgRNA
taactggcaccgccctgcgg

SEQ ID NO: 20305 - DNA, 20 bp, Artificial Sequence
  sgRNA
taaatgttgctctccagctt

SEQ ID NO: 20306 - DNA, 20 bp, Artificial Sequence
  sgRNA
gtagctaggtaacaagcact

SEQ ID NO: 20307 - DNA, 20 bp, Artificial Sequence
  sgRNA
tgccttacaattggatctca

SEQ ID NO: 20308 - DNA, 20 bp, Artificial Sequence
  sgRNA
tcttggttctataatagagc

SEQ ID NO: 20309 - DNA, 20 bp, Artificial Sequence
  sgRNA
ccgcgtggcgcgacgcaccc

SEQ ID NO: 20310 - DNA, 20 bp, Artificial Sequence
  sgRNA
gtgaaagctctaacagaatg

SEQ ID NO: 20311 - DNA, 20 bp, Artificial Sequence
  sgRNA
gggaagtgtagtcgcatctg

SEQ ID NO: 20312 - DNA, 20 bp, Artificial Sequence
  sgRNA
ggaatctcggagtcgctcca

SEQ ID NO: 20313 - DNA, 20 bp, Artificial Sequence
  sgRNA
cggttactaaggagtgggtg

SEQ ID NO: 20314 - DNA, 20 bp, Artificial Sequence
  sgRNA
gaggcgatgtccctgtcagg

SEQ ID NO: 20315 - DNA, 20 bp, Artificial Sequence
  sgRNA
ctcgcgggcagatgcaggtg

SEQ ID NO: 20316 - DNA, 20 bp, Artificial Sequence
  sgRNA
ggagggaagggaagaccggt

SEQ ID NO: 20317 - DNA, 20 bp, Artificial Sequence
  sgRNA
acaaagcacacgggcggcgc

SEQ ID NO: 20318 - DNA, 20 bp, Artificial Sequence
  sgRNA
ttgtacactctgggcggcgg

SEQ ID NO: 20319 - DNA, 20 bp, Artificial Sequence
  sgRNA
aaaggcgtacttggcctagg

SEQ ID NO: 20320 - DNA, 20 bp, Artificial Sequence
  sgRNA
cgcggactacgactcccgcc

SEQ ID NO: 20321 - DNA, 20 bp, Artificial Sequence
  sgRNA
agctgaaaggtaagcagagg

SEQ ID NO: 20322 - DNA, 20 bp, Artificial Sequence
  sgRNA
cgccgcccgccctgcctacg

SEQ ID NO: 20323 - DNA, 20 bp, Artificial Sequence
  sgRNA
ggcccagcccgccgccctac

SEQ ID NO: 20324 - DNA, 20 bp, Artificial Sequence
  sgRNA
gaggccgtgacgggaggcgg

SEQ ID NO: 20325 - DNA, 20 bp, Artificial Sequence
  sgRNA
gcgcggagcgacgggcagag

SEQ ID NO: 20326 - DNA, 20 bp, Artificial Sequence
  sgRNA
cccgcccgggtccgggcctt

SEQ ID NO: 20327 - DNA, 20 bp, Artificial Sequence
  sgRNA
cgagttagtttgcactatcc

SEQ ID NO: 20328 - DNA, 20 bp, Artificial Sequence
  sgRNA
ctatcccggactttaacatt

SEQ ID NO: 20329 - DNA, 20 bp, Artificial Sequence
  sgRNA
aaaggctgatgagctgtggt

SEQ ID NO: 20330 - DNA, 20 bp, Artificial Sequence
  sgRNA
catctggcaccagtgtgtgg

SEQ ID NO: 20331 - DNA, 20 bp, Artificial Sequence
  sgRNA
gactcggccaaagatttagc

SEQ ID NO: 20332 - DNA, 20 bp, Artificial Sequence
  sgRNA
ttctctggctgctggagcgc

SEQ ID NO: 20333 - DNA, 20 bp, Artificial Sequence
  sgRNA
gtggcctgactggttaggat

SEQ ID NO: 20334 - DNA, 20 bp, Artificial Sequence
  sgRNA
gagttcagcacaccagagcg

SEQ ID NO: 20335 - DNA, 20 bp, Artificial Sequence
  sgRNA
gaatgggagtccgcagtagg

SEQ ID NO: 20336 - DNA, 20 bp, Artificial Sequence
  sgRNA
tacggtggctggcgcggatc

SEQ ID NO: 20337 - DNA, 20 bp, Artificial Sequence
  sgRNA
gaagggtactcggtggaggc

SEQ ID NO: 20338 - DNA, 20 bp, Artificial Sequence
  sgRNA
tcttctcgcgcgaagggtct

SEQ ID NO: 20339 - DNA, 20 bp, Artificial Sequence
  sgRNA
tggagagacgacccaatcca

SEQ ID NO: 20340 - DNA, 20 bp, Artificial Sequence
  sgRNA
cacacctcttcgcgcatgct

SEQ ID NO: 20341 - DNA, 20 bp, Artificial Sequence
  sgRNA
ccgggctgtgagtttgcatc

SEQ ID NO: 20342 - DNA, 20 bp, Artificial Sequence
  sgRNA
ctcggtcgcgtggagtgcaa

SEQ ID NO: 20343 - DNA, 20 bp, Artificial Sequence
  sgRNA
gagactatgccatcagcgaa

SEQ ID NO: 20344 - DNA, 20 bp, Artificial Sequence
  sgRNA
catttgtgcggctacattta

SEQ ID NO: 20345 - DNA, 20 bp, Artificial Sequence
  sgRNA
ccggaagcgcctttgggtag

SEQ ID NO: 20346 - DNA, 20 bp, Artificial Sequence
  sgRNA
agtgagtttcataacaaaca

SEQ ID NO: 20347 - DNA, 20 bp, Artificial Sequence
  sgRNA
aattctcccgcgagggtatc

SEQ ID NO: 20348 - DNA, 20 bp, Artificial Sequence
  sgRNA
ttagtgtgcccttagcctcc

SEQ ID NO: 20349 - DNA, 20 bp, Artificial Sequence
  sgRNA
cggtaacttggaggtggagt

SEQ ID NO: 20350 - DNA, 20 bp, Artificial Sequence
  sgRNA
tggttaaccaggtatgacac

SEQ ID NO: 20351 - DNA, 20 bp, Artificial Sequence
  sgRNA
cacaatctgcttgtgcaagc

SEQ ID NO: 20352 - DNA, 20 bp, Artificial Sequence
  sgRNA
actctgcatagttcctgttt

SEQ ID NO: 20353 - DNA, 20 bp, Artificial Sequence
  sgRNA
tgcttcgtaatggaaggcag

SEQ ID NO: 20354 - DNA, 20 bp, Artificial Sequence
  sgRNA
gggaagccctgcaggttgta

SEQ ID NO: 20355 - DNA, 20 bp, Artificial Sequence
  sgRNA
cgaactccgccgtcccagat

SEQ ID NO: 20356 - DNA, 20 bp, Artificial Sequence
  sgRNA
gcgcgagtctcattgttggg

SEQ ID NO: 20357 - DNA, 20 bp, Artificial Sequence
  sgRNA
gccggcgagcggcgcggaag

SEQ ID NO: 20358 - DNA, 20 bp, Artificial Sequence
  sgRNA
gagggcgagagcacggcggg

SEQ ID NO: 20359 - DNA, 20 bp, Artificial Sequence
  sgRNA
gacgcggactacccgcgagc

SEQ ID NO: 20360 - DNA, 20 bp, Artificial Sequence
  sgRNA
ggcccgggacccggcgggcc

SEQ ID NO: 20361 - DNA, 20 bp, Artificial Sequence
  sgRNA
ggcggaggcggactccgacg

SEQ ID NO: 20362 - DNA, 20 bp, Artificial Sequence
  sgRNA
aagcgcctaactttacatct

SEQ ID NO: 20363 - DNA, 20 bp, Artificial Sequence
  sgRNA
aatggtccacgtcacgtgaa

SEQ ID NO: 20364 - DNA, 20 bp, Artificial Sequence
  sgRNA
cccacttccgggcgatgcca

SEQ ID NO: 20365 - DNA, 20 bp, Artificial Sequence
  sgRNA
ggaagatagttccgagggtg

SEQ ID NO: 20366 - DNA, 20 bp, Artificial Sequence
  sgRNA
gaaggagcgcgcgaaagggt

SEQ ID NO: 20367 - DNA, 20 bp, Artificial Sequence
  sgRNA
gaggtgctaagcagacgtcc

SEQ ID NO: 20368 - DNA, 20 bp, Artificial Sequence
  sgRNA
ttccacaaaccacagattta

SEQ ID NO: 20369 - DNA, 20 bp, Artificial Sequence
  sgRNA
ctgtcagctagctacagatg

SEQ ID NO: 20370 - DNA, 20 bp, Artificial Sequence
  sgRNA
gggatggagacggtgaacaa

SEQ ID NO: 20371 - DNA, 20 bp, Artificial Sequence
  sgRNA
ttacccaagcgcagtgtgcg

SEQ ID NO: 20372 - DNA, 20 bp, Artificial Sequence
  sgRNA
cctgtagcacgcatgcgtct

SEQ ID NO: 20373 - DNA, 20 bp, Artificial Sequence
  sgRNA
acgacgtaggcgcgcctcgc

SEQ ID NO: 20374 - DNA, 20 bp, Artificial Sequence
  sgRNA
aggaagtacaataaaccaca

SEQ ID NO: 20375 - DNA, 20 bp, Artificial Sequence
  sgRNA
aggagaacaggccctctggg

SEQ ID NO: 20376 - DNA, 20 bp, Artificial Sequence
  sgRNA
tgggccctcctccatttgcg

SEQ ID NO: 20377 - DNA, 20 bp, Artificial Sequence
  sgRNA
gtattgcgcgaagtgtgtga

SEQ ID NO: 20378 - DNA, 20 bp, Artificial Sequence
  sgRNA
aagatgattggttgccattc

SEQ ID NO: 20379 - DNA, 20 bp, Artificial Sequence
  sgRNA
catgcgcttcttctgatttc

SEQ ID NO: 20380 - DNA, 20 bp, Artificial Sequence
  sgRNA
cgcgttcgaactggcgcttg

SEQ ID NO: 20381 - DNA, 20 bp, Artificial Sequence
  sgRNA
ggcggttcattctccaccaa

SEQ ID NO: 20382 - DNA, 20 bp, Artificial Sequence
  sgRNA
cctgtcacctctcctctaaa

SEQ ID NO: 20383 - DNA, 20 bp, Artificial Sequence
  sgRNA
gagcgttggccaggcgctgg

SEQ ID NO: 20384 - DNA, 20 bp, Artificial Sequence
  sgRNA
gcacgcgaccgggagcgatg

SEQ ID NO: 20385 - DNA, 20 bp, Artificial Sequence
  sgRNA
ggactctgggcgcctggtgc

SEQ ID NO: 20386 - DNA, 20 bp, Artificial Sequence
  sgRNA
caaagtggtacagcccgtgg

SEQ ID NO: 20387 - DNA, 20 bp, Artificial Sequence
  sgRNA
caaggctgagcgttgggccc

SEQ ID NO: 20388 - DNA, 20 bp, Artificial Sequence
  sgRNA
ggcagcccttggacaattta

SEQ ID NO: 20389 - DNA, 20 bp, Artificial Sequence
  sgRNA
gggatgtggctagaatctcc

SEQ ID NO: 20390 - DNA, 20 bp, Artificial Sequence
  sgRNA
gctttgtagatgggtgacat

SEQ ID NO: 20391 - DNA, 20 bp, Artificial Sequence
  sgRNA
aaggtgcaaggtgactacgt

SEQ ID NO: 20392 - DNA, 20 bp, Artificial Sequence
  sgRNA
gagcatctctgacaatctgc

SEQ ID NO: 20393 - DNA, 20 bp, Artificial Sequence
  sgRNA
gcgcgacctcccgacacacg

SEQ ID NO: 20394 - DNA, 20 bp, Artificial Sequence
  sgRNA
gggcgctgtcgcagcacggc

SEQ ID NO: 20395 - DNA, 20 bp, Artificial Sequence
  sgRNA
acgatgtttgaggctaactt

SEQ ID NO: 20396 - DNA, 20 bp, Artificial Sequence
  sgRNA
ctagtgatcaaatttcagtt

SEQ ID NO: 20397 - DNA, 20 bp, Artificial Sequence
  sgRNA
taatgttatggctttgaaac

SEQ ID NO: 20398 - DNA, 20 bp, Artificial Sequence
  sgRNA
ggagggaggaccactcagtt

SEQ ID NO: 20399 - DNA, 20 bp, Artificial Sequence
  sgRNA
agcaaggtttgttggtgatc

SEQ ID NO: 20400 - DNA, 20 bp, Artificial Sequence
  sgRNA
agcaagatttatagctgttg

SEQ ID NO: 20401 - DNA, 20 bp, Artificial Sequence
  sgRNA
aacacggcggcgtgtttcca

SEQ ID NO: 20402 - DNA, 20 bp, Artificial Sequence
  sgRNA
gtcatgctggctgtattagg

SEQ ID NO: 20403 - DNA, 20 bp, Artificial Sequence
  sgRNA
ggcagacaacagcagcgaat

SEQ ID NO: 20404 - DNA, 20 bp, Artificial Sequence
  sgRNA
gttacgtttcaggcagcgga

SEQ ID NO: 20405 - DNA, 20 bp, Artificial Sequence
  sgRNA
gctcaacgctggtttcttat

SEQ ID NO: 20406 - DNA, 20 bp, Artificial Sequence
  sgRNA
tcggacaggtttggcgccac

SEQ ID NO: 20407 - DNA, 20 bp, Artificial Sequence
  sgRNA
gcccggagcggaccctatgc

SEQ ID NO: 20408 - DNA, 20 bp, Artificial Sequence
  sgRNA
aggactgctgatcctcctca

SEQ ID NO: 20409 - DNA, 20 bp, Artificial Sequence
  sgRNA
catccgggccagggatactc

SEQ ID NO: 20410 - DNA, 20 bp, Artificial Sequence
  sgRNA
tttagtgggcacgctttcaa

SEQ ID NO: 20411 - DNA, 20 bp, Artificial Sequence
  sgRNA
ccctggctataatttaagcc

SEQ ID NO: 20412 - DNA, 20 bp, Artificial Sequence
  sgRNA
tgcaacagtgcaacgtaaac

SEQ ID NO: 20413 - DNA, 20 bp, Artificial Sequence
  sgRNA
tccaacaatgaccctagtcc

SEQ ID NO: 20414 - DNA, 20 bp, Artificial Sequence
  sgRNA
gtgaagggtctcaagaaatt

SEQ ID NO: 20415 - DNA, 20 bp, Artificial Sequence
  sgRNA
aggcgcaacacaatccacgg

SEQ ID NO: 20416 - DNA, 20 bp, Artificial Sequence
  sgRNA
tcactagggctatttgttag

SEQ ID NO: 20417 - DNA, 20 bp, Artificial Sequence
  sgRNA
cctagcggcccagattccct

SEQ ID NO: 20418 - DNA, 20 bp, Artificial Sequence
  sgRNA
gcaggcgggaagtaaaggtc

SEQ ID NO: 20419 - DNA, 20 bp, Artificial Sequence
  sgRNA
tttcgggtcaggcagtgcgc

SEQ ID NO: 20420 - DNA, 20 bp, Artificial Sequence
  sgRNA
cccggcttcccaccattaga

SEQ ID NO: 20421 - DNA, 20 bp, Artificial Sequence
  sgRNA
ggcaagcgagcaagggacgt

SEQ ID NO: 20422 - DNA, 20 bp, Artificial Sequence
  sgRNA
gggctttaaactggaggctc

SEQ ID NO: 20423 - DNA, 20 bp, Artificial Sequence
  sgRNA
tcaggtttccagggtggttg

SEQ ID NO: 20424 - DNA, 20 bp, Artificial Sequence
  sgRNA
gacagctcccaagattgacc

SEQ ID NO: 20425 - DNA, 20 bp, Artificial Sequence
  sgRNA
gtccctgtcctgtggatctg

SEQ ID NO: 20426 - DNA, 20 bp, Artificial Sequence
  sgRNA
agtggcttatcagactgtgc

SEQ ID NO: 20427 - DNA, 20 bp, Artificial Sequence
  sgRNA
cccggatgcgattgctcaga

SEQ ID NO: 20428 - DNA, 20 bp, Artificial Sequence
  sgRNA
ccagaaacaaggagctcgtc

SEQ ID NO: 20429 - DNA, 20 bp, Artificial Sequence
  sgRNA
ggaagggcgggcgaggttgg

SEQ ID NO: 20430 - DNA, 20 bp, Artificial Sequence
  sgRNA
tgcggaagagccacgtttct

SEQ ID NO: 20431 - DNA, 20 bp, Artificial Sequence
  sgRNA
gggagcatgttgtgtctttc

SEQ ID NO: 20432 - DNA, 20 bp, Artificial Sequence
  sgRNA
ttcacgctcagtggcgttta

SEQ ID NO: 20433 - DNA, 20 bp, Artificial Sequence
  sgRNA
tgaggaaacacgttctctat

SEQ ID NO: 20434 - DNA, 20 bp, Artificial Sequence
  sgRNA
agggacagcagcgcctccgc

SEQ ID NO: 20435 - DNA, 20 bp, Artificial Sequence
  sgRNA
gaatggagcgagcaagcgag

SEQ ID NO: 20436 - DNA, 20 bp, Artificial Sequence
  sgRNA
cgcctcctggcagcccgcgg

SEQ ID NO: 20437 - DNA, 20 bp, Artificial Sequence
  sgRNA
cacccagtcaacggactggc

SEQ ID NO: 20438 - DNA, 20 bp, Artificial Sequence
  sgRNA
aaggaagaagactcttgttg

SEQ ID NO: 20439 - DNA, 20 bp, Artificial Sequence
  sgRNA
atgtgggcccagtctggccc

SEQ ID NO: 20440 - DNA, 20 bp, Artificial Sequence
  sgRNA
agtgttggcaagtcgctgat

SEQ ID NO: 20441 - DNA, 20 bp, Artificial Sequence
  sgRNA
ctccttcacgttagatacct

SEQ ID NO: 20442 - DNA, 20 bp, Artificial Sequence
  sgRNA
actcaagagctagccgtgat

SEQ ID NO: 20443 - DNA, 20 bp, Artificial Sequence
  sgRNA
atggcattggccattggcgg

SEQ ID NO: 20444 - DNA, 20 bp, Artificial Sequence
  sgRNA
tgagcccttccttgcaaggt

SEQ ID NO: 20445 - DNA, 20 bp, Artificial Sequence
  sgRNA
cggcttgtttgtgagagaag

SEQ ID NO: 20446 - DNA, 20 bp, Artificial Sequence
  sgRNA
aaggaccgccaggcgccctg

SEQ ID NO: 20447 - DNA, 20 bp, Artificial Sequence
  sgRNA
cccatcaatggtcctgcttg

SEQ ID NO: 20448 - DNA, 20 bp, Artificial Sequence
  sgRNA
tacaaggcaaactgcctctg

SEQ ID NO: 20449 - DNA, 20 bp, Artificial Sequence
  sgRNA
agaattggaagagagatgac

SEQ ID NO: 20450 - DNA, 20 bp, Artificial Sequence
  sgRNA
ccgaggtctccttgtgtccc

SEQ ID NO: 20451 - DNA, 20 bp, Artificial Sequence
  sgRNA
gattaagacaactgtgaacc

SEQ ID NO: 20452 - DNA, 20 bp, Artificial Sequence
  sgRNA
ttggtctactacagtccttg

SEQ ID NO: 20453 - DNA, 20 bp, Artificial Sequence
  sgRNA
gggtgtggctcatcttgctt

SEQ ID NO: 20454 - DNA, 20 bp, Artificial Sequence
  sgRNA
tgagagtgtgaggaagtggc

SEQ ID NO: 20455 - DNA, 20 bp, Artificial Sequence
  sgRNA
tctggtccagcctcattgag

SEQ ID NO: 20456 - DNA, 20 bp, Artificial Sequence
  sgRNA
gggaatgggattgcagtgac

SEQ ID NO: 20457 - DNA, 20 bp, Artificial Sequence
  sgRNA
gggagcgttgtcatggcaac

SEQ ID NO: 20458 - DNA, 20 bp, Artificial Sequence
  sgRNA
gaggccgcaagctgcgtagg

SEQ ID NO: 20459 - DNA, 20 bp, Artificial Sequence
  sgRNA
catgctcagtgcgaaccgcc

SEQ ID NO: 20460 - DNA, 20 bp, Artificial Sequence
  sgRNA
gaacgctggcatctggagtt

SEQ ID NO: 20461 - DNA, 20 bp, Artificial Sequence
  sgRNA
cgcgaccgggccactaagtg

SEQ ID NO: 20462 - DNA, 20 bp, Artificial Sequence
  sgRNA
agtgctgggcagcctcgcca

SEQ ID NO: 20463 - DNA, 20 bp, Artificial Sequence
  sgRNA
ggcccgatctgtccggcagg

SEQ ID NO: 20464 - DNA, 20 bp, Artificial Sequence
  sgRNA
tgggcaggtgccgcatcagg

SEQ ID NO: 20465 - DNA, 20 bp, Artificial Sequence
  sgRNA
agggcgaggcgatggattgc

SEQ ID NO: 20466 - DNA, 20 bp, Artificial Sequence
  sgRNA
acgcacagcgcgcgctccgg

SEQ ID NO: 20467 - DNA, 20 bp, Artificial Sequence
  sgRNA
gagtacgagcttgatgtttc

SEQ ID NO: 20468 - DNA, 20 bp, Artificial Sequence
  sgRNA
atgatctgtgagagtcataa

SEQ ID NO: 20469 - DNA, 20 bp, Artificial Sequence
  sgRNA
cggtatagagagatcattaa

SEQ ID NO: 20470 - DNA, 20 bp, Artificial Sequence
  sgRNA
gcccaacgttggccagagag

SEQ ID NO: 20471 - DNA, 20 bp, Artificial Sequence
  sgRNA
acctttggtggcggtgggcg

SEQ ID NO: 20472 - DNA, 20 bp, Artificial Sequence
  sgRNA
ggcccacgccttgcacccag

SEQ ID NO: 20473 - DNA, 20 bp, Artificial Sequence
  sgRNA
aagcagctgtttagccctcc

SEQ ID NO: 20474 - DNA, 20 bp, Artificial Sequence
  sgRNA
gcgacacgccctgaaatccc

SEQ ID NO: 20475 - DNA, 20 bp, Artificial Sequence
  sgRNA
tttagctaatttgttgaacc

SEQ ID NO: 20476 - DNA, 20 bp, Artificial Sequence
  sgRNA
attaagaagcaaatgtagtg

SEQ ID NO: 20477 - DNA, 20 bp, Artificial Sequence
  sgRNA
cactattaatattcatgagc

SEQ ID NO: 20478 - DNA, 20 bp, Artificial Sequence
  sgRNA
ggcttggagtttcaaagctg

SEQ ID NO: 20479 - DNA, 20 bp, Artificial Sequence
  sgRNA
ggctcctactttctgtccat

SEQ ID NO: 20480 - DNA, 20 bp, Artificial Sequence
  sgRNA
ctgggcgggccctttgcctg

SEQ ID NO: 20481 - DNA, 20 bp, Artificial Sequence
  sgRNA
gatatgtcacgagaaggtgg

SEQ ID NO: 20482 - DNA, 20 bp, Artificial Sequence
  sgRNA
ttgcggtggccgcagggagg

SEQ ID NO: 20483 - DNA, 20 bp, Artificial Sequence
  sgRNA
gaggaactaactccgaacgc

SEQ ID NO: 20484 - DNA, 20 bp, Artificial Sequence
  sgRNA
tccgccttacagacccttgc

SEQ ID NO: 20485 - DNA, 20 bp, Artificial Sequence
  sgRNA
acatttaaagggacaggctc

SEQ ID NO: 20486 - DNA, 20 bp, Artificial Sequence
  sgRNA
agctaagggtgagagtatag

SEQ ID NO: 20487 - DNA, 20 bp, Artificial Sequence
  sgRNA
taagaggctaggcggcggaa

SEQ ID NO: 20488 - DNA, 20 bp, Artificial Sequence
  sgRNA
gagcagaggtcgctcctccc

SEQ ID NO: 20489 - DNA, 20 bp, Artificial Sequence
  sgRNA
gcacctggaatggctaggcc

SEQ ID NO: 20490 - DNA, 20 bp, Artificial Sequence
  sgRNA
gcccgagggaagggagctat

SEQ ID NO: 20491 - DNA, 20 bp, Artificial Sequence
  sgRNA
atccacgtggcagagggacc

SEQ ID NO: 20492 - DNA, 20 bp, Artificial Sequence
  sgRNA
aaagcccggaccagctatcc

SEQ ID NO: 20493 - DNA, 20 bp, Artificial Sequence
  sgRNA
tgaggaaacaaactcgttca

SEQ ID NO: 20494 - DNA, 20 bp, Artificial Sequence
  sgRNA
ggaacagtgaagggatggga

SEQ ID NO: 20495 - DNA, 20 bp, Artificial Sequence
  sgRNA
cagataaaggttcaaacctg

SEQ ID NO: 20496 - DNA, 20 bp, Artificial Sequence
  sgRNA
taaggaaagacggccctgag

SEQ ID NO: 20497 - DNA, 20 bp, Artificial Sequence
  sgRNA
tgcgattgtgcatttcggaa

SEQ ID NO: 20498 - DNA, 20 bp, Artificial Sequence
  sgRNA
gagtgaactggcaaggtagg

SEQ ID NO: 20499 - DNA, 20 bp, Artificial Sequence
  sgRNA
gatgcttacggagctagccg

SEQ ID NO: 20500 - DNA, 20 bp, Artificial Sequence
  sgRNA
ccattgcgggacagcaccta

SEQ ID NO: 20501 - DNA, 20 bp, Artificial Sequence
  sgRNA
cagtgttctcctgtccaatc

SEQ ID NO: 20502 - DNA, 20 bp, Artificial Sequence
  sgRNA
ggcggtaaatgaaattccgt

SEQ ID NO: 20503 - DNA, 20 bp, Artificial Sequence
  sgRNA
aggacggaccctccctctgc

SEQ ID NO: 20504 - DNA, 20 bp, Artificial Sequence
  sgRNA
gagctacagggctccacgcg

SEQ ID NO: 20505 - DNA, 20 bp, Artificial Sequence
  sgRNA
ctgccgagcagggcgcttac

SEQ ID NO: 20506 - DNA, 20 bp, Artificial Sequence
  sgRNA
cttccgcaaacgcgcctggg

SEQ ID NO: 20507 - DNA, 20 bp, Artificial Sequence
  sgRNA
ggcgcaacagcagaaggagg

SEQ ID NO: 20508 - DNA, 20 bp, Artificial Sequence
  sgRNA
gggaggcctggcagcctgcc

SEQ ID NO: 20509 - DNA, 20 bp, Artificial Sequence
  sgRNA
gtcgaggaagtgtggcctcc

SEQ ID NO: 20510 - DNA, 20 bp, Artificial Sequence
  sgRNA
gtgtacttctcgcgaaatac

SEQ ID NO: 20511 - DNA, 20 bp, Artificial Sequence
  sgRNA
aggatactgtggcggctctc

SEQ ID NO: 20512 - DNA, 20 bp, Artificial Sequence
  sgRNA
aagacaagggagagtaagag

SEQ ID NO: 20513 - DNA, 20 bp, Artificial Sequence
  sgRNA
ctggtttgctcttagggccc

SEQ ID NO: 20514 - DNA, 20 bp, Artificial Sequence
  sgRNA
tgtcctggacaccctactga

SEQ ID NO: 20515 - DNA, 20 bp, Artificial Sequence
  sgRNA
tggcaggaggaaattgcgcg

SEQ ID NO: 20516 - DNA, 20 bp, Artificial Sequence
  sgRNA
gggcgcttgttacggacgcg

SEQ ID NO: 20517 - DNA, 20 bp, Artificial Sequence
  sgRNA
gggaggtggcaagtccgcaa

SEQ ID NO: 20518 - DNA, 20 bp, Artificial Sequence
  sgRNA
tggcttgaatgtttccagtg

SEQ ID NO: 20519 - DNA, 20 bp, Artificial Sequence
  sgRNA
tctcatacccataaccacac

SEQ ID NO: 20520 - DNA, 20 bp, Artificial Sequence
  sgRNA
ctctgagctaattggctgct

SEQ ID NO: 20521 - DNA, 20 bp, Artificial Sequence
  sgRNA
gcgcgcgcaggcggaacctg

SEQ ID NO: 20522 - DNA, 20 bp, Artificial Sequence
  sgRNA
gtggaccattatctcttccc

SEQ ID NO: 20523 - DNA, 20 bp, Artificial Sequence
  sgRNA
ctaggaaatgggagtaggcg

SEQ ID NO: 20524 - DNA, 20 bp, Artificial Sequence
  sgRNA
aggcctgcctcctacatccg

SEQ ID NO: 20525 - DNA, 20 bp, Artificial Sequence
  sgRNA
ggtgttctttggttgcggga

SEQ ID NO: 20526 - DNA, 20 bp, Artificial Sequence
  sgRNA
gcgcgctggcgtctcgagcg

SEQ ID NO: 20527 - DNA, 20 bp, Artificial Sequence
  sgRNA
gtgactcggtgcccaccgcg

SEQ ID NO: 20528 - DNA, 20 bp, Artificial Sequence
  sgRNA
atgggagcatcagttgaggt

SEQ ID NO: 20529 - DNA, 20 bp, Artificial Sequence
  sgRNA
gttgtcaacttgacatatct

SEQ ID NO: 20530 - DNA, 20 bp, Artificial Sequence
  sgRNA
tgaattaagacgcccgcggt

SEQ ID NO: 20531 - DNA, 20 bp, Artificial Sequence
  sgRNA
cagtagtcacacccacccag

SEQ ID NO: 20532 - DNA, 20 bp, Artificial Sequence
  sgRNA
gatcgcttccgccatgggcg

SEQ ID NO: 20533 - DNA, 20 bp, Artificial Sequence
  sgRNA
gctggagatgtagggatggg

SEQ ID NO: 20534 - DNA, 20 bp, Artificial Sequence
  sgRNA
gggagtctcatgctcagatc

SEQ ID NO: 20535 - DNA, 20 bp, Artificial Sequence
  sgRNA
catcaagatccttagggatg

SEQ ID NO: 20536 - DNA, 20 bp, Artificial Sequence
  sgRNA
gggacccaagcgggagccgc

SEQ ID NO: 20537 - DNA, 20 bp, Artificial Sequence
  sgRNA
gggtggagaggccatttaaa

SEQ ID NO: 20538 - DNA, 20 bp, Artificial Sequence
  sgRNA
ctggtgaatctggctgcgtg

SEQ ID NO: 20539 - DNA, 20 bp, Artificial Sequence
  sgRNA
gaatgccgcgcatgcgtgtg

SEQ ID NO: 20540 - DNA, 20 bp, Artificial Sequence
  sgRNA
agtctcaaccagtagcttcg

SEQ ID NO: 20541 - DNA, 20 bp, Artificial Sequence
  sgRNA
gtgtagcagaaatctgagtg

SEQ ID NO: 20542 - DNA, 20 bp, Artificial Sequence
  sgRNA
ccgaatgtttcgcctgtgaa

SEQ ID NO: 20543 - DNA, 20 bp, Artificial Sequence
  sgRNA
aggacgccgtcgggaaacct

SEQ ID NO: 20544 - DNA, 20 bp, Artificial Sequence
  sgRNA
agcggaaacttgtagcctgc

SEQ ID NO: 20545 - DNA, 20 bp, Artificial Sequence
  sgRNA
gcaaggtagcaaggtaggcg

SEQ ID NO: 20546 - DNA, 20 bp, Artificial Sequence
  sgRNA
agttaacaggagtaggatgg

SEQ ID NO: 20547 - DNA, 20 bp, Artificial Sequence
  sgRNA
cgccttgtccagtctcagat

SEQ ID NO: 20548 - DNA, 20 bp, Artificial Sequence
  sgRNA
tcagtccatccctcagcggg

SEQ ID NO: 20549 - DNA, 20 bp, Artificial Sequence
  sgRNA
agcagctcacagtgcgggtg

SEQ ID NO: 20550 - DNA, 20 bp, Artificial Sequence
  sgRNA
cacccgggtggacagatgtc

SEQ ID NO: 20551 - DNA, 20 bp, Artificial Sequence
  sgRNA
tgcgctgaacactcctctcg

SEQ ID NO: 20552 - DNA, 20 bp, Artificial Sequence
  sgRNA
cgcccaggagactacgggcg

SEQ ID NO: 20553 - DNA, 20 bp, Artificial Sequence
  sgRNA
ctgacgtcacgcacgcacac

SEQ ID NO: 20554 - DNA, 20 bp, Artificial Sequence
  sgRNA
gggtctccggccggacagcg

SEQ ID NO: 20555 - DNA, 20 bp, Artificial Sequence
  sgRNA
tgtagaattggaactactag

SEQ ID NO: 20556 - DNA, 20 bp, Artificial Sequence
  sgRNA
cgcaagcattgtgagaaccg

SEQ ID NO: 20557 - DNA, 20 bp, Artificial Sequence
  sgRNA
gtctggacatgtgagacagt

SEQ ID NO: 20558 - DNA, 20 bp, Artificial Sequence
  sgRNA
agtagaccactcagtgttgg

SEQ ID NO: 20559 - DNA, 20 bp, Artificial Sequence
  sgRNA
cttctgatgagggtgtggcc

SEQ ID NO: 20560 - DNA, 20 bp, Artificial Sequence
  sgRNA
gacttggagaggcggtgccg

SEQ ID NO: 20561 - DNA, 20 bp, Artificial Sequence
  sgRNA
ctgcgcgcaccgcgggaacc

SEQ ID NO: 20562 - DNA, 20 bp, Artificial Sequence
  sgRNA
aggcgtgtcgggcgtcggcg

SEQ ID NO: 20563 - DNA, 20 bp, Artificial Sequence
  sgRNA
aaagggaggtgggaaggaga

SEQ ID NO: 20564 - DNA, 20 bp, Artificial Sequence
  sgRNA
ggaagggtgacgtcactggg

SEQ ID NO: 20565 - DNA, 20 bp, Artificial Sequence
  sgRNA
ctataaaccaggacatagac

SEQ ID NO: 20566 - DNA, 20 bp, Artificial Sequence
  sgRNA
ctgcgcgactaagtttgagc

SEQ ID NO: 20567 - DNA, 20 bp, Artificial Sequence
  sgRNA
caggatggagagttagaaca

SEQ ID NO: 20568 - DNA, 20 bp, Artificial Sequence
  sgRNA
aagtcttgggctcccgtccg

SEQ ID NO: 20569 - DNA, 20 bp, Artificial Sequence
  sgRNA
tttcaagctagcggaggaac

SEQ ID NO: 20570 - DNA, 20 bp, Artificial Sequence
  sgRNA
caggaggccaatcgcgacag

SEQ ID NO: 20571 - DNA, 20 bp, Artificial Sequence
  sgRNA
aggtttgaacagggaattgc

SEQ ID NO: 20572 - DNA, 20 bp, Artificial Sequence
  sgRNA
aataggaaccgcacgcacga

SEQ ID NO: 20573 - DNA, 20 bp, Artificial Sequence
  sgRNA
tcgcaggttggaagttgccc

SEQ ID NO: 20574 - DNA, 20 bp, Artificial Sequence
  sgRNA
actctgcatgcggaagctag

SEQ ID NO: 20575 - DNA, 20 bp, Artificial Sequence
  sgRNA
ggcgtgcggaacacgactga

SEQ ID NO: 20576 - DNA, 20 bp, Artificial Sequence
  sgRNA
agcggaagcgacgctctatc

SEQ ID NO: 20577 - DNA, 20 bp, Artificial Sequence
  sgRNA
accgcctagtgcgtaatacc

SEQ ID NO: 20578 - DNA, 20 bp, Artificial Sequence
  sgRNA
aaaggacagcccggccgcgg

SEQ ID NO: 20579 - DNA, 20 bp, Artificial Sequence
  sgRNA
aactcagatgtgcgagggcg

SEQ ID NO: 20580 - DNA, 20 bp, Artificial Sequence
  sgRNA
gttggagaaacctgttcttc

SEQ ID NO: 20581 - DNA, 20 bp, Artificial Sequence
  sgRNA
gggcaagcacagtcaggaga

SEQ ID NO: 20582 - DNA, 20 bp, Artificial Sequence
  sgRNA
ggcgcccgcgggctgtttaa

SEQ ID NO: 20583 - DNA, 20 bp, Artificial Sequence
  sgRNA
ttgaacgctaagtgctcgga

SEQ ID NO: 20584 - DNA, 20 bp, Artificial Sequence
  sgRNA
ctgtgtttagaagcgttgct

SEQ ID NO: 20585 - DNA, 20 bp, Artificial Sequence
  sgRNA
tatgggtaaaggtgctgagt

SEQ ID NO: 20586 - DNA, 20 bp, Artificial Sequence
  sgRNA
ctagtttacccaaatgagaa

SEQ ID NO: 20587 - DNA, 20 bp, Artificial Sequence
  sgRNA
agtctcgagcgtctcctccc

SEQ ID NO: 20588 - DNA, 20 bp, Artificial Sequence
  sgRNA
ctcgcggctccgctccgctc

SEQ ID NO: 20589 - DNA, 20 bp, Artificial Sequence
  sgRNA
ctctctttctgtcgccgacg

SEQ ID NO: 20590 - DNA, 20 bp, Artificial Sequence
  sgRNA
attaaatcttcccagaggtt

SEQ ID NO: 20591 - DNA, 20 bp, Artificial Sequence
  sgRNA
ttactacgcgtagcttctgg

SEQ ID NO: 20592 - DNA, 20 bp, Artificial Sequence
  sgRNA
aaaggtgacgtgtggtccaa

SEQ ID NO: 20593 - DNA, 20 bp, Artificial Sequence
  sgRNA
agcagcaggatttagaggga

SEQ ID NO: 20594 - DNA, 20 bp, Artificial Sequence
  sgRNA
agaaagccaagagttgggtg

SEQ ID NO: 20595 - DNA, 20 bp, Artificial Sequence
  sgRNA
aaaggtcagatctgtactcc

SEQ ID NO: 20596 - DNA, 20 bp, Artificial Sequence
  sgRNA
gcgcccaacggtgctcgtag

SEQ ID NO: 20597 - DNA, 20 bp, Artificial Sequence
  sgRNA
ccacgtccagtgttggaaga

SEQ ID NO: 20598 - DNA, 20 bp, Artificial Sequence
  sgRNA
gttgaaggcgtctagaaacc

SEQ ID NO: 20599 - DNA, 20 bp, Artificial Sequence
  sgRNA
tttaagccaaagagcggagg

SEQ ID NO: 20600 - DNA, 20 bp, Artificial Sequence
  sgRNA
gtgcagctctggctcgcaga

SEQ ID NO: 20601 - DNA, 20 bp, Artificial Sequence
  sgRNA
ggcccgcttgatttcgcaag

SEQ ID NO: 20602 - DNA, 20 bp, Artificial Sequence
  sgRNA
tgaatcctaagtgatgagtg

SEQ ID NO: 20603 - DNA, 20 bp, Artificial Sequence
  sgRNA
gaggtgggatagatgagact

SEQ ID NO: 20604 - DNA, 20 bp, Artificial Sequence
  sgRNA
ccaatcgcagccgacaggcc

SEQ ID NO: 20605 - DNA, 20 bp, Artificial Sequence
  sgRNA
gacttaagttctgtaggcgc

SEQ ID NO: 20606 - DNA, 20 bp, Artificial Sequence
  sgRNA
ggaaacgcctcctcacccgg

SEQ ID NO: 20607 - DNA, 20 bp, Artificial Sequence
  sgRNA
gggtttcaggcaaccacaga

SEQ ID NO: 20608 - DNA, 20 bp, Artificial Sequence
  sgRNA
gtcccgcaagcgcgaagctg

SEQ ID NO: 20609 - DNA, 20 bp, Artificial Sequence
  sgRNA
cgccggagagtttgatagga

SEQ ID NO: 20610 - DNA, 20 bp, Artificial Sequence
  sgRNA
cagctcccgtgacagtctca

SEQ ID NO: 20611 - DNA, 20 bp, Artificial Sequence
  sgRNA
tatggcagatcgcagaagaa

SEQ ID NO: 20612 - DNA, 20 bp, Artificial Sequence
  sgRNA
caactaatattggttccttt

SEQ ID NO: 20613 - DNA, 20 bp, Artificial Sequence
  sgRNA
agctttcacagcagattatg

SEQ ID NO: 20614 - DNA, 20 bp, Artificial Sequence
  sgRNA
agatggccactcgtggaggg

SEQ ID NO: 20615 - DNA, 20 bp, Artificial Sequence
  sgRNA
cagaaccgtaatcttctatc

SEQ ID NO: 20616 - DNA, 20 bp, Artificial Sequence
  sgRNA
gtcagcgtcccgcgagaatg

SEQ ID NO: 20617 - DNA, 20 bp, Artificial Sequence
  sgRNA
acactacgcagccgcagtcc

SEQ ID NO: 20618 - DNA, 20 bp, Artificial Sequence
  sgRNA
tcagacttctgtgcactgtc

SEQ ID NO: 20619 - DNA, 20 bp, Artificial Sequence
  sgRNA
tgacgtcacgcgcatcaact

SEQ ID NO: 20620 - DNA, 20 bp, Artificial Sequence
  sgRNA
atgcgcaaaccagctgttat

SEQ ID NO: 20621 - DNA, 20 bp, Artificial Sequence
  sgRNA
accacagagccattacacga

SEQ ID NO: 20622 - DNA, 20 bp, Artificial Sequence
  sgRNA
cgaaccaggaagtcggcggg

SEQ ID NO: 20623 - DNA, 20 bp, Artificial Sequence
  sgRNA
gggacgcgcgcggtccgctc

SEQ ID NO: 20624 - DNA, 20 bp, Artificial Sequence
  sgRNA
gggaaactcggagggctgag

SEQ ID NO: 20625 - DNA, 20 bp, Artificial Sequence
  sgRNA
ggtgctgatgacgtaggacg

SEQ ID NO: 20626 - DNA, 20 bp, Artificial Sequence
  sgRNA
gaggtctagggaatgcttgc

SEQ ID NO: 20627 - DNA, 20 bp, Artificial Sequence
  sgRNA
gggacatctggtcaccaact

SEQ ID NO: 20628 - DNA, 20 bp, Artificial Sequence
  sgRNA
ggtaacatttaataggcacc

SEQ ID NO: 20629 - DNA, 20 bp, Artificial Sequence
  sgRNA
agctccgacctcgtccgtcg

SEQ ID NO: 20630 - DNA, 20 bp, Artificial Sequence
  sgRNA
gtggctaggacccgccgcct

SEQ ID NO: 20631 - DNA, 20 bp, Artificial Sequence
  sgRNA
gagcgctggcccgacgccgc

SEQ ID NO: 20632 - DNA, 20 bp, Artificial Sequence
  sgRNA
gtcaagtggcttcagaggcc

SEQ ID NO: 20633 - DNA, 20 bp, Artificial Sequence
  sgRNA
tgatctctgggcgtcttcca

SEQ ID NO: 20634 - DNA, 20 bp, Artificial Sequence
  sgRNA
agagttggagcaggagctga

SEQ ID NO: 20635 - DNA, 20 bp, Artificial Sequence
  sgRNA
cgcgcgggagtctgcaactc

SEQ ID NO: 20636 - DNA, 20 bp, Artificial Sequence
  sgRNA
ctgccagcaaacttggcctc

SEQ ID NO: 20637 - DNA, 20 bp, Artificial Sequence
  sgRNA
gctccaccacaggtcgcctt

SEQ ID NO: 20638 - DNA, 20 bp, Artificial Sequence
  sgRNA
gatagcactgtcccacaatg

SEQ ID NO: 20639 - DNA, 20 bp, Artificial Sequence
  sgRNA
tttgaacagctggtacccag

SEQ ID NO: 20640 - DNA, 20 bp, Artificial Sequence
  sgRNA
agagctaataaatctgtgaa

SEQ ID NO: 20641 - DNA, 20 bp, Artificial Sequence
  sgRNA
gctactagttagtatattca

SEQ ID NO: 20642 - DNA, 20 bp, Artificial Sequence
  sgRNA
tcatgaagctgcagcctgat

SEQ ID NO: 20643 - DNA, 20 bp, Artificial Sequence
  sgRNA
gtagcacgtcccttcgccta

SEQ ID NO: 20644 - DNA, 20 bp, Artificial Sequence
  sgRNA
tgattgcgtgctgacgcact

SEQ ID NO: 20645 - DNA, 20 bp, Artificial Sequence
  sgRNA
ggctccgtaccgaagctgca

SEQ ID NO: 20646 - DNA, 20 bp, Artificial Sequence
  sgRNA
gtgtggtccctgacagcacc

SEQ ID NO: 20647 - DNA, 20 bp, Artificial Sequence
  sgRNA
tgggattgcaccggcacggg

SEQ ID NO: 20648 - DNA, 20 bp, Artificial Sequence
  sgRNA
ttaataatcggaactagaag

SEQ ID NO: 20649 - DNA, 20 bp, Artificial Sequence
  sgRNA
agccgggaactcacgtgcgg

SEQ ID NO: 20650 - DNA, 20 bp, Artificial Sequence
  sgRNA
tcgcgcctcacacaagccct

SEQ ID NO: 20651 - DNA, 20 bp, Artificial Sequence
  sgRNA
ggaaagggagcatcacccgc

SEQ ID NO: 20652 - DNA, 20 bp, Artificial Sequence
  sgRNA
gcacccacttcccatattga

SEQ ID NO: 20653 - DNA, 20 bp, Artificial Sequence
  sgRNA
aacataagcacccatcagct

SEQ ID NO: 20654 - DNA, 20 bp, Artificial Sequence
  sgRNA
gggctaagtggctacccgct

SEQ ID NO: 20655 - DNA, 20 bp, Artificial Sequence
  sgRNA
gcggagacacgcaaatgaac

SEQ ID NO: 20656 - DNA, 20 bp, Artificial Sequence
  sgRNA
gtatggtgccgcgcgccgat

SEQ ID NO: 20657 - DNA, 20 bp, Artificial Sequence
  sgRNA
tgcagacgctcaggcttgca

SEQ ID NO: 20658 - DNA, 20 bp, Artificial Sequence
  sgRNA
ccttgcgtatgtttgccatc

SEQ ID NO: 20659 - DNA, 20 bp, Artificial Sequence
  sgRNA
ggttaatgatctacagttat

SEQ ID NO: 20660 - DNA, 20 bp, Artificial Sequence
  sgRNA
aatgaaatgcgaggtaagta

SEQ ID NO: 20661 - DNA, 20 bp, Artificial Sequence
  sgRNA
tttcgtgggcggccggctgg

SEQ ID NO: 20662 - DNA, 20 bp, Artificial Sequence
  sgRNA
gacagcgacacggctcctcc

SEQ ID NO: 20663 - DNA, 20 bp, Artificial Sequence
  sgRNA
gaaataacgggcggccaggt

SEQ ID NO: 20664 - DNA, 20 bp, Artificial Sequence
  sgRNA
cgtctgaaactggtcctcat

SEQ ID NO: 20665 - DNA, 20 bp, Artificial Sequence
  sgRNA
ctgacacagcaacacagcgc

SEQ ID NO: 20666 - DNA, 20 bp, Artificial Sequence
  sgRNA
atgactgctttcctcggaga

SEQ ID NO: 20667 - DNA, 20 bp, Artificial Sequence
  sgRNA
tgcaagcctcacactcgctg

SEQ ID NO: 20668 - DNA, 20 bp, Artificial Sequence
  sgRNA
aacggtacacacgttcctta

SEQ ID NO: 20669 - DNA, 20 bp, Artificial Sequence
  sgRNA
tgaatatttcagcgtatatg

SEQ ID NO: 20670 - DNA, 20 bp, Artificial Sequence
  sgRNA
cgctgtcccgcacagcatgc

SEQ ID NO: 20671 - DNA, 20 bp, Artificial Sequence
  sgRNA
ggtgaagagctccacacgtg

SEQ ID NO: 20672 - DNA, 20 bp, Artificial Sequence
  sgRNA
ttgcggcacgcgctactcgc

SEQ ID NO: 20673 - DNA, 20 bp, Artificial Sequence
  sgRNA
ctttgcgtacatccgccaaa

SEQ ID NO: 20674 - DNA, 20 bp, Artificial Sequence
  sgRNA
aggagaatctcaccatcagt

SEQ ID NO: 20675 - DNA, 20 bp, Artificial Sequence
  sgRNA
gtttagcgcagccaagcgac

SEQ ID NO: 20676 - DNA, 20 bp, Artificial Sequence
  sgRNA
ggtacaggaaattcctgtaa

SEQ ID NO: 20677 - DNA, 20 bp, Artificial Sequence
  sgRNA
ttcatcagaagaaagccttt

SEQ ID NO: 20678 - DNA, 20 bp, Artificial Sequence
  sgRNA
ccgtgtcgaatgttaacatt

SEQ ID NO: 20679 - DNA, 20 bp, Artificial Sequence
  sgRNA
gggctcggcctatcaaatgc

SEQ ID NO: 20680 - DNA, 20 bp, Artificial Sequence
  sgRNA
ggttactatgggtcattctg

SEQ ID NO: 20681 - DNA, 20 bp, Artificial Sequence
  sgRNA
cgccgacggctggacccgac

SEQ ID NO: 20682 - DNA, 20 bp, Artificial Sequence
  sgRNA
ccgcgtgttcctggatttga

SEQ ID NO: 20683 - DNA, 20 bp, Artificial Sequence
  sgRNA
ccgaagccgcgcagtttaga

SEQ ID NO: 20684 - DNA, 20 bp, Artificial Sequence
  sgRNA
ggcgggcagaagcctgtgat

SEQ ID NO: 20685 - DNA, 20 bp, Artificial Sequence
  sgRNA
tgtcttctccaggactgaaa

SEQ ID NO: 20686 - DNA, 20 bp, Artificial Sequence
  sgRNA
gactcaagcaggttcccgcc

SEQ ID NO: 20687 - DNA, 20 bp, Artificial Sequence
  sgRNA
cgagtgggcgtcccagctga

SEQ ID NO: 20688 - DNA, 20 bp, Artificial Sequence
  sgRNA
cagggccatagtagcagcag

SEQ ID NO: 20689 - DNA, 20 bp, Artificial Sequence
  sgRNA
tgtcacgggcgaacgcggcg

SEQ ID NO: 20690 - DNA, 20 bp, Artificial Sequence
  sgRNA
tgacccgcgacaagcggctc

SEQ ID NO: 20691 - DNA, 20 bp, Artificial Sequence
  sgRNA
agagcaaattccaagattct

SEQ ID NO: 20692 - DNA, 20 bp, Artificial Sequence
  sgRNA
agttgaaggaagagggaaag

SEQ ID NO: 20693 - DNA, 20 bp, Artificial Sequence
  sgRNA
tcataggaaagaagtgaatc

SEQ ID NO: 20694 - DNA, 20 bp, Artificial Sequence
  sgRNA
gcagtacgacagccgggccg

SEQ ID NO: 20695 - DNA, 20 bp, Artificial Sequence
  sgRNA
gaccgcgagacacttatgga

SEQ ID NO: 20696 - DNA, 20 bp, Artificial Sequence
  sgRNA
atgcgtgatcggacctaggt

SEQ ID NO: 20697 - DNA, 20 bp, Artificial Sequence
  sgRNA
cagctgtgatcctcttctac

SEQ ID NO: 20698 - DNA, 20 bp, Artificial Sequence
  sgRNA
ctctctcaggtgggaagagt

SEQ ID NO: 20699 - DNA, 20 bp, Artificial Sequence
  sgRNA
gcggagaccgctgcgtccag

SEQ ID NO: 20700 - DNA, 20 bp, Artificial Sequence
  sgRNA
atggacgatacaggagatag

SEQ ID NO: 20701 - DNA, 20 bp, Artificial Sequence
  sgRNA
acagctgagggttgagatgg

SEQ ID NO: 20702 - DNA, 20 bp, Artificial Sequence
  sgRNA
acaactcccaggaggtcccg

SEQ ID NO: 20703 - DNA, 20 bp, Artificial Sequence
  sgRNA
ggacctggcccggtaactcc

SEQ ID NO: 20704 - DNA, 20 bp, Artificial Sequence
  sgRNA
tacaccaggacacgacaagc

SEQ ID NO: 20705 - DNA, 20 bp, Artificial Sequence
  sgRNA
tcgctttcctttggatctag

SEQ ID NO: 20706 - DNA, 20 bp, Artificial Sequence
  sgRNA
caagttccattcatatgatt

SEQ ID NO: 20707 - DNA, 20 bp, Artificial Sequence
  sgRNA
tcattgtagggcatagggct

SEQ ID NO: 20708 - DNA, 20 bp, Artificial Sequence
  sgRNA
tctcttgggaagttaactaa

SEQ ID NO: 20709 - DNA, 20 bp, Artificial Sequence
  sgRNA
caaacagcatcctcaaagca

SEQ ID NO: 20710 - DNA, 20 bp, Artificial Sequence
  sgRNA
ggccacgacgagtgtgctcc

SEQ ID NO: 20711 - DNA, 20 bp, Artificial Sequence
  sgRNA
atgagaaatcgcctgtagac

SEQ ID NO: 20712 - DNA, 20 bp, Artificial Sequence
  sgRNA
caccggaaccggaaaccttc

SEQ ID NO: 20713 - DNA, 20 bp, Artificial Sequence
  sgRNA
gtccctacggcacgtgacta

SEQ ID NO: 20714 - DNA, 20 bp, Artificial Sequence
  sgRNA
acggcgggccgtagggcaac

SEQ ID NO: 20715 - DNA, 20 bp, Artificial Sequence
  sgRNA
tacgctttccggtctgttgg

SEQ ID NO: 20716 - DNA, 20 bp, Artificial Sequence
  sgRNA
ccttcttaccctgttgcctt

SEQ ID NO: 20717 - DNA, 20 bp, Artificial Sequence
  sgRNA
agagcggtacggcaaaggca

SEQ ID NO: 20718 - DNA, 20 bp, Artificial Sequence
  sgRNA
catttgcccgcgaactcaaa

SEQ ID NO: 20719 - DNA, 20 bp, Artificial Sequence
  sgRNA
gggcagattgatgtagctca

SEQ ID NO: 20720 - DNA, 20 bp, Artificial Sequence
  sgRNA
tagcaccgagagtccgtggg

SEQ ID NO: 20721 - DNA, 20 bp, Artificial Sequence
  sgRNA
ctttggcttcctgctatgtc

SEQ ID NO: 20722 - DNA, 20 bp, Artificial Sequence
  sgRNA
gaggtggctaaataacaaat

SEQ ID NO: 20723 - DNA, 20 bp, Artificial Sequence
  sgRNA
ataaagctccaaagaggacc

SEQ ID NO: 20724 - DNA, 20 bp, Artificial Sequence
  sgRNA
ctgcatgatgtgggacagcg

SEQ ID NO: 20725 - DNA, 20 bp, Artificial Sequence
  sgRNA
gccgcgggatgccacgtgag

SEQ ID NO: 20726 - DNA, 20 bp, Artificial Sequence
  sgRNA
gctgtctgcgtctcgccggg

SEQ ID NO: 20727 - DNA, 20 bp, Artificial Sequence
  sgRNA
ccaggaggacgttgtaacgt

SEQ ID NO: 20728 - DNA, 20 bp, Artificial Sequence
  sgRNA
ctgtacaacgtgaatctcca

SEQ ID NO: 20729 - DNA, 20 bp, Artificial Sequence
  sgRNA
agacgtgggcgtggtgaaag

SEQ ID NO: 20730 - DNA, 20 bp, Artificial Sequence
  sgRNA
aagtcactcaagcccaagcc

SEQ ID NO: 20731 - DNA, 20 bp, Artificial Sequence
  sgRNA
atattctctgatgacacagc

SEQ ID NO: 20732 - DNA, 20 bp, Artificial Sequence
  sgRNA
ggcctccaggtctccaactg

SEQ ID NO: 20733 - DNA, 20 bp, Artificial Sequence
  sgRNA
tccaataccctcaattctac

SEQ ID NO: 20734 - DNA, 20 bp, Artificial Sequence
  sgRNA
gcggagtcggctgctcagcg

SEQ ID NO: 20735 - DNA, 20 bp, Artificial Sequence
  sgRNA
ggccggagtgagtctaccgg

SEQ ID NO: 20736 - DNA, 20 bp, Artificial Sequence
  sgRNA
gtcggcgactcgcgcctgcg

SEQ ID NO: 20737 - DNA, 20 bp, Artificial Sequence
  sgRNA
agcgactgacaggaaattat

SEQ ID NO: 20738 - DNA, 20 bp, Artificial Sequence
  sgRNA
cgcgcgagatctgctggcct

SEQ ID NO: 20739 - DNA, 20 bp, Artificial Sequence
  sgRNA
tcggcgcggccctccgctaa

SEQ ID NO: 20740 - DNA, 20 bp, Artificial Sequence
  sgRNA
ggccggcctccagcggactc

SEQ ID NO: 20741 - DNA, 20 bp, Artificial Sequence
  sgRNA
ttaggctggtgaataatgca

SEQ ID NO: 20742 - DNA, 20 bp, Artificial Sequence
  sgRNA
gcgataggtagcaccgcctc

SEQ ID NO: 20743 - DNA, 20 bp, Artificial Sequence
  sgRNA
cgatgtgtttctgcgaacac

SEQ ID NO: 20744 - DNA, 20 bp, Artificial Sequence
  sgRNA
aaacgactttggcaaagtgc

SEQ ID NO: 20745 - DNA, 20 bp, Artificial Sequence
  sgRNA
cccggcgaacaaagcgacgg

SEQ ID NO: 20746 - DNA, 20 bp, Artificial Sequence
  sgRNA
ggagcgagcagctcaggcgc

SEQ ID NO: 20747 - DNA, 20 bp, Artificial Sequence
  sgRNA
tcagaatgcggcgcccagag

SEQ ID NO: 20748 - DNA, 20 bp, Artificial Sequence
  sgRNA
ttgatctcatcatatctgaa

SEQ ID NO: 20749 - DNA, 20 bp, Artificial Sequence
  sgRNA
tctcaaccaatcacagaaca

SEQ ID NO: 20750 - DNA, 20 bp, Artificial Sequence
  sgRNA
ttcaggtagtcgagggtcac

SEQ ID NO: 20751 - DNA, 20 bp, Artificial Sequence
  sgRNA
acatgcgcattaacctttat

SEQ ID NO: 20752 - DNA, 20 bp, Artificial Sequence
  sgRNA
tttgcagagatttgacaggc

SEQ ID NO: 20753 - DNA, 20 bp, Artificial Sequence
  sgRNA
aagcaatgtattagttagcc

SEQ ID NO: 20754 - DNA, 20 bp, Artificial Sequence
  sgRNA
aaggtgtgtgctgccatgcc

SEQ ID NO: 20755 - DNA, 20 bp, Artificial Sequence
  sgRNA
ggcaggcagatctaagtgtg

SEQ ID NO: 20756 - DNA, 20 bp, Artificial Sequence
  sgRNA
atgctctctccgaagtgccg

SEQ ID NO: 20757 - DNA, 20 bp, Artificial Sequence
  sgRNA
ggtaccgcgtctcttatacc

SEQ ID NO: 20758 - DNA, 20 bp, Artificial Sequence
  sgRNA
ccgtagggttggtccgccaa

SEQ ID NO: 20759 - DNA, 20 bp, Artificial Sequence
  sgRNA
agcattacacctgatgttcc

SEQ ID NO: 20760 - DNA, 20 bp, Artificial Sequence
  sgRNA
gttcacatttcaaacagagc

SEQ ID NO: 20761 - DNA, 20 bp, Artificial Sequence
  sgRNA
tgtgagggtggattaagtac

SEQ ID NO: 20762 - DNA, 20 bp, Artificial Sequence
  sgRNA
cctgtgaacccttaacaagg

SEQ ID NO: 20763 - DNA, 20 bp, Artificial Sequence
  sgRNA
aaactttgatgctgagtaga

SEQ ID NO: 20764 - DNA, 20 bp, Artificial Sequence
  sgRNA
ctggccttcctctttagtag

SEQ ID NO: 20765 - DNA, 20 bp, Artificial Sequence
  sgRNA
acgcggcgagttgcatcagc

SEQ ID NO: 20766 - DNA, 20 bp, Artificial Sequence
  sgRNA
aagggctcgggagaattctc

SEQ ID NO: 20767 - DNA, 20 bp, Artificial Sequence
  sgRNA
gcaagcgtacatcctaggtc

SEQ ID NO: 20768 - DNA, 20 bp, Artificial Sequence
  sgRNA
cgggtgggcgtgggaggcag

SEQ ID NO: 20769 - DNA, 20 bp, Artificial Sequence
  sgRNA
cccgacgcgacagtccagct

SEQ ID NO: 20770 - DNA, 20 bp, Artificial Sequence
  sgRNA
cagtcgcagccgcccggccc

SEQ ID NO: 20771 - DNA, 20 bp, Artificial Sequence
  sgRNA
cgcccagcactacgggtccc

SEQ ID NO: 20772 - DNA, 20 bp, Artificial Sequence
  sgRNA
ggaggtgaagaggacgttct

SEQ ID NO: 20773 - DNA, 20 bp, Artificial Sequence
  sgRNA
ccgtttgcctgtctccatcc

SEQ ID NO: 20774 - DNA, 20 bp, Artificial Sequence
  sgRNA
ccattcaacccaagtctgcc

SEQ ID NO: 20775 - DNA, 20 bp, Artificial Sequence
  sgRNA
gctatgttcggagtattaag

SEQ ID NO: 20776 - DNA, 20 bp, Artificial Sequence
  sgRNA
ggaatcagttacaattcctc

SEQ ID NO: 20777 - DNA, 20 bp, Artificial Sequence
  sgRNA
gccaagggaggatgtagatg

SEQ ID NO: 20778 - DNA, 20 bp, Artificial Sequence
  sgRNA
acgccacggccgcgtgaagc

SEQ ID NO: 20779 - DNA, 20 bp, Artificial Sequence
  sgRNA
gggcctcaagctacctgtca

SEQ ID NO: 20780 - DNA, 20 bp, Artificial Sequence
  sgRNA
gggaacagggtctaaggcag

SEQ ID NO: 20781 - DNA, 20 bp, Artificial Sequence
  sgRNA
caccgttctttcgcaggtgt

SEQ ID NO: 20782 - DNA, 20 bp, Artificial Sequence
  sgRNA
tcactagacgcacgtcaccc

SEQ ID NO: 20783 - DNA, 20 bp, Artificial Sequence
  sgRNA
gccgcgggctcgctccaccc

SEQ ID NO: 20784 - DNA, 20 bp, Artificial Sequence
  sgRNA
cgggaggctgggctgctggg

SEQ ID NO: 20785 - DNA, 20 bp, Artificial Sequence
  sgRNA
ctctgcacagggcaggctgg

SEQ ID NO: 20786 - DNA, 20 bp, Artificial Sequence
  sgRNA
ggcgacggagagcttggacg

SEQ ID NO: 20787 - DNA, 20 bp, Artificial Sequence
  sgRNA
cccgcgcacagatcattagg

SEQ ID NO: 20788 - DNA, 20 bp, Artificial Sequence
  sgRNA
ctcttccggccagggatcga

SEQ ID NO: 20789 - DNA, 20 bp, Artificial Sequence
  sgRNA
gcgggaggaaggatgcaccg

SEQ ID NO: 20790 - DNA, 20 bp, Artificial Sequence
  sgRNA
tacctcccacggacgccgcg

SEQ ID NO: 20791 - DNA, 20 bp, Artificial Sequence
  sgRNA
agggcgtcctcgcggattcg

SEQ ID NO: 20792 - DNA, 20 bp, Artificial Sequence
  sgRNA
cgtgctctcccgaaccaggc

SEQ ID NO: 20793 - DNA, 20 bp, Artificial Sequence
  sgRNA
tttgcattctgccagctaag

SEQ ID NO: 20794 - DNA, 20 bp, Artificial Sequence
  sgRNA
agcaagtcagtcacagcatc

SEQ ID NO: 20795 - DNA, 20 bp, Artificial Sequence
  sgRNA
cgtgactgtaaatcctgctt

SEQ ID NO: 20796 - DNA, 20 bp, Artificial Sequence
  sgRNA
ggccgcgcggagtttcaaat

SEQ ID NO: 20797 - DNA, 20 bp, Artificial Sequence
  sgRNA
gcggtggtggatggctgata

SEQ ID NO: 20798 - DNA, 20 bp, Artificial Sequence
  sgRNA
cgctaacgttacgctgtttc

SEQ ID NO: 20799 - DNA, 20 bp, Artificial Sequence
  sgRNA
gtgggccgcgatgcgcagcc

SEQ ID NO: 20800 - DNA, 20 bp, Artificial Sequence
  sgRNA
gctgccggtggagggcttcg

SEQ ID NO: 20801 - DNA, 20 bp, Artificial Sequence
  sgRNA
ccacttatgacgatacaagc

SEQ ID NO: 20802 - DNA, 20 bp, Artificial Sequence
  sgRNA
gcgtgaagcgtctcgagcgg

SEQ ID NO: 20803 - DNA, 20 bp, Artificial Sequence
  sgRNA
gcgtagtagagacccgaata

SEQ ID NO: 20804 - DNA, 20 bp, Artificial Sequence
  sgRNA
taggcataggaaagcttccg

SEQ ID NO: 20805 - DNA, 20 bp, Artificial Sequence
  sgRNA
gggctccagacttagccgga

SEQ ID NO: 20806 - DNA, 20 bp, Artificial Sequence
  sgRNA
cgacgcggaaccaaagtact

SEQ ID NO: 20807 - DNA, 20 bp, Artificial Sequence
  sgRNA
tatctactgagggttccctt

SEQ ID NO: 20808 - DNA, 20 bp, Artificial Sequence
  sgRNA
tgagagtttgcttctgtagt

SEQ ID NO: 20809 - DNA, 20 bp, Artificial Sequence
  sgRNA
tgtggaggtgcagtgggaag

SEQ ID NO: 20810 - DNA, 20 bp, Artificial Sequence
  sgRNA
cgggaaagttggttccactc

SEQ ID NO: 20811 - DNA, 20 bp, Artificial Sequence
  sgRNA
gcagaacccggctgtgcctc

SEQ ID NO: 20812 - DNA, 20 bp, Artificial Sequence
  sgRNA
cctgggtcctcccgtgccga

SEQ ID NO: 20813 - DNA, 20 bp, Artificial Sequence
  sgRNA
accgtgcgcccacaatgcac

SEQ ID NO: 20814 - DNA, 20 bp, Artificial Sequence
  sgRNA
gggtagcagtaaccgctgga

SEQ ID NO: 20815 - DNA, 20 bp, Artificial Sequence
  sgRNA
gtgcggccacgggaaggaag

SEQ ID NO: 20816 - DNA, 20 bp, Artificial Sequence
  sgRNA
gggcgcgggcggcgcgttcc

SEQ ID NO: 20817 - DNA, 20 bp, Artificial Sequence
  sgRNA
ccgaaacgcgtcctggcccg

SEQ ID NO: 20818 - DNA, 20 bp, Artificial Sequence
  sgRNA
accagcggcgggagggtcgg

SEQ ID NO: 20819 - DNA, 20 bp, Artificial Sequence
  sgRNA
ccaccgcccgggcgacgccg

SEQ ID NO: 20820 - DNA, 20 bp, Artificial Sequence
  sgRNA
ggaagtggcctcggtcggcg

SEQ ID NO: 20821 - DNA, 20 bp, Artificial Sequence
  sgRNA
gtgccggcaggttccgcccg

SEQ ID NO: 20822 - DNA, 20 bp, Artificial Sequence
  sgRNA
aaagatcctcagagaaatac

SEQ ID NO: 20823 - DNA, 20 bp, Artificial Sequence
  sgRNA
gaatagggagcaactctttc

SEQ ID NO: 20824 - DNA, 20 bp, Artificial Sequence
  sgRNA
gtcatttggaaggtttactg

SEQ ID NO: 20825 - DNA, 20 bp, Artificial Sequence
  sgRNA
cccgagagggaagaagagga

SEQ ID NO: 20826 - DNA, 20 bp, Artificial Sequence
  sgRNA
ccctgctggccagctacgga

SEQ ID NO: 20827 - DNA, 20 bp, Artificial Sequence
  sgRNA
gagggcaccaggaggtcaag

SEQ ID NO: 20828 - DNA, 20 bp, Artificial Sequence
  sgRNA
gccctggttgtcccggatcg

SEQ ID NO: 20829 - DNA, 20 bp, Artificial Sequence
  sgRNA
atccagtgtccaggtcttcc

SEQ ID NO: 20830 - DNA, 20 bp, Artificial Sequence
  sgRNA
agctgagggacccgcagccc

SEQ ID NO: 20831 - DNA, 20 bp, Artificial Sequence
  sgRNA
ttcgcgagctcggtaggcgc

SEQ ID NO: 20832 - DNA, 20 bp, Artificial Sequence
  sgRNA
tgaaggtccgagcacccgag

SEQ ID NO: 20833 - DNA, 20 bp, Artificial Sequence
  sgRNA
ggagtgactcggcgactagg

SEQ ID NO: 20834 - DNA, 20 bp, Artificial Sequence
  sgRNA
gtgacgggtgcgccgggcgt

SEQ ID NO: 20835 - DNA, 20 bp, Artificial Sequence
  sgRNA
accgacccagcaggacgttg

SEQ ID NO: 20836 - DNA, 20 bp, Artificial Sequence
  sgRNA
tacgtcaacgtctacgtaaa

SEQ ID NO: 20837 - DNA, 20 bp, Artificial Sequence
  sgRNA
atgctaagaccacaactaca

SEQ ID NO: 20838 - DNA, 20 bp, Artificial Sequence
  sgRNA
tagagtgcgtgatttcatag

SEQ ID NO: 20839 - DNA, 20 bp, Artificial Sequence
  sgRNA
ctgcctgggtcttagagatc

SEQ ID NO: 20840 - DNA, 20 bp, Artificial Sequence
  sgRNA
ctttagctagtcctaaggaa

SEQ ID NO: 20841 - DNA, 20 bp, Artificial Sequence
  sgRNA
gtatagctggactcctatgc

SEQ ID NO: 20842 - DNA, 20 bp, Artificial Sequence
  sgRNA
tttaagcgagcggaagagcc

SEQ ID NO: 20843 - DNA, 20 bp, Artificial Sequence
  sgRNA
gctgccgcctggctgctctg

SEQ ID NO: 20844 - DNA, 20 bp, Artificial Sequence
  sgRNA
gccgcgagaaggaggcgcgc

SEQ ID NO: 20845 - DNA, 20 bp, Artificial Sequence
  sgRNA
gggtcagcccggcgtggcgt

SEQ ID NO: 20846 - DNA, 20 bp, Artificial Sequence
  sgRNA
ccagggtgggcgagggcttt

SEQ ID NO: 20847 - DNA, 20 bp, Artificial Sequence
  sgRNA
tcccggctccggctaacaat

SEQ ID NO: 20848 - DNA, 20 bp, Artificial Sequence
  sgRNA
ctacacttggcccacaccca

SEQ ID NO: 20849 - DNA, 20 bp, Artificial Sequence
  sgRNA
tgctcatgccgcgttgccat

SEQ ID NO: 20850 - DNA, 20 bp, Artificial Sequence
  sgRNA
gcaccgccctctttcactac

SEQ ID NO: 20851 - DNA, 20 bp, Artificial Sequence
  sgRNA
ccagatccctcgtgggccaa

SEQ ID NO: 20852 - DNA, 20 bp, Artificial Sequence
  sgRNA
gcggcgcaggccatccctag

SEQ ID NO: 20853 - DNA, 20 bp, Artificial Sequence
  sgRNA
cgcgtgcgtatgcgtcgccc

SEQ ID NO: 20854 - DNA, 20 bp, Artificial Sequence
  sgRNA
tcagaaccatggcaggaaag

SEQ ID NO: 20855 - DNA, 20 bp, Artificial Sequence
  sgRNA
atggagatggactgtagctg

SEQ ID NO: 20856 - DNA, 20 bp, Artificial Sequence
  sgRNA
tttgctttcctggtgatgga

SEQ ID NO: 20857 - DNA, 20 bp, Artificial Sequence
  sgRNA
ggagaacattatatcagccg

SEQ ID NO: 20858 - DNA, 20 bp, Artificial Sequence
  sgRNA
ccagggccagacaccacaca

SEQ ID NO: 20859 - DNA, 20 bp, Artificial Sequence
  sgRNA
gtcctgcccagccacagttg

SEQ ID NO: 20860 - DNA, 20 bp, Artificial Sequence
  sgRNA
taagcggacctcagcacgtt

SEQ ID NO: 20861 - DNA, 20 bp, Artificial Sequence
  sgRNA
cttaatccttctgggaattc

SEQ ID NO: 20862 - DNA, 20 bp, Artificial Sequence
  sgRNA
tgatggcctagttactgcca

SEQ ID NO: 20863 - DNA, 20 bp, Artificial Sequence
  sgRNA
ttaattcctgacccgttagc

SEQ ID NO: 20864 - DNA, 20 bp, Artificial Sequence
  sgRNA
agggatcagtctcacgggtt

SEQ ID NO: 20865 - DNA, 20 bp, Artificial Sequence
  sgRNA
ggctgcgggcgagaccaacc

SEQ ID NO: 20866 - DNA, 20 bp, Artificial Sequence
  sgRNA
aggtacataaggtcgcttat

SEQ ID NO: 20867 - DNA, 20 bp, Artificial Sequence
  sgRNA
acggctagactgcactgacc

SEQ ID NO: 20868 - DNA, 20 bp, Artificial Sequence
  sgRNA
ggtccgcgaaatctgaaacc

SEQ ID NO: 20869 - DNA, 20 bp, Artificial Sequence
  sgRNA
aggtgctcttcatgggcttt

SEQ ID NO: 20870 - DNA, 20 bp, Artificial Sequence
  sgRNA
gtttccgtccgctcactagg

SEQ ID NO: 20871 - DNA, 20 bp, Artificial Sequence
  sgRNA
ctgctcatttctaggtttat

SEQ ID NO: 20872 - DNA, 20 bp, Artificial Sequence
  sgRNA
ctaagcaagagagaagtgca

SEQ ID NO: 20873 - DNA, 20 bp, Artificial Sequence
  sgRNA
gagaaactctgggatgtagt

SEQ ID NO: 20874 - DNA, 20 bp, Artificial Sequence
  sgRNA
cagctcccgcgagggaggtg

SEQ ID NO: 20875 - DNA, 20 bp, Artificial Sequence
  sgRNA
agtcagcggttgtttgcacg

SEQ ID NO: 20876 - DNA, 20 bp, Artificial Sequence
  sgRNA
gtcggagtgtgccctcaagg

SEQ ID NO: 20877 - DNA, 20 bp, Artificial Sequence
  sgRNA
acaagctaagttcccagagt

SEQ ID NO: 20878 - DNA, 20 bp, Artificial Sequence
  sgRNA
gtccttctgcttggacaggg

SEQ ID NO: 20879 - DNA, 20 bp, Artificial Sequence
  sgRNA
gcaggacgtccggagctcag

SEQ ID NO: 20880 - DNA, 20 bp, Artificial Sequence
  sgRNA
aaataagtggaagaatagga

SEQ ID NO: 20881 - DNA, 20 bp, Artificial Sequence
  sgRNA
tggaagagcatcttgagttc

SEQ ID NO: 20882 - DNA, 20 bp, Artificial Sequence
  sgRNA
cgctctgcttcttagggccc

SEQ ID NO: 20883 - DNA, 20 bp, Artificial Sequence
  sgRNA
gcttcttgcactagagtcct

SEQ ID NO: 20884 - DNA, 20 bp, Artificial Sequence
  sgRNA
tggtacggtccgggtttaaa

SEQ ID NO: 20885 - DNA, 20 bp, Artificial Sequence
  sgRNA
cagagtcaaatatgtatcca

SEQ ID NO: 20886 - DNA, 20 bp, Artificial Sequence
  sgRNA
gccctttaaggcagctccca

SEQ ID NO: 20887 - DNA, 20 bp, Artificial Sequence
  sgRNA
acaccacaatggaggctatc

SEQ ID NO: 20888 - DNA, 20 bp, Artificial Sequence
  sgRNA
taatcgtccacagagcccag

SEQ ID NO: 20889 - DNA, 20 bp, Artificial Sequence
  sgRNA
tctcaaggcggtaagtggtg

SEQ ID NO: 20890 - DNA, 20 bp, Artificial Sequence
  sgRNA
tatcgtcacctcccagacca

SEQ ID NO: 20891 - DNA, 20 bp, Artificial Sequence
  sgRNA
gccttcaggaaaggagtccc

SEQ ID NO: 20892 - DNA, 20 bp, Artificial Sequence
  sgRNA
acatgctagccgcggaggac

SEQ ID NO: 20893 - DNA, 20 bp, Artificial Sequence
  sgRNA
gggcgtggacttagtgggtg

SEQ ID NO: 20894 - DNA, 20 bp, Artificial Sequence
  sgRNA
ctaggacccagcgggccgac

SEQ ID NO: 20895 - DNA, 20 bp, Artificial Sequence
  sgRNA
ctgacctcccggaagccggc

SEQ ID NO: 20896 - DNA, 20 bp, Artificial Sequence
  sgRNA
ggcagatgcctagcgggact

SEQ ID NO: 20897 - DNA, 20 bp, Artificial Sequence
  sgRNA
tattctgccaccctgtggcc

SEQ ID NO: 20898 - DNA, 20 bp, Artificial Sequence
  sgRNA
gcgccagagttacactgagg

SEQ ID NO: 20899 - DNA, 20 bp, Artificial Sequence
  sgRNA
aaaccagtgagcatccctcc

SEQ ID NO: 20900 - DNA, 20 bp, Artificial Sequence
  sgRNA
cccagccagtcctccgctcc

SEQ ID NO: 20901 - DNA, 20 bp, Artificial Sequence
  sgRNA
gggaaggaggaggaagaagg

SEQ ID NO: 20902 - DNA, 20 bp, Artificial Sequence
  sgRNA
cagggaagccggaacctcgc

SEQ ID NO: 20903 - DNA, 20 bp, Artificial Sequence
  sgRNA
gcgctttacaaactggctga

SEQ ID NO: 20904 - DNA, 20 bp, Artificial Sequence
  sgRNA
ggtcaccgggtcagtcccgc

SEQ ID NO: 20905 - DNA, 20 bp, Artificial Sequence
  sgRNA
tgcaaagttgggcgcggctt

SEQ ID NO: 20906 - DNA, 20 bp, Artificial Sequence
  sgRNA
cggccagcgtttccaagacc

SEQ ID NO: 20907 - DNA, 20 bp, Artificial Sequence
  sgRNA
gatcgcgcgcaggcgcagaa

SEQ ID NO: 20908 - DNA, 20 bp, Artificial Sequence
  sgRNA
gtaaggcgcaggtgttcgcg

SEQ ID NO: 20909 - DNA, 20 bp, Artificial Sequence
  sgRNA
ggagtcccgggcgggtcgga

SEQ ID NO: 20910 - DNA, 20 bp, Artificial Sequence
  sgRNA
ggccagggcccgatagtctc

SEQ ID NO: 20911 - DNA, 20 bp, Artificial Sequence
  sgRNA
ggccactgtcccaaggtctc

SEQ ID NO: 20912 - DNA, 20 bp, Artificial Sequence
  sgRNA
cagcacaaattcccttagaa

SEQ ID NO: 20913 - DNA, 20 bp, Artificial Sequence
  sgRNA
aacgggaagtctttggtctc

SEQ ID NO: 20914 - DNA, 20 bp, Artificial Sequence
  sgRNA
tttcagcagaggcagcaacc

SEQ ID NO: 20915 - DNA, 20 bp, Artificial Sequence
  sgRNA
gttggctttccctctgcagg

SEQ ID NO: 20916 - DNA, 20 bp, Artificial Sequence
  sgRNA
gtggtgtcggattggtcttc

SEQ ID NO: 20917 - DNA, 20 bp, Artificial Sequence
  sgRNA
tttcactcggctcggtcctg

SEQ ID NO: 20918 - DNA, 20 bp, Artificial Sequence
  sgRNA
tgtctctcggtctttccagc

SEQ ID NO: 20919 - DNA, 20 bp, Artificial Sequence
  sgRNA
ccatccaatgcagtcacatt

SEQ ID NO: 20920 - DNA, 20 bp, Artificial Sequence
  sgRNA
ctgctgtgtcagggttggca

SEQ ID NO: 20921 - DNA, 20 bp, Artificial Sequence
  sgRNA
ttgtgatttgtttcctaagg

SEQ ID NO: 20922 - DNA, 20 bp, Artificial Sequence
  sgRNA
cggtcctgaaatgctgtcct

SEQ ID NO: 20923 - DNA, 20 bp, Artificial Sequence
  sgRNA
atgcgaggagaacttctacc

SEQ ID NO: 20924 - DNA, 20 bp, Artificial Sequence
  sgRNA
acggatccttaaatatgctg

SEQ ID NO: 20925 - DNA, 20 bp, Artificial Sequence
  sgRNA
gacgcggaagaagagacctg

SEQ ID NO: 20926 - DNA, 20 bp, Artificial Sequence
  sgRNA
gcttggcgggtgctgtgcgt

SEQ ID NO: 20927 - DNA, 20 bp, Artificial Sequence
  sgRNA
aggacagtgccagccaattc

SEQ ID NO: 20928 - DNA, 20 bp, Artificial Sequence
  sgRNA
gagcaccatatattactggg

SEQ ID NO: 20929 - DNA, 20 bp, Artificial Sequence
  sgRNA
gggcagcgccgcgtagactt

SEQ ID NO: 20930 - DNA, 20 bp, Artificial Sequence
  sgRNA
gtcaagatgggagggttgga

SEQ ID NO: 20931 - DNA, 20 bp, Artificial Sequence
  sgRNA
aaaccagtcttcttggattc

SEQ ID NO: 20932 - DNA, 20 bp, Artificial Sequence
  sgRNA
ggacaaagaggctgggaatt

SEQ ID NO: 20933 - DNA, 20 bp, Artificial Sequence
  sgRNA
atcagtcaatttgtaggttg

SEQ ID NO: 20934 - DNA, 20 bp, Artificial Sequence
  sgRNA
cgacgcccgccattgggaga

SEQ ID NO: 20935 - DNA, 20 bp, Artificial Sequence
  sgRNA
ggaggcggagtctaggtcta

SEQ ID NO: 20936 - DNA, 20 bp, Artificial Sequence
  sgRNA
gttggcggcgaacacctgct

SEQ ID NO: 20937 - DNA, 20 bp, Artificial Sequence
  sgRNA
ctggaatcccactcgaggga

SEQ ID NO: 20938 - DNA, 20 bp, Artificial Sequence
  sgRNA
cagcatcgccagtcgctctc

SEQ ID NO: 20939 - DNA, 20 bp, Artificial Sequence
  sgRNA
catttcactagctgtgttgg

SEQ ID NO: 20940 - DNA, 20 bp, Artificial Sequence
  sgRNA
agtagattggcatcactcac

SEQ ID NO: 20941 - DNA, 20 bp, Artificial Sequence
  sgRNA
gaaacaacaagcagcattga

SEQ ID NO: 20942 - DNA, 20 bp, Artificial Sequence
  sgRNA
agctcttgagtgctggaggg

SEQ ID NO: 20943 - DNA, 20 bp, Artificial Sequence
  sgRNA
atttcttatgtccctgtgtt

SEQ ID NO: 20944 - DNA, 20 bp, Artificial Sequence
  sgRNA
cactcccagccgtggaggga

SEQ ID NO: 20945 - DNA, 20 bp, Artificial Sequence
  sgRNA
ggagtcatgtgataccaaga

SEQ ID NO: 20946 - DNA, 20 bp, Artificial Sequence
  sgRNA
ttatgacaatgggtagttaa

SEQ ID NO: 20947 - DNA, 20 bp, Artificial Sequence
  sgRNA
gggtcacgcgacgctgatgc

SEQ ID NO: 20948 - DNA, 20 bp, Artificial Sequence
  sgRNA
agcgcgagcgcgggagttag

SEQ ID NO: 20949 - DNA, 20 bp, Artificial Sequence
  sgRNA
catggtgggacacctgagcg

SEQ ID NO: 20950 - DNA, 20 bp, Artificial Sequence
  sgRNA
gtagccaatgcggtggctat

SEQ ID NO: 20951 - DNA, 20 bp, Artificial Sequence
  sgRNA
tgaccctccctctttgtagg

SEQ ID NO: 20952 - DNA, 20 bp, Artificial Sequence
  sgRNA
tataattctgcagtatctga

SEQ ID NO: 20953 - DNA, 20 bp, Artificial Sequence
  sgRNA
gcaaagtttcctggttcgtg

SEQ ID NO: 20954 - DNA, 20 bp, Artificial Sequence
  sgRNA
ccgtggaactcgagcgatcc

SEQ ID NO: 20955 - DNA, 20 bp, Artificial Sequence
  sgRNA
aacaaactagataccggaac

SEQ ID NO: 20956 - DNA, 20 bp, Artificial Sequence
  sgRNA
ctcaagtccggttgtcggcc

SEQ ID NO: 20957 - DNA, 20 bp, Artificial Sequence
  sgRNA
taatatagtgtgccaaccac

SEQ ID NO: 20958 - DNA, 20 bp, Artificial Sequence
  sgRNA
ccctacccggccagtgggcg

SEQ ID NO: 20959 - DNA, 20 bp, Artificial Sequence
  sgRNA
acttggaattgttcatccag

SEQ ID NO: 20960 - DNA, 20 bp, Artificial Sequence
  sgRNA
gcagagacagactgttacaa

SEQ ID NO: 20961 - DNA, 20 bp, Artificial Sequence
  sgRNA
caggtatgaaactctgttcc

SEQ ID NO: 20962 - DNA, 20 bp, Artificial Sequence
  sgRNA
gcttagtcccaaagttcaaa

SEQ ID NO: 20963 - DNA, 20 bp, Artificial Sequence
  sgRNA
gaaccagtgcgcagactcac

SEQ ID NO: 20964 - DNA, 20 bp, Artificial Sequence
  sgRNA
atgcttctcctaagatagaa

SEQ ID NO: 20965 - DNA, 20 bp, Artificial Sequence
  sgRNA
tccagaagaggatcgaagtg

SEQ ID NO: 20966 - DNA, 20 bp, Artificial Sequence
  sgRNA
ttctcctcttctcgcgatag

SEQ ID NO: 20967 - DNA, 20 bp, Artificial Sequence
  sgRNA
gagcgaattccctcggagag

SEQ ID NO: 20968 - DNA, 20 bp, Artificial Sequence
  sgRNA
ttgatggcaatcgggccatt

SEQ ID NO: 20969 - DNA, 20 bp, Artificial Sequence
  sgRNA
tgtagaaacctttcaccagt

SEQ ID NO: 20970 - DNA, 20 bp, Artificial Sequence
  sgRNA
gaacccaggttctctagatc

SEQ ID NO: 20971 - DNA, 20 bp, Artificial Sequence
  sgRNA
tgcactccagtggccaacct

SEQ ID NO: 20972 - DNA, 20 bp, Artificial Sequence
  sgRNA
ttgcttcaggaggctcctga

SEQ ID NO: 20973 - DNA, 20 bp, Artificial Sequence
  sgRNA
caagggacaccggacctgtg

SEQ ID NO: 20974 - DNA, 20 bp, Artificial Sequence
  sgRNA
gggattggcctccaccggcc

SEQ ID NO: 20975 - DNA, 20 bp, Artificial Sequence
  sgRNA
gaactccctcgtgacgcacc

SEQ ID NO: 20976 - DNA, 20 bp, Artificial Sequence
  sgRNA
gggactccctccggctctat

SEQ ID NO: 20977 - DNA, 20 bp, Artificial Sequence
  sgRNA
ggcgcgcgcggacggcgagg

SEQ ID NO: 20978 - DNA, 20 bp, Artificial Sequence
  sgRNA
gacggcgcgggccgggtgcg

SEQ ID NO: 20979 - DNA, 20 bp, Artificial Sequence
  sgRNA
ctcggtcccgaggctcgaag

SEQ ID NO: 20980 - DNA, 20 bp, Artificial Sequence
  sgRNA
ttccgataagttgttgcaaa

SEQ ID NO: 20981 - DNA, 20 bp, Artificial Sequence
  sgRNA
agctccaaccctacttaaac

SEQ ID NO: 20982 - DNA, 20 bp, Artificial Sequence
  sgRNA
tggctgcttgagtgggccaa

SEQ ID NO: 20983 - DNA, 20 bp, Artificial Sequence
  sgRNA
gacagtggctgagggtttct

SEQ ID NO: 20984 - DNA, 20 bp, Artificial Sequence
  sgRNA
aactgaggcgcaggcgcacg

SEQ ID NO: 20985 - DNA, 20 bp, Artificial Sequence
  sgRNA
cgtgattggtggccctgctg

SEQ ID NO: 20986 - DNA, 20 bp, Artificial Sequence
  sgRNA
cggttccggagcggtctcag

SEQ ID NO: 20987 - DNA, 20 bp, Artificial Sequence
  sgRNA
gaagggcgggcttccgctca

SEQ ID NO: 20988 - DNA, 20 bp, Artificial Sequence
  sgRNA
cgtgcagccgcgtgctaacc

SEQ ID NO: 20989 - DNA, 20 bp, Artificial Sequence
  sgRNA
atctgctgcccgtggctaag

SEQ ID NO: 20990 - DNA, 20 bp, Artificial Sequence
  sgRNA
gctgtgaggaggagaacact

SEQ ID NO: 20991 - DNA, 20 bp, Artificial Sequence
  sgRNA
gagcaggcagagccgagcaa

SEQ ID NO: 20992 - DNA, 20 bp, Artificial Sequence
  sgRNA
cgctgagagagagacaaact

SEQ ID NO: 20993 - DNA, 20 bp, Artificial Sequence
  sgRNA
ccttccacgtcacatccatg

SEQ ID NO: 20994 - DNA, 20 bp, Artificial Sequence
  sgRNA
gaaggcggagcgtggtactg

SEQ ID NO: 20995 - DNA, 20 bp, Artificial Sequence
  sgRNA
ctatatggctagccacatca

SEQ ID NO: 20996 - DNA, 20 bp, Artificial Sequence
  sgRNA
cgaggctagacaaacatgtg

SEQ ID NO: 20997 - DNA, 20 bp, Artificial Sequence
  sgRNA
acacacccagttgacaaacg

SEQ ID NO: 20998 - DNA, 20 bp, Artificial Sequence
  sgRNA
gattccgtgttagctcataa

SEQ ID NO: 20999 - DNA, 20 bp, Artificial Sequence
  sgRNA
ggagctctccgctgacatcc

SEQ ID NO: 21000 - DNA, 20 bp, Artificial Sequence
  sgRNA
gtgtagggctaaccttgggc

SEQ ID NO: 21001 - DNA, 20 bp, Artificial Sequence
  sgRNA
gtttggagagtcagttgtgt

SEQ ID NO: 21002 - DNA, 20 bp, Artificial Sequence
  sgRNA
gatcttgttatgttgtaaag

SEQ ID NO: 21003 - DNA, 20 bp, Artificial Sequence
  sgRNA
tgtgtcactgaagcagacac

SEQ ID NO: 21004 - DNA, 20 bp, Artificial Sequence
  sgRNA
cgagacgaactccctttccc

SEQ ID NO: 21005 - DNA, 20 bp, Artificial Sequence
  sgRNA
tcgtttgcgaaacggtcacg

SEQ ID NO: 21006 - DNA, 20 bp, Artificial Sequence
  sgRNA
aaatctataaagcctttccc

SEQ ID NO: 21007 - DNA, 20 bp, Artificial Sequence
  sgRNA
tttggatggagtggatatcg

SEQ ID NO: 21008 - DNA, 20 bp, Artificial Sequence
  sgRNA
atcgagccagccaaagaccc

SEQ ID NO: 21009 - DNA, 20 bp, Artificial Sequence
  sgRNA
gagaccaatcattatgttcc

SEQ ID NO: 21010 - DNA, 20 bp, Artificial Sequence
  sgRNA
atcttgttgccaaagggttt

SEQ ID NO: 21011 - DNA, 20 bp, Artificial Sequence
  sgRNA
gacagccaattctcgtcagc

SEQ ID NO: 21012 - DNA, 20 bp, Artificial Sequence
  sgRNA
tcatccaatcagaactgcgc

SEQ ID NO: 21013 - DNA, 20 bp, Artificial Sequence
  sgRNA
tagggtctcttgtttctcgc

SEQ ID NO: 21014 - DNA, 20 bp, Artificial Sequence
  sgRNA
cgagtttggtgtcagcgact

SEQ ID NO: 21015 - DNA, 20 bp, Artificial Sequence
  sgRNA
gaccggcctcaagtcacttc

SEQ ID NO: 21016 - DNA, 20 bp, Artificial Sequence
  sgRNA
acaggttgttgacggcaacg

SEQ ID NO: 21017 - DNA, 20 bp, Artificial Sequence
  sgRNA
tgacagggctttacaatcac

SEQ ID NO: 21018 - DNA, 20 bp, Artificial Sequence
  sgRNA
tagcctggatcgggagactt

SEQ ID NO: 21019 - DNA, 20 bp, Artificial Sequence
  sgRNA
taactgacttaccagcgaaa

SEQ ID NO: 21020 - DNA, 20 bp, Artificial Sequence
  sgRNA
gctgtcagggaaaccactaa

SEQ ID NO: 21021 - DNA, 20 bp, Artificial Sequence
  sgRNA
ctctttacagctagcgagtg

SEQ ID NO: 21022 - DNA, 20 bp, Artificial Sequence
  sgRNA
ttgacgtggaatcggatgtt

SEQ ID NO: 21023 - DNA, 20 bp, Artificial Sequence
  sgRNA
tcaaatgttccacgttgagc

SEQ ID NO: 21024 - DNA, 20 bp, Artificial Sequence
  sgRNA
tcgggtttcaggccttgaaa

SEQ ID NO: 21025 - DNA, 20 bp, Artificial Sequence
  sgRNA
aaggcggcgtttgtgtgttc

SEQ ID NO: 21026 - DNA, 20 bp, Artificial Sequence
  sgRNA
agaactcgggctttgcgacc

SEQ ID NO: 21027 - DNA, 20 bp, Artificial Sequence
  sgRNA
ggacagatcctgattggaag

SEQ ID NO: 21028 - DNA, 20 bp, Artificial Sequence
  sgRNA
attggctgctcggccctcca

SEQ ID NO: 21029 - DNA, 20 bp, Artificial Sequence
  sgRNA
ttattagtatgcagggcccg

SEQ ID NO: 21030 - DNA, 20 bp, Artificial Sequence
  sgRNA
gcgtaaacaggcctcccaat

SEQ ID NO: 21031 - DNA, 20 bp, Artificial Sequence
  sgRNA
gcagagtagggtttcaaagc

SEQ ID NO: 21032 - DNA, 20 bp, Artificial Sequence
  sgRNA
agagagcgggaatgctgttc

SEQ ID NO: 21033 - DNA, 20 bp, Artificial Sequence
  sgRNA
cttggctgcagttgtgcggc

SEQ ID NO: 21034 - DNA, 20 bp, Artificial Sequence
  sgRNA
tcaagttccagcaggaacta

SEQ ID NO: 21035 - DNA, 20 bp, Artificial Sequence
  sgRNA
gcaggtttagcttgttagcc

SEQ ID NO: 21036 - DNA, 20 bp, Artificial Sequence
  sgRNA
agggtttggaccttactctg

SEQ ID NO: 21037 - DNA, 20 bp, Artificial Sequence
  sgRNA
cagggctcctcgcgaaagtg

SEQ ID NO: 21038 - DNA, 20 bp, Artificial Sequence
  sgRNA
ctcttgggcagccgctagga

SEQ ID NO: 21039 - DNA, 20 bp, Artificial Sequence
  sgRNA
aggaggaggcgccctgtatc

SEQ ID NO: 21040 - DNA, 20 bp, Artificial Sequence
  sgRNA
acccggcagagcgcaacacg

SEQ ID NO: 21041 - DNA, 20 bp, Artificial Sequence
  sgRNA
gctgcacgtgcgccctctaa

SEQ ID NO: 21042 - DNA, 20 bp, Artificial Sequence
  sgRNA
gcagactctgtaccagactg

SEQ ID NO: 21043 - DNA, 20 bp, Artificial Sequence
  sgRNA
gaagagctaatgtcctcaag

SEQ ID NO: 21044 - DNA, 20 bp, Artificial Sequence
  sgRNA
caagtcttcgaagttccaat

SEQ ID NO: 21045 - DNA, 20 bp, Artificial Sequence
  sgRNA
cgtctctgtgctaactgaga

SEQ ID NO: 21046 - DNA, 20 bp, Artificial Sequence
  sgRNA
tgctgggtggcggcgctggg

SEQ ID NO: 21047 - DNA, 20 bp, Artificial Sequence
  sgRNA
ggtcggcctgagcctaaggg

SEQ ID NO: 21048 - DNA, 20 bp, Artificial Sequence
  sgRNA
cgccgcaccgatcgtgcccg

SEQ ID NO: 21049 - DNA, 20 bp, Artificial Sequence
  sgRNA
gcgttgctttagttgatatg

SEQ ID NO: 21050 - DNA, 20 bp, Artificial Sequence
  sgRNA
tttccggcagtgccgcaagt

SEQ ID NO: 21051 - DNA, 20 bp, Artificial Sequence
  sgRNA
ccggcgcgtgtacgactagc

SEQ ID NO: 21052 - DNA, 20 bp, Artificial Sequence
  sgRNA
acagggttcgttgtcttgaa

SEQ ID NO: 21053 - DNA, 20 bp, Artificial Sequence
  sgRNA
agcacagcttggactacgat

SEQ ID NO: 21054 - DNA, 20 bp, Artificial Sequence
  sgRNA
gtctacgattggtcgctcgt

SEQ ID NO: 21055 - DNA, 20 bp, Artificial Sequence
  sgRNA
gacgcttcactcatgaaagg

SEQ ID NO: 21056 - DNA, 20 bp, Artificial Sequence
  sgRNA
tgcaagaacaactgacaatg

SEQ ID NO: 21057 - DNA, 20 bp, Artificial Sequence
  sgRNA
tagatttattagttgaggct

SEQ ID NO: 21058 - DNA, 20 bp, Artificial Sequence
  sgRNA
ttcagccaccaacttcaatc

SEQ ID NO: 21059 - DNA, 20 bp, Artificial Sequence
  sgRNA
aagtttgcttgcaccaactc

SEQ ID NO: 21060 - DNA, 20 bp, Artificial Sequence
  sgRNA
gaggacaggcagtaaagcaa

SEQ ID NO: 21061 - DNA, 20 bp, Artificial Sequence
  sgRNA
aaatattcagggtagagaag

SEQ ID NO: 21062 - DNA, 20 bp, Artificial Sequence
  sgRNA
ctctcatggtgtttgcaaag

SEQ ID NO: 21063 - DNA, 20 bp, Artificial Sequence
  sgRNA
ttccaccagagcaagcagga

SEQ ID NO: 21064 - DNA, 20 bp, Artificial Sequence
  sgRNA
acagaacaccagtcgagcgc

SEQ ID NO: 21065 - DNA, 20 bp, Artificial Sequence
  sgRNA
gggcgtgaccgacgcggaac

SEQ ID NO: 21066 - DNA, 20 bp, Artificial Sequence
  sgRNA
cgacggataggaggcgcggc

SEQ ID NO: 21067 - DNA, 20 bp, Artificial Sequence
  sgRNA
accgaagctttgccattccg

SEQ ID NO: 21068 - DNA, 20 bp, Artificial Sequence
  sgRNA
gtcgtttccgctcccgggag

SEQ ID NO: 21069 - DNA, 20 bp, Artificial Sequence
  sgRNA
cagaagagcgacctaccaaa

SEQ ID NO: 21070 - DNA, 20 bp, Artificial Sequence
  sgRNA
tcctgaaagtcccggctgcg

SEQ ID NO: 21071 - DNA, 20 bp, Artificial Sequence
  sgRNA
cccgccggccaagcctccca

SEQ ID NO: 21072 - DNA, 20 bp, Artificial Sequence
  sgRNA
cgcttccgccgcgcacgccg

SEQ ID NO: 21073 - DNA, 20 bp, Artificial Sequence
  sgRNA
gctgctgctgctgatgctac

SEQ ID NO: 21074 - DNA, 20 bp, Artificial Sequence
  sgRNA
gcagcccagggaggagaagg

SEQ ID NO: 21075 - DNA, 20 bp, Artificial Sequence
  sgRNA
agcagtggcagtagcggcag

SEQ ID NO: 21076 - DNA, 20 bp, Artificial Sequence
  sgRNA
tttatgtgagtagtatgacc

SEQ ID NO: 21077 - DNA, 20 bp, Artificial Sequence
  sgRNA
ccaaattgggaactgcaccc

SEQ ID NO: 21078 - DNA, 20 bp, Artificial Sequence
  sgRNA
cgcagttcgaagctagtccc

SEQ ID NO: 21079 - DNA, 20 bp, Artificial Sequence
  sgRNA
tcttcgggattcccgcgatg

SEQ ID NO: 21080 - DNA, 20 bp, Artificial Sequence
  sgRNA
tgactttccgctcagaggtg

SEQ ID NO: 21081 - DNA, 20 bp, Artificial Sequence
  sgRNA
tctgagagcaatttgtcaca

SEQ ID NO: 21082 - DNA, 20 bp, Artificial Sequence
  sgRNA
gtgggagccgaacccggaag

SEQ ID NO: 21083 - DNA, 20 bp, Artificial Sequence
  sgRNA
gccgcctcgaagccgagagc

SEQ ID NO: 21084 - DNA, 20 bp, Artificial Sequence
  sgRNA
ggcagcggcaagtctgactc

SEQ ID NO: 21085 - DNA, 20 bp, Artificial Sequence
  sgRNA
gggcttcccggcgatggaga

SEQ ID NO: 21086 - DNA, 20 bp, Artificial Sequence
  sgRNA
ggcgcgagcctctccggccg

SEQ ID NO: 21087 - DNA, 20 bp, Artificial Sequence
  sgRNA
ggccgcggccaatcgctgta

SEQ ID NO: 21088 - DNA, 20 bp, Artificial Sequence
  sgRNA
tcgtaggtcgatcgcctgtc

SEQ ID NO: 21089 - DNA, 20 bp, Artificial Sequence
  sgRNA
agaggcgacttccggcgcgg

SEQ ID NO: 21090 - DNA, 20 bp, Artificial Sequence
  sgRNA
agtccagagcggcgagccag

SEQ ID NO: 21091 - DNA, 20 bp, Artificial Sequence
  sgRNA
aaacctgaagctgaacagtt

SEQ ID NO: 21092 - DNA, 20 bp, Artificial Sequence
  sgRNA
tgagaacagagtcgcaacta

SEQ ID NO: 21093 - DNA, 20 bp, Artificial Sequence
  sgRNA
aagtgatccaatcaagactg

SEQ ID NO: 21094 - DNA, 20 bp, Artificial Sequence
  sgRNA
gtcgcggaagtgacgtgagg

SEQ ID NO: 21095 - DNA, 20 bp, Artificial Sequence
  sgRNA
tcagtcccagttcgtcctct

SEQ ID NO: 21096 - DNA, 20 bp, Artificial Sequence
  sgRNA
agcggagcagagtcctgccc

SEQ ID NO: 21097 - DNA, 20 bp, Artificial Sequence
  sgRNA
cgaaggagccgggcgcgcgc

SEQ ID NO: 21098 - DNA, 20 bp, Artificial Sequence
  sgRNA
ggcgggcgcacgcgcgcacc

SEQ ID NO: 21099 - DNA, 20 bp, Artificial Sequence
  sgRNA
cgcgccggcacgtgagctcc

SEQ ID NO: 21100 - DNA, 20 bp, Artificial Sequence
  sgRNA
ccaactctttaagagttctg

SEQ ID NO: 21101 - DNA, 20 bp, Artificial Sequence
  sgRNA
acacttacccgctcacacgc

SEQ ID NO: 21102 - DNA, 20 bp, Artificial Sequence
  sgRNA
gttaattacctacagagaac

SEQ ID NO: 21103 - DNA, 20 bp, Artificial Sequence
  sgRNA
tgataagtagggcttcaatc

SEQ ID NO: 21104 - DNA, 20 bp, Artificial Sequence
  sgRNA
tgtataacaggtgcaaagtg

SEQ ID NO: 21105 - DNA, 20 bp, Artificial Sequence
  sgRNA
gtcttggagagaccaactcc

SEQ ID NO: 21106 - DNA, 20 bp, Artificial Sequence
  sgRNA
cgcccaggtttgctggaggg

SEQ ID NO: 21107 - DNA, 20 bp, Artificial Sequence
  sgRNA
ttgcggtgggatgcaggaaa

SEQ ID NO: 21108 - DNA, 20 bp, Artificial Sequence
  sgRNA
ggcgctgctcgccctttatt

SEQ ID NO: 21109 - DNA, 20 bp, Artificial Sequence
  sgRNA
ttccctcacagcagcctacc

SEQ ID NO: 21110 - DNA, 20 bp, Artificial Sequence
  sgRNA
cccaaagcgtaattgctgcc

SEQ ID NO: 21111 - DNA, 20 bp, Artificial Sequence
  sgRNA
gccagacttgcaagcctcct

SEQ ID NO: 21112 - DNA, 20 bp, Artificial Sequence
  sgRNA
gtggatggagcctagggtgc

SEQ ID NO: 21113 - DNA, 20 bp, Artificial Sequence
  sgRNA
ttcttgttaacatggttaag

SEQ ID NO: 21114 - DNA, 20 bp, Artificial Sequence
  sgRNA
gggagtggctgggtgccaca

SEQ ID NO: 21115 - DNA, 20 bp, Artificial Sequence
  sgRNA
tccggttcattgcgggaggg

SEQ ID NO: 21116 - DNA, 20 bp, Artificial Sequence
  sgRNA
aaagattagtcataaaccag

SEQ ID NO: 21117 - DNA, 20 bp, Artificial Sequence
  sgRNA
aagagccggcctcttcatcc

SEQ ID NO: 21118 - DNA, 20 bp, Artificial Sequence
  sgRNA
gtggtagctgggatacatac

SEQ ID NO: 21119 - DNA, 20 bp, Artificial Sequence
  sgRNA
aggaagttggccagtttatg

SEQ ID NO: 21120 - DNA, 20 bp, Artificial Sequence
  sgRNA
gctcagtagtaggtaagagg

SEQ ID NO: 21121 - DNA, 20 bp, Artificial Sequence
  sgRNA
cgtgcgcagtgtctcgccta

SEQ ID NO: 21122 - DNA, 20 bp, Artificial Sequence
  sgRNA
cactgcgcaactgtgcagtt

SEQ ID NO: 21123 - DNA, 20 bp, Artificial Sequence
  sgRNA
tctgggtcatccctctccga

SEQ ID NO: 21124 - DNA, 20 bp, Artificial Sequence
  sgRNA
cctccgggctcattagcatc

SEQ ID NO: 21125 - DNA, 20 bp, Artificial Sequence
  sgRNA
gaggttgaagtcccatgtgc

SEQ ID NO: 21126 - DNA, 20 bp, Artificial Sequence
  sgRNA
ggagaacaggtgaattggat

SEQ ID NO: 21127 - DNA, 20 bp, Artificial Sequence
  sgRNA
tagagatgattgaaggtatt

SEQ ID NO: 21128 - DNA, 20 bp, Artificial Sequence
  sgRNA
ggatctgggagattatctga

SEQ ID NO: 21129 - DNA, 20 bp, Artificial Sequence
  sgRNA
tactaatggatcgcatgtca

SEQ ID NO: 21130 - DNA, 20 bp, Artificial Sequence
  sgRNA
agcgaacgctgctttcgacc

SEQ ID NO: 21131 - DNA, 20 bp, Artificial Sequence
  sgRNA
ccctcgctcctctcctagtg

SEQ ID NO: 21132 - DNA, 20 bp, Artificial Sequence
  sgRNA
agcattgctagtcctgtccc

SEQ ID NO: 21133 - DNA, 20 bp, Artificial Sequence
  sgRNA
ggctcaggacttggtctgcc

SEQ ID NO: 21134 - DNA, 20 bp, Artificial Sequence
  sgRNA
agatctgcgcgtgcgtagga

SEQ ID NO: 21135 - DNA, 20 bp, Artificial Sequence
  sgRNA
taactcgcgccggcgcagta

SEQ ID NO: 21136 - DNA, 20 bp, Artificial Sequence
  sgRNA
aagtgtccgtgggccgcgcg

SEQ ID NO: 21137 - DNA, 20 bp, Artificial Sequence
  sgRNA
cgaagcagcagccggcagat

SEQ ID NO: 21138 - DNA, 20 bp, Artificial Sequence
  sgRNA
tgctggccgcggcggtcgga

SEQ ID NO: 21139 - DNA, 20 bp, Artificial Sequence
  sgRNA
gactggtggctgtctcactg

SEQ ID NO: 21140 - DNA, 20 bp, Artificial Sequence
  sgRNA
ggagtccctgaacagaactg

SEQ ID NO: 21141 - DNA, 20 bp, Artificial Sequence
  sgRNA
tgagacaaagttcaggttgg

SEQ ID NO: 21142 - DNA, 20 bp, Artificial Sequence
  sgRNA
aaagtggtaccgagcaatag

SEQ ID NO: 21143 - DNA, 20 bp, Artificial Sequence
  sgRNA
ctgttgaagaccgactggaa

SEQ ID NO: 21144 - DNA, 20 bp, Artificial Sequence
  sgRNA
cgcggctgctacgtcacaga

SEQ ID NO: 21145 - DNA, 20 bp, Artificial Sequence
  sgRNA
ctcgggtccttgccctattc

SEQ ID NO: 21146 - DNA, 20 bp, Artificial Sequence
  sgRNA
gtaactcgggcgggtctgcc

SEQ ID NO: 21147 - DNA, 20 bp, Artificial Sequence
  sgRNA
gactaacactgaagccaccc

SEQ ID NO: 21148 - DNA, 20 bp, Artificial Sequence
  sgRNA
ccgagatcgtagagcttgat

SEQ ID NO: 21149 - DNA, 20 bp, Artificial Sequence
  sgRNA
acctagaacacagggctctg

SEQ ID NO: 21150 - DNA, 20 bp, Artificial Sequence
  sgRNA
ggtgagccagactgtgtaaa

SEQ ID NO: 21151 - DNA, 20 bp, Artificial Sequence
  sgRNA
agcaaagcagatggaaactc

SEQ ID NO: 21152 - DNA, 20 bp, Artificial Sequence
  sgRNA
gctaagaggtcaaggaaatg

SEQ ID NO: 21153 - DNA, 20 bp, Artificial Sequence
  sgRNA
gagagctgcattgagtcccg

SEQ ID NO: 21154 - DNA, 20 bp, Artificial Sequence
  sgRNA
gacgcagtagccgagttcta

SEQ ID NO: 21155 - DNA, 20 bp, Artificial Sequence
  sgRNA
aatttggatccgaggcttgt

SEQ ID NO: 21156 - DNA, 20 bp, Artificial Sequence
  sgRNA
ctaatggcagtggataggtg

SEQ ID NO: 21157 - DNA, 20 bp, Artificial Sequence
  sgRNA
caaggcgtgtagcccttctt

SEQ ID NO: 21158 - DNA, 20 bp, Artificial Sequence
  sgRNA
ctgtgtgagaaagcattaga

SEQ ID NO: 21159 - DNA, 20 bp, Artificial Sequence
  sgRNA
tgctgattggcttcgggagg

SEQ ID NO: 21160 - DNA, 20 bp, Artificial Sequence
  sgRNA
ggtgggagcctggtagggcg

SEQ ID NO: 21161 - DNA, 20 bp, Artificial Sequence
  sgRNA
cttgagtgagacgcgagggc

SEQ ID NO: 21162 - DNA, 20 bp, Artificial Sequence
  sgRNA
ggaggcacgctcgcagccaa

SEQ ID NO: 21163 - DNA, 20 bp, Artificial Sequence
  sgRNA
cgcgggactgggtggttcgc

SEQ ID NO: 21164 - DNA, 20 bp, Artificial Sequence
  sgRNA
ccatggtcacgggtaactag

SEQ ID NO: 21165 - DNA, 20 bp, Artificial Sequence
  sgRNA
actgctgcgagacaacctgt

SEQ ID NO: 21166 - DNA, 20 bp, Artificial Sequence
  sgRNA
agggaccggttcacgtgatc

SEQ ID NO: 21167 - DNA, 20 bp, Artificial Sequence
  sgRNA
ctgaccaaccactgtgcagc

SEQ ID NO: 21168 - DNA, 20 bp, Artificial Sequence
  sgRNA
gcgcacggcctttgattggt

SEQ ID NO: 21169 - DNA, 20 bp, Artificial Sequence
  sgRNA
gttccttcccacccatcggc

SEQ ID NO: 21170 - DNA, 20 bp, Artificial Sequence
  sgRNA
tgcctaactcttggcccacg

SEQ ID NO: 21171 - DNA, 20 bp, Artificial Sequence
  sgRNA
cagggatgtgtttactaagc

SEQ ID NO: 21172 - DNA, 20 bp, Artificial Sequence
  sgRNA
ataactttccttccttatgt

SEQ ID NO: 21173 - DNA, 20 bp, Artificial Sequence
  sgRNA
gcggagcctcagacacgcgc

SEQ ID NO: 21174 - DNA, 20 bp, Artificial Sequence
  sgRNA
cgctcgctgctgccacctgc

SEQ ID NO: 21175 - DNA, 20 bp, Artificial Sequence
  sgRNA
gggtgacagtgaatgacaga

SEQ ID NO: 21176 - DNA, 20 bp, Artificial Sequence
  sgRNA
ttcattggccagactggctg

SEQ ID NO: 21177 - DNA, 20 bp, Artificial Sequence
  sgRNA
agtgtgctctacgtgatgag

SEQ ID NO: 21178 - DNA, 20 bp, Artificial Sequence
  sgRNA
aagggaaagcttctaaatca

SEQ ID NO: 21179 - DNA, 20 bp, Artificial Sequence
  sgRNA
tgcagagttcccatcatctg

SEQ ID NO: 21180 - DNA, 20 bp, Artificial Sequence
  sgRNA
gaagcagggtgtaaacctcc

SEQ ID NO: 21181 - DNA, 20 bp, Artificial Sequence
  sgRNA
ggatgggatagagtcctgga

SEQ ID NO: 21182 - DNA, 20 bp, Artificial Sequence
  sgRNA
agcatcctgaatcttagggc

SEQ ID NO: 21183 - DNA, 20 bp, Artificial Sequence
  sgRNA
gggcgaggccatgccgccaa

SEQ ID NO: 21184 - DNA, 20 bp, Artificial Sequence
  sgRNA
ccatgacaccagattccagg

SEQ ID NO: 21185 - DNA, 20 bp, Artificial Sequence
  sgRNA
aaacccggagcagaccacca

SEQ ID NO: 21186 - DNA, 20 bp, Artificial Sequence
  sgRNA
agtcacaaatcctggaagcc

SEQ ID NO: 21187 - DNA, 20 bp, Artificial Sequence
  sgRNA
ttctcgatggttccgctttg

SEQ ID NO: 21188 - DNA, 20 bp, Artificial Sequence
  sgRNA
agccactctgtctctcttca

SEQ ID NO: 21189 - DNA, 20 bp, Artificial Sequence
  sgRNA
cctagaggcgcctgggccgg

SEQ ID NO: 21190 - DNA, 20 bp, Artificial Sequence
  sgRNA
aactgcgggtgtagctgcca

SEQ ID NO: 21191 - DNA, 20 bp, Artificial Sequence
  sgRNA
cacataaatctggtgcttgt

SEQ ID NO: 21192 - DNA, 20 bp, Artificial Sequence
  sgRNA
gaaagaagcacctttaccat

SEQ ID NO: 21193 - DNA, 20 bp, Artificial Sequence
  sgRNA
cagcagataatccagtgcgg

SEQ ID NO: 21194 - DNA, 20 bp, Artificial Sequence
  sgRNA
gttacataaacagccggccg

SEQ ID NO: 21195 - DNA, 20 bp, Artificial Sequence
  sgRNA
cagacacaggaatagttgcg

SEQ ID NO: 21196 - DNA, 20 bp, Artificial Sequence
  sgRNA
gcggccaggccacaaccgag

SEQ ID NO: 21197 - DNA, 20 bp, Artificial Sequence
  sgRNA
ggccctctggtggtagcacc

SEQ ID NO: 21198 - DNA, 20 bp, Artificial Sequence
  sgRNA
ccctaagggacccgcccgca

SEQ ID NO: 21199 - DNA, 20 bp, Artificial Sequence
  sgRNA
ctgtgggtgagctcgggatt

SEQ ID NO: 21200 - DNA, 20 bp, Artificial Sequence
  sgRNA
aatgttcggagcaccttgcc

SEQ ID NO: 21201 - DNA, 20 bp, Artificial Sequence
  sgRNA
gctccgcccacgccggatat

SEQ ID NO: 21202 - DNA, 20 bp, Artificial Sequence
  sgRNA
cgggtaacggtagagataaa

SEQ ID NO: 21203 - DNA, 20 bp, Artificial Sequence
  sgRNA
gcgttaagatcctgaaactg

SEQ ID NO: 21204 - DNA, 20 bp, Artificial Sequence
  sgRNA
cccaagtctgttagagcacg

SEQ ID NO: 21205 - DNA, 20 bp, Artificial Sequence
  sgRNA
gggctctgaaagactaagaa

SEQ ID NO: 21206 - DNA, 20 bp, Artificial Sequence
  sgRNA
cccaggattctttaaacaac

SEQ ID NO: 21207 - DNA, 20 bp, Artificial Sequence
  sgRNA
gaaagagattccctgctccc

SEQ ID NO: 21208 - DNA, 20 bp, Artificial Sequence
  sgRNA
caatctcaggttaacgtgta

SEQ ID NO: 21209 - DNA, 20 bp, Artificial Sequence
  sgRNA
aagtaagaaggtaaacacct

SEQ ID NO: 21210 - DNA, 20 bp, Artificial Sequence
  sgRNA
ttataatgtccatctgaggg

SEQ ID NO: 21211 - DNA, 20 bp, Artificial Sequence
  sgRNA
ttgctagctgctttgtctta

SEQ ID NO: 21212 - DNA, 20 bp, Artificial Sequence
  sgRNA
gtcggctccgctagggtgtg

SEQ ID NO: 21213 - DNA, 20 bp, Artificial Sequence
  sgRNA
gggagcgtctgtgcgcgtcg

SEQ ID NO: 21214 - DNA, 20 bp, Artificial Sequence
  sgRNA
aatcatgggtgactttgtgc

SEQ ID NO: 21215 - DNA, 20 bp, Artificial Sequence
  sgRNA
gaaccagcccgcgcgttgct

SEQ ID NO: 21216 - DNA, 20 bp, Artificial Sequence
  sgRNA
agcatacggtactgtgagcg

SEQ ID NO: 21217 - DNA, 20 bp, Artificial Sequence
  sgRNA
cgcttcctgctggagcgggc

SEQ ID NO: 21218 - DNA, 20 bp, Artificial Sequence
  sgRNA
ctcttcaactatgaatgtca

SEQ ID NO: 21219 - DNA, 20 bp, Artificial Sequence
  sgRNA
aagttaaggccaagcattcc

SEQ ID NO: 21220 - DNA, 20 bp, Artificial Sequence
  sgRNA
agtacaagaagtctgttctc

SEQ ID NO: 21221 - DNA, 20 bp, Artificial Sequence
  sgRNA
ctgatcccaatttccatcac

SEQ ID NO: 21222 - DNA, 20 bp, Artificial Sequence
  sgRNA
ataatccaaataccctgaca

SEQ ID NO: 21223 - DNA, 20 bp, Artificial Sequence
  sgRNA
cgccgcgccgttcagatccc

SEQ ID NO: 21224 - DNA, 20 bp, Artificial Sequence
  sgRNA
gagccgagggacccgcagag

SEQ ID NO: 21225 - DNA, 20 bp, Artificial Sequence
  sgRNA
gagcagtggacgggccgcgg

SEQ ID NO: 21226 - DNA, 20 bp, Artificial Sequence
  sgRNA
ggcaacaacaccttcgttcc

SEQ ID NO: 21227 - DNA, 20 bp, Artificial Sequence
  sgRNA
atgcccagcaaaggcctccg

SEQ ID NO: 21228 - DNA, 20 bp, Artificial Sequence
  sgRNA
cttagcgtccacgcctcagt

SEQ ID NO: 21229 - DNA, 20 bp, Artificial Sequence
  sgRNA
agggcgaggagaggacgagg

SEQ ID NO: 21230 - DNA, 20 bp, Artificial Sequence
  sgRNA
gagagagcagagagtggaga

SEQ ID NO: 21231 - DNA, 20 bp, Artificial Sequence
  sgRNA
actcgctatataaatatacg

SEQ ID NO: 21232 - DNA, 20 bp, Artificial Sequence
  sgRNA
aagattgattcagggtgatg

SEQ ID NO: 21233 - DNA, 20 bp, Artificial Sequence
  sgRNA
ataacttcgtcactttgtgg

SEQ ID NO: 21234 - DNA, 20 bp, Artificial Sequence
  sgRNA
gaagctcgtaggcttaatat

SEQ ID NO: 21235 - DNA, 20 bp, Artificial Sequence
  sgRNA
ccacccaaccgcgcgctccg

SEQ ID NO: 21236 - DNA, 20 bp, Artificial Sequence
  sgRNA
gtctttgtgcggaaggcctg

SEQ ID NO: 21237 - DNA, 20 bp, Artificial Sequence
  sgRNA
ctcgcaatcctaaccggttc

SEQ ID NO: 21238 - DNA, 20 bp, Artificial Sequence
  sgRNA
taaccaatcaacaccaagag

SEQ ID NO: 21239 - DNA, 20 bp, Artificial Sequence
  sgRNA
acagtgctagagaatcgatt

SEQ ID NO: 21240 - DNA, 20 bp, Artificial Sequence
  sgRNA
tactcaagaatgcagcatct

SEQ ID NO: 21241 - DNA, 20 bp, Artificial Sequence
  sgRNA
tatctagtcctcatttgcag

SEQ ID NO: 21242 - DNA, 20 bp, Artificial Sequence
  sgRNA
gggcgggatcagcaggaccg

SEQ ID NO: 21243 - DNA, 20 bp, Artificial Sequence
  sgRNA
atccggagggtgtagtgggc

SEQ ID NO: 21244 - DNA, 20 bp, Artificial Sequence
  sgRNA
cccgctcgcggccagaggga

SEQ ID NO: 21245 - DNA, 20 bp, Artificial Sequence
  sgRNA
tggccagtcaagtggtcccg

SEQ ID NO: 21246 - DNA, 20 bp, Artificial Sequence
  sgRNA
ctattggctaatctacagtg

SEQ ID NO: 21247 - DNA, 20 bp, Artificial Sequence
  sgRNA
gctgcccagctaaatagttg

SEQ ID NO: 21248 - DNA, 20 bp, Artificial Sequence
  sgRNA
gttggtgtgcaagtttcttt

SEQ ID NO: 21249 - DNA, 20 bp, Artificial Sequence
  sgRNA
cttatgacaggcgcgccatt

SEQ ID NO: 21250 - DNA, 20 bp, Artificial Sequence
  sgRNA
cccacgcctttgcgtacatc

SEQ ID NO: 21251 - DNA, 20 bp, Artificial Sequence
  sgRNA
ttcctgttccggtcggactc

SEQ ID NO: 21252 - DNA, 20 bp, Artificial Sequence
  sgRNA
tggaatccatgccgacgagc

SEQ ID NO: 21253 - DNA, 20 bp, Artificial Sequence
  sgRNA
gcggcgaccgctgaagacag

SEQ ID NO: 21254 - DNA, 20 bp, Artificial Sequence
  sgRNA
cacaggagatctaggcacga

SEQ ID NO: 21255 - DNA, 20 bp, Artificial Sequence
  sgRNA
gggtggcggctaggcgttcc

SEQ ID NO: 21256 - DNA, 20 bp, Artificial Sequence
  sgRNA
tcaggatcacaggtgaaagt

SEQ ID NO: 21257 - DNA, 20 bp, Artificial Sequence
  sgRNA
atctcgcggcgcttggccgg

SEQ ID NO: 21258 - DNA, 20 bp, Artificial Sequence
  sgRNA
cccggcgacccactaaagcc

SEQ ID NO: 21259 - DNA, 20 bp, Artificial Sequence
  sgRNA
aaagcgactgctctaggagg

SEQ ID NO: 21260 - DNA, 20 bp, Artificial Sequence
  sgRNA
aaccttggctagtctgaacg

SEQ ID NO: 21261 - DNA, 20 bp, Artificial Sequence
  sgRNA
gcaatttccttgccgcgccc

SEQ ID NO: 21262 - DNA, 20 bp, Artificial Sequence
  sgRNA
gtggccgccgcggatgctag

SEQ ID NO: 21263 - DNA, 20 bp, Artificial Sequence
  sgRNA
tccaacactgggatggaatg

SEQ ID NO: 21264 - DNA, 20 bp, Artificial Sequence
  sgRNA
aacagaagaatgcccaccca

SEQ ID NO: 21265 - DNA, 20 bp, Artificial Sequence
  sgRNA
agtgggagacaagaggcgac

SEQ ID NO: 21266 - DNA, 20 bp, Artificial Sequence
  sgRNA
gcggctgcaggcggaccctg

SEQ ID NO: 21267 - DNA, 20 bp, Artificial Sequence
  sgRNA
ttggatccgcgcgggccgcc

SEQ ID NO: 21268 - DNA, 20 bp, Artificial Sequence
  sgRNA
gccgctctgagcgccgagcc

SEQ ID NO: 21269 - DNA, 20 bp, Artificial Sequence
  sgRNA
gggccggcgggcccgggagc

SEQ ID NO: 21270 - DNA, 20 bp, Artificial Sequence
  sgRNA
gggcgcctaggcgccggcgg

SEQ ID NO: 21271 - DNA, 20 bp, Artificial Sequence
  sgRNA
gaagcgacgagggcgggcgg

SEQ ID NO: 21272 - DNA, 20 bp, Artificial Sequence
  sgRNA
gcgctgagcggcaggcgaag

SEQ ID NO: 21273 - DNA, 20 bp, Artificial Sequence
  sgRNA
cctgcgcaactgcgagcagc

SEQ ID NO: 21274 - DNA, 20 bp, Artificial Sequence
  sgRNA
aatggaatgagaaagcggag

SEQ ID NO: 21275 - DNA, 20 bp, Artificial Sequence
  sgRNA
gaaatggcacaggcggcagc

SEQ ID NO: 21276 - DNA, 20 bp, Artificial Sequence
  sgRNA
gcgagagtgtgcgcgcgccg

SEQ ID NO: 21277 - DNA, 20 bp, Artificial Sequence
  sgRNA
gcgagtgtgtgtgtgcgcgg

SEQ ID NO: 21278 - DNA, 20 bp, Artificial Sequence
  sgRNA
ggttcctgccggtccgccca

SEQ ID NO: 21279 - DNA, 20 bp, Artificial Sequence
  sgRNA
gaatctgtcaggcagctagg

SEQ ID NO: 21280 - DNA, 20 bp, Artificial Sequence
  sgRNA
ttggatttgaggtcagaggg

SEQ ID NO: 21281 - DNA, 20 bp, Artificial Sequence
  sgRNA
cccttccagtctctagtccc

SEQ ID NO: 21282 - DNA, 20 bp, Artificial Sequence
  sgRNA
ttcttagactcttaatttcc

SEQ ID NO: 21283 - DNA, 20 bp, Artificial Sequence
  sgRNA
ggaggtgtaggagatggtgg

SEQ ID NO: 21284 - DNA, 20 bp, Artificial Sequence
  sgRNA
gtgtctttgactcgcgcgcg

SEQ ID NO: 21285 - DNA, 20 bp, Artificial Sequence
  sgRNA
tgtcagccttatcagccaat

SEQ ID NO: 21286 - DNA, 20 bp, Artificial Sequence
  sgRNA
ccaacaaggaacgctctcat

SEQ ID NO: 21287 - DNA, 20 bp, Artificial Sequence
  sgRNA
gagagaacacccttaactgc

SEQ ID NO: 21288 - DNA, 20 bp, Artificial Sequence
  sgRNA
gggtcaccctgctaagccta

SEQ ID NO: 21289 - DNA, 20 bp, Artificial Sequence
  sgRNA
cccaaatgcagatgtgggcg

SEQ ID NO: 21290 - DNA, 20 bp, Artificial Sequence
  sgRNA
aactccggccgagaacaccc

SEQ ID NO: 21291 - DNA, 20 bp, Artificial Sequence
  sgRNA
gggccaaggaagggttaacg

SEQ ID NO: 21292 - DNA, 20 bp, Artificial Sequence
  sgRNA
gggagctgagtgtgccacgg

SEQ ID NO: 21293 - DNA, 20 bp, Artificial Sequence
  sgRNA
gttgacttcccggagagaga

SEQ ID NO: 21294 - DNA, 20 bp, Artificial Sequence
  sgRNA
ttctgctgggcttaagtcct

SEQ ID NO: 21295 - DNA, 20 bp, Artificial Sequence
  sgRNA
cgatagctgccgccaagccg

SEQ ID NO: 21296 - DNA, 20 bp, Artificial Sequence
  sgRNA
agaggatcagagcgtgcgcg

SEQ ID NO: 21297 - DNA, 20 bp, Artificial Sequence
  sgRNA
cctagtgggatgggagcatt

SEQ ID NO: 21298 - DNA, 20 bp, Artificial Sequence
  sgRNA
gcacggtcacagagcatcgc

SEQ ID NO: 21299 - DNA, 20 bp, Artificial Sequence
  sgRNA
tgctaagtgttggaaggata

SEQ ID NO: 21300 - DNA, 20 bp, Artificial Sequence
  sgRNA
ctggttccagataagcctcg

SEQ ID NO: 21301 - DNA, 20 bp, Artificial Sequence
  sgRNA
gggtgcgtgaggctgcaggg

SEQ ID NO: 21302 - DNA, 20 bp, Artificial Sequence
  sgRNA
ctgtgcttctgacgtcaggg

SEQ ID NO: 21303 - DNA, 20 bp, Artificial Sequence
  sgRNA
acacgcctaatccagttccg

SEQ ID NO: 21304 - DNA, 20 bp, Artificial Sequence
  sgRNA
gttataaaggcttctgtcgc

SEQ ID NO: 21305 - DNA, 20 bp, Artificial Sequence
  sgRNA
gatagcccaagccgccatcc

SEQ ID NO: 21306 - DNA, 20 bp, Artificial Sequence
  sgRNA
cgctgctcacgtgtgccggg

SEQ ID NO: 21307 - DNA, 20 bp, Artificial Sequence
  sgRNA
ccgagggagtttggcgcgat

SEQ ID NO: 21308 - DNA, 20 bp, Artificial Sequence
  sgRNA
gctcgccatcccaccgctac

SEQ ID NO: 21309 - DNA, 20 bp, Artificial Sequence
  sgRNA
gcgccgggcaataacttccg

SEQ ID NO: 21310 - DNA, 20 bp, Artificial Sequence
  sgRNA
gaaggagaagttaccaagtt

SEQ ID NO: 21311 - DNA, 20 bp, Artificial Sequence
  sgRNA
cgatcacaattgctcaggaa

SEQ ID NO: 21312 - DNA, 20 bp, Artificial Sequence
  sgRNA
gaaggtgtggtctctaagta

SEQ ID NO: 21313 - DNA, 20 bp, Artificial Sequence
  sgRNA
ttaaagggcaggtgtggccg

SEQ ID NO: 21314 - DNA, 20 bp, Artificial Sequence
  sgRNA
cttcataaggagacggttct

SEQ ID NO: 21315 - DNA, 20 bp, Artificial Sequence
  sgRNA
ggcagggcgtagagtgccgc

SEQ ID NO: 21316 - DNA, 20 bp, Artificial Sequence
  sgRNA
cgcgtgtctccctgacgacg

SEQ ID NO: 21317 - DNA, 20 bp, Artificial Sequence
  sgRNA
agcgtgcttcttacacaccg

SEQ ID NO: 21318 - DNA, 20 bp, Artificial Sequence
  sgRNA
gaagaaatcttccagagcga

SEQ ID NO: 21319 - DNA, 20 bp, Artificial Sequence
  sgRNA
aaggtcccgccagaagacta

SEQ ID NO: 21320 - DNA, 20 bp, Artificial Sequence
  sgRNA
acgcgggagagccgggtctg

SEQ ID NO: 21321 - DNA, 20 bp, Artificial Sequence
  sgRNA
agcggagccggaactcgagg

SEQ ID NO: 21322 - DNA, 20 bp, Artificial Sequence
  sgRNA
agcctgcgcgaggccggccc

SEQ ID NO: 21323 - DNA, 20 bp, Artificial Sequence
  sgRNA
acgcatctctgggcgggaag

SEQ ID NO: 21324 - DNA, 20 bp, Artificial Sequence
  sgRNA
agcgacaagtcctcgactct

SEQ ID NO: 21325 - DNA, 20 bp, Artificial Sequence
  sgRNA
tcggtgctccacgtagtagc

SEQ ID NO: 21326 - DNA, 20 bp, Artificial Sequence
  sgRNA
aactcctcaagtgcagatct

SEQ ID NO: 21327 - DNA, 20 bp, Artificial Sequence
  sgRNA
tacaagggcaaaggaacggg

SEQ ID NO: 21328 - DNA, 20 bp, Artificial Sequence
  sgRNA
cacagaaactattaatagtc

SEQ ID NO: 21329 - DNA, 20 bp, Artificial Sequence
  sgRNA
tggtgcattgctggagcgaa

SEQ ID NO: 21330 - DNA, 20 bp, Artificial Sequence
  sgRNA
gtttacttgctagcagagtg

SEQ ID NO: 21331 - DNA, 20 bp, Artificial Sequence
  sgRNA
aaatacagtgtggtgtttag

SEQ ID NO: 21332 - DNA, 20 bp, Artificial Sequence
  sgRNA
gtgatttgaatttggctcgg

SEQ ID NO: 21333 - DNA, 20 bp, Artificial Sequence
  sgRNA
ggcgttggagcgcggcgggc

SEQ ID NO: 21334 - DNA, 20 bp, Artificial Sequence
  sgRNA
gggaggcagtggcgagaggc

SEQ ID NO: 21335 - DNA, 20 bp, Artificial Sequence
  sgRNA
acgtggtggcagacgcacag

SEQ ID NO: 21336 - DNA, 20 bp, Artificial Sequence
  sgRNA
tggcggcgtactgctgcgag

SEQ ID NO: 21337 - DNA, 20 bp, Artificial Sequence
  sgRNA
cactcactcagaagcaagct

SEQ ID NO: 21338 - DNA, 20 bp, Artificial Sequence
  sgRNA
aaagttccgacagctggcgg

SEQ ID NO: 21339 - DNA, 20 bp, Artificial Sequence
  sgRNA
ctcttccgaggccgggttcg

SEQ ID NO: 21340 - DNA, 20 bp, Artificial Sequence
  sgRNA
tgcggtggctatcggcgtct

SEQ ID NO: 21341 - DNA, 20 bp, Artificial Sequence
  sgRNA
ggatgttgatgcggaagttt

SEQ ID NO: 21342 - DNA, 20 bp, Artificial Sequence
  sgRNA
cgctgagtcatccaagtccc

SEQ ID NO: 21343 - DNA, 20 bp, Artificial Sequence
  sgRNA
gagggtctcacataaagtcg

SEQ ID NO: 21344 - DNA, 20 bp, Artificial Sequence
  sgRNA
tcacaagtctattatttcct

SEQ ID NO: 21345 - DNA, 20 bp, Artificial Sequence
  sgRNA
gggccctgacgtcagcgccg

SEQ ID NO: 21346 - DNA, 20 bp, Artificial Sequence
  sgRNA
ggctttgtgcgcccggagcg

SEQ ID NO: 21347 - DNA, 20 bp, Artificial Sequence
  sgRNA
agaagccctaggtgcgatag

SEQ ID NO: 21348 - DNA, 20 bp, Artificial Sequence
  sgRNA
tctgtgctcagccggcgctg

SEQ ID NO: 21349 - DNA, 20 bp, Artificial Sequence
  sgRNA
ctatgggtcaggatcctcag

SEQ ID NO: 21350 - DNA, 20 bp, Artificial Sequence
  sgRNA
atgtcaggagccgccgatcc

SEQ ID NO: 21351 - DNA, 20 bp, Artificial Sequence
  sgRNA
tctgtaaagttcgagggagc

SEQ ID NO: 21352 - DNA, 20 bp, Artificial Sequence
  sgRNA
agggcagcgatgatcccagc

SEQ ID NO: 21353 - DNA, 20 bp, Artificial Sequence
  sgRNA
tttggcatcgatgggagaga

SEQ ID NO: 21354 - DNA, 20 bp, Artificial Sequence
  sgRNA
gggagacaagctgaaatctt

SEQ ID NO: 21355 - DNA, 20 bp, Artificial Sequence
  sgRNA
caatgctgcagaggtcctaa

SEQ ID NO: 21356 - DNA, 20 bp, Artificial Sequence
  sgRNA
gcagcgtggtaggagtcacg

SEQ ID NO: 21357 - DNA, 20 bp, Artificial Sequence
  sgRNA
agctttgcgcttgcttcttt

SEQ ID NO: 21358 - DNA, 20 bp, Artificial Sequence
  sgRNA
gctgctcattggccggcagc

SEQ ID NO: 21359 - DNA, 20 bp, Artificial Sequence
  sgRNA
gaggcgggaattaggctgaa

SEQ ID NO: 21360 - DNA, 20 bp, Artificial Sequence
  sgRNA
acaacttcagggctgagact

SEQ ID NO: 21361 - DNA, 20 bp, Artificial Sequence
  sgRNA
tgttcaccagagaaagcaag

SEQ ID NO: 21362 - DNA, 20 bp, Artificial Sequence
  sgRNA
gaggagggcgagcgatgacg

SEQ ID NO: 21363 - DNA, 20 bp, Artificial Sequence
  sgRNA
actgctttctgaccagtggg

SEQ ID NO: 21364 - DNA, 20 bp, Artificial Sequence
  sgRNA
ttgcctgtgcgtacagaagg

SEQ ID NO: 21365 - DNA, 20 bp, Artificial Sequence
  sgRNA
ggccctccaattccacagcc

SEQ ID NO: 21366 - DNA, 20 bp, Artificial Sequence
  sgRNA
cgttgcgcccgctgtacagt

SEQ ID NO: 21367 - DNA, 20 bp, Artificial Sequence
  sgRNA
actccctgcttgcaccctcc

SEQ ID NO: 21368 - DNA, 20 bp, Artificial Sequence
  sgRNA
aagtctcgcgagggcgcggc

SEQ ID NO: 21369 - DNA, 20 bp, Artificial Sequence
  sgRNA
agaactcccaagagcactcg

SEQ ID NO: 21370 - DNA, 20 bp, Artificial Sequence
  sgRNA
ggagcagctgcgtgatgctg

SEQ ID NO: 21371 - DNA, 20 bp, Artificial Sequence
  sgRNA
tcgcggatgctcccgagctg

SEQ ID NO: 21372 - DNA, 20 bp, Artificial Sequence
  sgRNA
cggcccgaggcaagcggcgt

SEQ ID NO: 21373 - DNA, 20 bp, Artificial Sequence
  sgRNA
cggcactgtggtcaagccct

SEQ ID NO: 21374 - DNA, 20 bp, Artificial Sequence
  sgRNA
ccacgtcactgtgagaattg

SEQ ID NO: 21375 - DNA, 20 bp, Artificial Sequence
  sgRNA
atgagagtctgtcattggtg

SEQ ID NO: 21376 - DNA, 20 bp, Artificial Sequence
  sgRNA
acaaatggactgggcattct

SEQ ID NO: 21377 - DNA, 20 bp, Artificial Sequence
  sgRNA
gggttcccacggtgcggcga

SEQ ID NO: 21378 - DNA, 20 bp, Artificial Sequence
  sgRNA
gctgcacgagctaggtccgc

SEQ ID NO: 21379 - DNA, 20 bp, Artificial Sequence
  sgRNA
gagccgcggcttcaggcgcg

SEQ ID NO: 21380 - DNA, 20 bp, Artificial Sequence
  sgRNA
catggcggacgacgtagatc

SEQ ID NO: 21381 - DNA, 20 bp, Artificial Sequence
  sgRNA
cgccctcgtagtttgcatgg

SEQ ID NO: 21382 - DNA, 20 bp, Artificial Sequence
  sgRNA
tatagttcgccttcagtgcg

SEQ ID NO: 21383 - DNA, 20 bp, Artificial Sequence
  sgRNA
cactcagagccgcgggaggc

SEQ ID NO: 21384 - DNA, 20 bp, Artificial Sequence
  sgRNA
aatgtagcctgagaaagagg

SEQ ID NO: 21385 - DNA, 20 bp, Artificial Sequence
  sgRNA
taccggtgtgttgccgcctg

SEQ ID NO: 21386 - DNA, 20 bp, Artificial Sequence
  sgRNA
cgccctcctccctcggcgcg

SEQ ID NO: 21387 - DNA, 20 bp, Artificial Sequence
  sgRNA
ccggagcgcaggcacgcccg

SEQ ID NO: 21388 - DNA, 20 bp, Artificial Sequence
  sgRNA
cctcatagtccgccgcccgc

SEQ ID NO: 21389 - DNA, 20 bp, Artificial Sequence
  sgRNA
tcttagcagtgggagtgagg

SEQ ID NO: 21390 - DNA, 20 bp, Artificial Sequence
  sgRNA
ggaggaggcaccacggcctc

SEQ ID NO: 21391 - DNA, 20 bp, Artificial Sequence
  sgRNA
ctgcttctcacgtcatgagc

SEQ ID NO: 21392 - DNA, 20 bp, Artificial Sequence
  sgRNA
ttatcccaccaatcggtctc

SEQ ID NO: 21393 - DNA, 20 bp, Artificial Sequence
  sgRNA
acgggtcaggccttggttca

SEQ ID NO: 21394 - DNA, 20 bp, Artificial Sequence
  sgRNA
ttctagaagagactgtcagg

SEQ ID NO: 21395 - DNA, 20 bp, Artificial Sequence
  sgRNA
gacctaggtaaacattaatc

SEQ ID NO: 21396 - DNA, 20 bp, Artificial Sequence
  sgRNA
aggagaattccgactttatc

SEQ ID NO: 21397 - DNA, 20 bp, Artificial Sequence
  sgRNA
taggatcctgcacttagtta

SEQ ID NO: 21398 - DNA, 20 bp, Artificial Sequence
  sgRNA
gaaagaaaggaagagcgctg

SEQ ID NO: 21399 - DNA, 20 bp, Artificial Sequence
  sgRNA
cccgccctcagcgcccggcc

SEQ ID NO: 21400 - DNA, 20 bp, Artificial Sequence
  sgRNA
ctgaggtggacagggagagg

SEQ ID NO: 21401 - DNA, 20 bp, Artificial Sequence
  sgRNA
gggagcgctcgcaaccgccg

SEQ ID NO: 21402 - DNA, 20 bp, Artificial Sequence
  sgRNA
aacttggactgagaatttgc

SEQ ID NO: 21403 - DNA, 20 bp, Artificial Sequence
  sgRNA
gagtcccaaatcaggcaaag

SEQ ID NO: 21404 - DNA, 20 bp, Artificial Sequence
  sgRNA
ggcgggccgggccggatccg

SEQ ID NO: 21405 - DNA, 20 bp, Artificial Sequence
  sgRNA
ggagactgggcgcctagcac

SEQ ID NO: 21406 - DNA, 20 bp, Artificial Sequence
  sgRNA
cgggacgccggcgtccgctg

SEQ ID NO: 21407 - DNA, 20 bp, Artificial Sequence
  sgRNA
ccggtcggaatcccagctcc

SEQ ID NO: 21408 - DNA, 20 bp, Artificial Sequence
  sgRNA
gtcggcctgcagcactagcc

SEQ ID NO: 21409 - DNA, 20 bp, Artificial Sequence
  sgRNA
cgatatggccggacttctcg

SEQ ID NO: 21410 - DNA, 20 bp, Artificial Sequence
  sgRNA
gctattgctagtgtctagac

SEQ ID NO: 21411 - DNA, 20 bp, Artificial Sequence
  sgRNA
aggcatccttagcattcatg

SEQ ID NO: 21412 - DNA, 20 bp, Artificial Sequence
  sgRNA
ggtgatagaacagagcagga

SEQ ID NO: 21413 - DNA, 20 bp, Artificial Sequence
  sgRNA
ggacgcgacaccgagaaacg

SEQ ID NO: 21414 - DNA, 20 bp, Artificial Sequence
  sgRNA
agaggaagcacgtgaccgcc

SEQ ID NO: 21415 - DNA, 20 bp, Artificial Sequence
  sgRNA
aaaggactcgaccaatccga

SEQ ID NO: 21416 - DNA, 20 bp, Artificial Sequence
  sgRNA
agtgcatgctaatgagcgcg

SEQ ID NO: 21417 - DNA, 20 bp, Artificial Sequence
  sgRNA
tcctacctgaggtttggtcc

SEQ ID NO: 21418 - DNA, 20 bp, Artificial Sequence
  sgRNA
tagcttcagcatccctgatc

SEQ ID NO: 21419 - DNA, 20 bp, Artificial Sequence
  sgRNA
ctatgacacatccaggatcc

SEQ ID NO: 21420 - DNA, 20 bp, Artificial Sequence
  sgRNA
ctcttgtgcatggtgttgtc

SEQ ID NO: 21421 - DNA, 20 bp, Artificial Sequence
  sgRNA
ggctgcccatgctcacttcc

SEQ ID NO: 21422 - DNA, 20 bp, Artificial Sequence
  sgRNA
gcagtgagcgtggttctctg

SEQ ID NO: 21423 - DNA, 20 bp, Artificial Sequence
  sgRNA
cctccgcttgaatccatacg

SEQ ID NO: 21424 - DNA, 20 bp, Artificial Sequence
  sgRNA
aggtgcaatgggagatgcaa

SEQ ID NO: 21425 - DNA, 20 bp, Artificial Sequence
  sgRNA
gcggccgtccgcggtctgat

SEQ ID NO: 21426 - DNA, 20 bp, Artificial Sequence
  sgRNA
ttggccaatggtcgccaccg

SEQ ID NO: 21427 - DNA, 20 bp, Artificial Sequence
  sgRNA
gctagtgaaccaataggaag

SEQ ID NO: 21428 - DNA, 20 bp, Artificial Sequence
  sgRNA
ctagatataattgaaagccc

SEQ ID NO: 21429 - DNA, 20 bp, Artificial Sequence
  sgRNA
tacttcctgccttgaacact

SEQ ID NO: 21430 - DNA, 20 bp, Artificial Sequence
  sgRNA
caggagtaagcaatgccagg

SEQ ID NO: 21431 - DNA, 20 bp, Artificial Sequence
  sgRNA
ttaacttgctagctctgggc

SEQ ID NO: 21432 - DNA, 20 bp, Artificial Sequence
  sgRNA
catgccagggcattccagct

SEQ ID NO: 21433 - DNA, 20 bp, Artificial Sequence
  sgRNA
tttcctctagagagatctaa

SEQ ID NO: 21434 - DNA, 20 bp, Artificial Sequence
  sgRNA
gctggtgtcactagttgcca

SEQ ID NO: 21435 - DNA, 20 bp, Artificial Sequence
  sgRNA
cccagagcctacgattctcc

SEQ ID NO: 21436 - DNA, 20 bp, Artificial Sequence
  sgRNA
gctgcacaccttactacaca

SEQ ID NO: 21437 - DNA, 20 bp, Artificial Sequence
  sgRNA
gtgtctttgactcgcgcgcg

SEQ ID NO: 21438 - DNA, 20 bp, Artificial Sequence
  sgRNA
tgtcagccttatcagccaat

SEQ ID NO: 21439 - DNA, 20 bp, Artificial Sequence
  sgRNA
ccaacaaggaacgctctcat

SEQ ID NO: 21440 - DNA, 20 bp, Artificial Sequence
  sgRNA
tgagattgccaagtttgaaa

SEQ ID NO: 21441 - DNA, 20 bp, Artificial Sequence
  sgRNA
gaggtaatgcagacccatac

SEQ ID NO: 21442 - DNA, 20 bp, Artificial Sequence
  sgRNA
cacttattgatgataggcca

SEQ ID NO: 21443 - DNA, 20 bp, Artificial Sequence
  sgRNA
tgatccgtaggcacgccctt

SEQ ID NO: 21444 - DNA, 20 bp, Artificial Sequence
  sgRNA
tggcagtcgcaggccaatag

SEQ ID NO: 21445 - DNA, 20 bp, Artificial Sequence
  sgRNA
ccgagcccaccttgaggccg

SEQ ID NO: 21446 - DNA, 20 bp, Artificial Sequence
  sgRNA
gcgctctgacgttctttgca

SEQ ID NO: 21447 - DNA, 20 bp, Artificial Sequence
  sgRNA
aactagacctaagccaatag

SEQ ID NO: 21448 - DNA, 20 bp, Artificial Sequence
  sgRNA
gcccttgcaaagtgcttgta

SEQ ID NO: 21449 - DNA, 20 bp, Artificial Sequence
  sgRNA
tttggatggagtggatatcg

SEQ ID NO: 21450 - DNA, 20 bp, Artificial Sequence
  sgRNA
atcgagccagccaaagaccc

SEQ ID NO: 21451 - DNA, 20 bp, Artificial Sequence
  sgRNA
gagaccaatcattatgttcc

SEQ ID NO: 21452 - DNA, 20 bp, Artificial Sequence
  sgRNA
tcgttctgcgattggtcggt

SEQ ID NO: 21453 - DNA, 20 bp, Artificial Sequence
  sgRNA
aacagttgctagggacgcac

SEQ ID NO: 21454 - DNA, 20 bp, Artificial Sequence
  sgRNA
cgcgaagaaatcgggtcttt

SEQ ID NO: 21455 - DNA, 20 bp, Artificial Sequence
  sgRNA
ttacgtttactagcaatact

SEQ ID NO: 21456 - DNA, 20 bp, Artificial Sequence
  sgRNA
atttacccttgaccatttca

SEQ ID NO: 21457 - DNA, 20 bp, Artificial Sequence
  sgRNA
tgttaaccagatagtcaaat

SEQ ID NO: 21458 - DNA, 20 bp, Artificial Sequence
  sgRNA
aaaggctgatgagctgtggt

SEQ ID NO: 21459 - DNA, 20 bp, Artificial Sequence
  sgRNA
catctggcaccagtgtgtgg

SEQ ID NO: 21460 - DNA, 20 bp, Artificial Sequence
  sgRNA
gactcggccaaagatttagc

SEQ ID NO: 21461 - DNA, 20 bp, Artificial Sequence
  sgRNA
gcgcgtgattgacaagggcg

SEQ ID NO: 21462 - DNA, 20 bp, Artificial Sequence
  sgRNA
caatcgttgagcggcctccg

SEQ ID NO: 21463 - DNA, 20 bp, Artificial Sequence
  sgRNA
gggtgatgcgtgctcctcag

SEQ ID NO: 21464 - DNA, 20 bp, Artificial Sequence
  sgRNA
gctcagcccaagagattgtc

SEQ ID NO: 21465 - DNA, 20 bp, Artificial Sequence
  sgRNA
gaactgagtgcgccagagag

SEQ ID NO: 21466 - DNA, 20 bp, Artificial Sequence
  sgRNA
atctttgacttctagcttgg

SEQ ID NO: 21467 - DNA, 20 bp, Artificial Sequence
  sgRNA
gcgggctcgtctccgagggc

SEQ ID NO: 21468 - DNA, 20 bp, Artificial Sequence
  sgRNA
gcacacacggtgcaggctgc

SEQ ID NO: 21469 - DNA, 20 bp, Artificial Sequence
  sgRNA
cctgggttctttctcttccg

SEQ ID NO: 21470 - DNA, 20 bp, Artificial Sequence
  sgRNA
ggtaacctctgacccaaatc

SEQ ID NO: 21471 - DNA, 20 bp, Artificial Sequence
  sgRNA
ctagatagccattgggaggg

SEQ ID NO: 21472 - DNA, 20 bp, Artificial Sequence
  sgRNA
gaccagagaagtacttatag

SEQ ID NO: 21473 - DNA, 20 bp, Artificial Sequence
  sgRNA
gatttctctggaatcctaag

SEQ ID NO: 21474 - DNA, 20 bp, Artificial Sequence
  sgRNA
attgaatctgttcagacacc

SEQ ID NO: 21475 - DNA, 20 bp, Artificial Sequence
  sgRNA
agacaccacacagacgtggg

SEQ ID NO: 21476 - DNA, 20 bp, Artificial Sequence
  sgRNA
catgcgtggtagggctggcc

SEQ ID NO: 21477 - DNA, 20 bp, Artificial Sequence
  sgRNA
tgctgcactaaggaacgaat

SEQ ID NO: 21478 - DNA, 20 bp, Artificial Sequence
  sgRNA
gcgctcgcgctcatgttgct

SEQ ID NO: 21479 - DNA, 20 bp, Artificial Sequence
  sgRNA
gctcatagggtagggagggc

SEQ ID NO: 21480 - DNA, 20 bp, Artificial Sequence
  sgRNA
ctagtgtaaactggagagtg

SEQ ID NO: 21481 - DNA, 20 bp, Artificial Sequence
  sgRNA
tccctctgtttatctcccat

SEQ ID NO: 21482 - DNA, 20 bp, Artificial Sequence
  sgRNA
ctctagaagctagataagcg

SEQ ID NO: 21483 - DNA, 20 bp, Artificial Sequence
  sgRNA
aaacagctacaaggcttgct

SEQ ID NO: 21484 - DNA, 20 bp, Artificial Sequence
  sgRNA
ggcaataacagcttcagcag

SEQ ID NO: 21485 - DNA, 20 bp, Artificial Sequence
  sgRNA
gccagctgtagggagcaaag

SEQ ID NO: 21486 - DNA, 20 bp, Artificial Sequence
  sgRNA
agatctcccaaaccctctta

SEQ ID NO: 21487 - DNA, 20 bp, Artificial Sequence
  sgRNA
caggaaggagcaagtcaggg

SEQ ID NO: 21488 - DNA, 20 bp, Artificial Sequence
  sgRNA
cttcgctcagctactcttta

SEQ ID NO: 21489 - DNA, 20 bp, Artificial Sequence
  sgRNA
tccttacctaaactccaaga

SEQ ID NO: 21490 - DNA, 20 bp, Artificial Sequence
  sgRNA
gagtaaatgttcccaccagg

SEQ ID NO: 21491 - DNA, 20 bp, Artificial Sequence
  sgRNA
cggagggccgtggaagcgca

SEQ ID NO: 21492 - DNA, 20 bp, Artificial Sequence
  sgRNA
ggagaatgcgcagcgtggct

SEQ ID NO: 21493 - DNA, 20 bp, Artificial Sequence
  sgRNA
gactcggcgcgctacgctcg

SEQ ID NO: 21494 - DNA, 20 bp, Artificial Sequence
  sgRNA
gggtcttggattggttagag

SEQ ID NO: 21495 - DNA, 20 bp, Artificial Sequence
  sgRNA
aaggcaacagcttggcgcca

SEQ ID NO: 21496 - DNA, 20 bp, Artificial Sequence
  sgRNA
acaacagcagtctgattggc

SEQ ID NO: 21497 - DNA, 20 bp, Artificial Sequence
  sgRNA
gggtcgtgcctgaggttcgg

SEQ ID NO: 21498 - DNA, 20 bp, Artificial Sequence
  sgRNA
cgagccgactggacagactg

SEQ ID NO: 21499 - DNA, 20 bp, Artificial Sequence
  sgRNA
gtgcaccacttccgttgtgt

SEQ ID NO: 21500 - DNA, 20 bp, Artificial Sequence
  sgRNA
caggcggatatctgagtttg

SEQ ID NO: 21501 - DNA, 20 bp, Artificial Sequence
  sgRNA
ctgtgtagccctagctgtcc

SEQ ID NO: 21502 - DNA, 20 bp, Artificial Sequence
  sgRNA
ctcccaaatgctgggattaa

SEQ ID NO: 21503 - DNA, 20 bp, Artificial Sequence
  sgRNA
agcgtgaaggcggagcttag

SEQ ID NO: 21504 - DNA, 20 bp, Artificial Sequence
  sgRNA
ctcaggaagcggcctgcgtc

SEQ ID NO: 21505 - DNA, 20 bp, Artificial Sequence
  sgRNA
gcggattgtgacgaaagcaa

SEQ ID NO: 21506 - DNA, 20 bp, Artificial Sequence
  sgRNA
tgacttagtactagcacaaa

SEQ ID NO: 21507 - DNA, 20 bp, Artificial Sequence
  sgRNA
tgggatgctcttcagtgcaa

SEQ ID NO: 21508 - DNA, 20 bp, Artificial Sequence
  sgRNA
aacctctgtgagcggagccg

SEQ ID NO: 21509 - DNA, 20 bp, Artificial Sequence
  sgRNA
gcgggtggactgggctggtg

SEQ ID NO: 21510 - DNA, 20 bp, Artificial Sequence
  sgRNA
gagaggatgggactggctgg

SEQ ID NO: 21511 - DNA, 20 bp, Artificial Sequence
  sgRNA
cttatgattggcccgcagct

SEQ ID NO: 21512 - DNA, 20 bp, Artificial Sequence
  sgRNA
cagacgtacgtaagatgtgc

SEQ ID NO: 21513 - DNA, 20 bp, Artificial Sequence
  sgRNA
agaatgcatgagcgtgagag

SEQ ID NO: 21514 - DNA, 20 bp, Artificial Sequence
  sgRNA
aaagggcaggtaggcggagc

SEQ ID NO: 21515 - DNA, 20 bp, Artificial Sequence
  sgRNA
aaggccggaggattctgatc

SEQ ID NO: 21516 - DNA, 20 bp, Artificial Sequence
  sgRNA
atttctcgaagctgttcctt

SEQ ID NO: 21517 - DNA, 20 bp, Artificial Sequence
  sgRNA
cccggagacagaaatgggaa

SEQ ID NO: 21518 - DNA, 20 bp, Artificial Sequence
  sgRNA
ggagttagacaccgccttcc

SEQ ID NO: 21519 - DNA, 20 bp, Artificial Sequence
  sgRNA
gggtcgcgagcacgagggag

SEQ ID NO: 21520 - DNA, 20 bp, Artificial Sequence
  sgRNA
cgtgacaaacgctccaggcg

SEQ ID NO: 21521 - DNA, 20 bp, Artificial Sequence
  sgRNA
ttccctcacagcagcctacc

SEQ ID NO: 21522 - DNA, 20 bp, Artificial Sequence
  sgRNA
cccaaagcgtaattgctgcc

SEQ ID NO: 21523 - DNA, 20 bp, Artificial Sequence
  sgRNA
gccagacttgcaagcctcct

SEQ ID NO: 21524 - DNA, 20 bp, Artificial Sequence
  sgRNA
cggaccaggaatgtttccag

SEQ ID NO: 21525 - DNA, 20 bp, Artificial Sequence
  sgRNA
gcgttaatcattagccacgg

SEQ ID NO: 21526 - DNA, 20 bp, Artificial Sequence
  sgRNA
cgcggctgcgatccagcaat

SEQ ID NO: 21527 - DNA, 20 bp, Artificial Sequence
  sgRNA
gagggctaacatggacggtg

SEQ ID NO: 21528 - DNA, 20 bp, Artificial Sequence
  sgRNA
cttgaccaaggaaatcttca

SEQ ID NO: 21529 - DNA, 20 bp, Artificial Sequence
  sgRNA
cccttcctgtatcaccaggg

SEQ ID NO: 21530 - DNA, 20 bp, Artificial Sequence
  sgRNA
cacgcgtgcgcggcctcctg

SEQ ID NO: 21531 - DNA, 20 bp, Artificial Sequence
  sgRNA
gaggagcgaagactaggaac

SEQ ID NO: 21532 - DNA, 20 bp, Artificial Sequence
  sgRNA
ggatattagcatagggcacc

SEQ ID NO: 21533 - DNA, 20 bp, Artificial Sequence
  sgRNA
cctcccaagcctccaggaca

SEQ ID NO: 21534 - DNA, 20 bp, Artificial Sequence
  sgRNA
gcagtgtgagatgtgtcagg

SEQ ID NO: 21535 - DNA, 20 bp, Artificial Sequence
  sgRNA
ccaaatcctgctgctgagtc

SEQ ID NO: 21536 - DNA, 20 bp, Artificial Sequence
  sgRNA
ctggagacctgcatcctaat

SEQ ID NO: 21537 - DNA, 20 bp, Artificial Sequence
  sgRNA
gcgaaccaagtgttggatgt

SEQ ID NO: 21538 - DNA, 20 bp, Artificial Sequence
  sgRNA
ggatttaacacctgcctaag

SEQ ID NO: 21539 - DNA, 20 bp, Artificial Sequence
  sgRNA
gctgtcatctgtgggagctc

SEQ ID NO: 21540 - DNA, 20 bp, Artificial Sequence
  sgRNA
ttggcatgtaggacacatgt

SEQ ID NO: 21541 - DNA, 20 bp, Artificial Sequence
  sgRNA
gcggtctccaccgtggccag

SEQ ID NO: 21542 - DNA, 20 bp, Artificial Sequence
  sgRNA
tgttgtccaattctgtctaa

SEQ ID NO: 21543 - DNA, 20 bp, Artificial Sequence
  sgRNA
ttcggacactgtagaatgag

SEQ ID NO: 21544 - DNA, 20 bp, Artificial Sequence
  sgRNA
gagacagtcggcgctctgat

SEQ ID NO: 21545 - DNA, 20 bp, Artificial Sequence
  sgRNA
gttgacttcccggagagaga

SEQ ID NO: 21546 - DNA, 20 bp, Artificial Sequence
  sgRNA
ttctgctgggcttaagtcct

SEQ ID NO: 21547 - DNA, 20 bp, Artificial Sequence
  sgRNA
cgatagctgccgccaagccg

SEQ ID NO: 21548 - DNA, 20 bp, Artificial Sequence
  sgRNA
taagatctgcaaatgagaaa

SEQ ID NO: 21549 - DNA, 20 bp, Artificial Sequence
  sgRNA
ccaggaactcatatattacc

SEQ ID NO: 21550 - DNA, 20 bp, Artificial Sequence
  sgRNA
gccaggactccacatcacaa

SEQ ID NO: 21551 - DNA, 20 bp, Artificial Sequence
  sgRNA
tatgtacacattgcctcctc

SEQ ID NO: 21552 - DNA, 20 bp, Artificial Sequence
  sgRNA
aaccattctagaatgtctgg

SEQ ID NO: 21553 - DNA, 20 bp, Artificial Sequence
  sgRNA
ttcagccttatgactcagtg

SEQ ID NO: 21554 - DNA, 20 bp, Artificial Sequence
  sgRNA
ttgggctgtcagcagatctg

SEQ ID NO: 21555 - DNA, 20 bp, Artificial Sequence
  sgRNA
gctctgttaggaaggcatga

SEQ ID NO: 21556 - DNA, 20 bp, Artificial Sequence
  sgRNA
ttacagcccggctctgtgat

SEQ ID NO: 21557 - DNA, 20 bp, Artificial Sequence
  sgRNA
tgcctggcgcggcctctagg

SEQ ID NO: 21558 - DNA, 20 bp, Artificial Sequence
  sgRNA
cgagtttacaaacagtcgag

SEQ ID NO: 21559 - DNA, 20 bp, Artificial Sequence
  sgRNA
gctctgccgctgagtgcacc

SEQ ID NO: 21560 - DNA, 20 bp, Artificial Sequence
  sgRNA
tcagaacagtgagatggatt

SEQ ID NO: 21561 - DNA, 20 bp, Artificial Sequence
  sgRNA
ggaagtcacaacaacagctc

SEQ ID NO: 21562 - DNA, 20 bp, Artificial Sequence
  sgRNA
taaacagcgttcagttgtct

SEQ ID NO: 21563 - DNA, 20 bp, Artificial Sequence
  sgRNA
agtctctctggctactgtga

SEQ ID NO: 21564 - DNA, 20 bp, Artificial Sequence
  sgRNA
ggatgactagacttgagctc

SEQ ID NO: 21565 - DNA, 20 bp, Artificial Sequence
  sgRNA
tttatggcgctcacaacttc

SEQ ID NO: 21566 - DNA, 20 bp, Artificial Sequence
  sgRNA
gagcccagcctggccgtcgg

SEQ ID NO: 21567 - DNA, 20 bp, Artificial Sequence
  sgRNA
actcggtctgaagctttctc

SEQ ID NO: 21568 - DNA, 20 bp, Artificial Sequence
  sgRNA
cttgccctccagcctgtcgc

SEQ ID NO: 21569 - DNA, 20 bp, Artificial Sequence
  sgRNA
cgccgtgcggagtccttcct

SEQ ID NO: 21570 - DNA, 20 bp, Artificial Sequence
  sgRNA
ggaggtcctgggtaggacag

SEQ ID NO: 21571 - DNA, 20 bp, Artificial Sequence
  sgRNA
ggcctggtgcgcaggccctt

SEQ ID NO: 21572 - DNA, 20 bp, Artificial Sequence
  sgRNA
tggtgggagttgcaagccgc

SEQ ID NO: 21573 - DNA, 20 bp, Artificial Sequence
  sgRNA
ccgactaagtagcagctcaa

SEQ ID NO: 21574 - DNA, 20 bp, Artificial Sequence
  sgRNA
ctgagctagggcttccaccc

SEQ ID NO: 21575 - DNA, 20 bp, Artificial Sequence
  sgRNA
gggacacataggaaagatga

SEQ ID NO: 21576 - DNA, 20 bp, Artificial Sequence
  sgRNA
gatgagttgttattctctga

SEQ ID NO: 21577 - DNA, 20 bp, Artificial Sequence
  sgRNA
cttatcagccttgttactca

SEQ ID NO: 21578 - DNA, 20 bp, Artificial Sequence
  sgRNA
ggcagagacggagcctcgag

SEQ ID NO: 21579 - DNA, 20 bp, Artificial Sequence
  sgRNA
cctatctttctcggtcggcc

SEQ ID NO: 21580 - DNA, 20 bp, Artificial Sequence
  sgRNA
cacatgtattagggcgggcc

SEQ ID NO: 21581 - DNA, 20 bp, Artificial Sequence
  sgRNA
gcacttagatgcagttactt

SEQ ID NO: 21582 - DNA, 20 bp, Artificial Sequence
  sgRNA
gggtgcatctctctcccagt

SEQ ID NO: 21583 - DNA, 20 bp, Artificial Sequence
  sgRNA
gcggcgcttagagtcttaaa

SEQ ID NO: 21584 - DNA, 20 bp, Artificial Sequence
  sgRNA
tggccatcctggtggaggtg

SEQ ID NO: 21585 - DNA, 20 bp, Artificial Sequence
  sgRNA
tccgcccgcccagctcccag

SEQ ID NO: 21586 - DNA, 20 bp, Artificial Sequence
  sgRNA
taattacggcgtgatccgag

SEQ ID NO: 21587 - DNA, 20 bp, Artificial Sequence
  sgRNA
agagccaaagggttaggaac

SEQ ID NO: 21588 - DNA, 20 bp, Artificial Sequence
  sgRNA
gaagagtcacgtttcggaga

SEQ ID NO: 21589 - DNA, 20 bp, Artificial Sequence
  sgRNA
gcggtccctcaatgacgcac

SEQ ID NO: 21590 - DNA, 20 bp, Artificial Sequence
  sgRNA
gcagagaggcgaccaggagg

SEQ ID NO: 21591 - DNA, 20 bp, Artificial Sequence
  sgRNA
gagccggagggccaaggcgc

SEQ ID NO: 21592 - DNA, 20 bp, Artificial Sequence
  sgRNA
gctgccgccgcctactgcgc

SEQ ID NO: 21593 - DNA, 20 bp, Artificial Sequence
  sgRNA
ggcccgggcggccgtcttcc

SEQ ID NO: 21594 - DNA, 20 bp, Artificial Sequence
  sgRNA
gaggctttcgacgcccttgg

SEQ ID NO: 21595 - DNA, 20 bp, Artificial Sequence
  sgRNA
cgggcgcggccctcgaacgg

SEQ ID NO: 21596 - DNA, 20 bp, Artificial Sequence
  sgRNA
gctctgtgtcaacttgacac

SEQ ID NO: 21597 - DNA, 20 bp, Artificial Sequence
  sgRNA
tgctgcagccttgcccaatc

SEQ ID NO: 21598 - DNA, 20 bp, Artificial Sequence
  sgRNA
ccatccaggaccacctgccc

SEQ ID NO: 21599 - DNA, 20 bp, Artificial Sequence
  sgRNA
ttataaagagttgttggccc

SEQ ID NO: 21600 - DNA, 20 bp, Artificial Sequence
  sgRNA
tcatatggtacttgtcccaa

SEQ ID NO: 21601 - DNA, 20 bp, Artificial Sequence
  sgRNA
agatgacatcagcggcaggt

SEQ ID NO: 21602 - DNA, 20 bp, Artificial Sequence
  sgRNA
atgtgggttggagcagaaga

SEQ ID NO: 21603 - DNA, 20 bp, Artificial Sequence
  sgRNA
taaaggctccagcggagcca

SEQ ID NO: 21604 - DNA, 20 bp, Artificial Sequence
  sgRNA
gaaggcgggcgcgcgcccat

SEQ ID NO: 21605 - DNA, 20 bp, Artificial Sequence
  sgRNA
agactgctggctgcagacgc

SEQ ID NO: 21606 - DNA, 20 bp, Artificial Sequence
  sgRNA
ggcgcgatgtcccggcgcgg

SEQ ID NO: 21607 - DNA, 20 bp, Artificial Sequence
  sgRNA
cacggtgaacaacacatggt

SEQ ID NO: 21608 - DNA, 20 bp, Artificial Sequence
  sgRNA
gggtggctcaggaacttctt

SEQ ID NO: 21609 - DNA, 20 bp, Artificial Sequence
  sgRNA
atcttgctcacctcaatagc

SEQ ID NO: 21610 - DNA, 20 bp, Artificial Sequence
  sgRNA
ccggagacgcaggacgggcg

SEQ ID NO: 21611 - DNA, 20 bp, Artificial Sequence
  sgRNA
aatgtttgcagggcgaagtg

SEQ ID NO: 21612 - DNA, 20 bp, Artificial Sequence
  sgRNA
gaacggctacagttagaatt

SEQ ID NO: 21613 - DNA, 20 bp, Artificial Sequence
  sgRNA
tttaaagggctgggtgagct

SEQ ID NO: 21614 - DNA, 20 bp, Artificial Sequence
  sgRNA
ctgaagcctgcagtttatcc

SEQ ID NO: 21615 - DNA, 20 bp, Artificial Sequence
  sgRNA
tttcagtggagaatgcagta

SEQ ID NO: 21616 - DNA, 20 bp, Artificial Sequence
  sgRNA
cccacgtggctgcgtagacc

SEQ ID NO: 21617 - DNA, 20 bp, Artificial Sequence
  sgRNA
gtgcttgtggctggcgcagt

SEQ ID NO: 21618 - DNA, 20 bp, Artificial Sequence
  sgRNA
cctctgcgcttgcgcttata

SEQ ID NO: 21619 - DNA, 20 bp, Artificial Sequence
  sgRNA
ggctcgcgaccatagagaag

SEQ ID NO: 21620 - DNA, 20 bp, Artificial Sequence
  sgRNA
taattcacactccggtgaag

SEQ ID NO: 21621 - DNA, 20 bp, Artificial Sequence
  sgRNA
cgagtctagttctattaagt

SEQ ID NO: 21622 - DNA, 20 bp, Artificial Sequence
  sgRNA
gttactgtatccctttccct

SEQ ID NO: 21623 - DNA, 20 bp, Artificial Sequence
  sgRNA
atgccggagtcttatatttg

SEQ ID NO: 21624 - DNA, 20 bp, Artificial Sequence
  sgRNA
tggcgcatgcaatcacactc

SEQ ID NO: 21625 - DNA, 20 bp, Artificial Sequence
  sgRNA
gcttggtgacaagtggaacc

SEQ ID NO: 21626 - DNA, 20 bp, Artificial Sequence
  sgRNA
cagggacacaaaggatggaa

SEQ ID NO: 21627 - DNA, 20 bp, Artificial Sequence
  sgRNA
agtctggagcaatgcattgt

SEQ ID NO: 21628 - DNA, 20 bp, Artificial Sequence
  sgRNA
tgagcaggaacgttcgttcc

SEQ ID NO: 21629 - DNA, 20 bp, Artificial Sequence
  sgRNA
atctgctcgcaagtcttgag

SEQ ID NO: 21630 - DNA, 20 bp, Artificial Sequence
  sgRNA
tccgtcgatctaatacgtcc

SEQ ID NO: 21631 - DNA, 20 bp, Artificial Sequence
  sgRNA
tacagtcaaacaaagatgag

SEQ ID NO: 21632 - DNA, 20 bp, Artificial Sequence
  sgRNA
ggagctgactctgatgttct

SEQ ID NO: 21633 - DNA, 20 bp, Artificial Sequence
  sgRNA
gacagagaccaaccgcgcgc

SEQ ID NO: 21634 - DNA, 20 bp, Artificial Sequence
  sgRNA
ggagtatgggttaactaatg

SEQ ID NO: 21635 - DNA, 20 bp, Artificial Sequence
  sgRNA
agatggacccggtggagcgc

SEQ ID NO: 21636 - DNA, 20 bp, Artificial Sequence
  sgRNA
ggagcatgcgtattagccga

SEQ ID NO: 21637 - DNA, 20 bp, Artificial Sequence
  sgRNA
aaagggactgggtgctggcg

SEQ ID NO: 21638 - DNA, 20 bp, Artificial Sequence
  sgRNA
ctggcgcggaccagcgctag

SEQ ID NO: 21639 - DNA, 20 bp, Artificial Sequence
  sgRNA
accagggacaacgctcctcg

SEQ ID NO: 21640 - DNA, 20 bp, Artificial Sequence
  sgRNA
cccatctgagtctactcatc

SEQ ID NO: 21641 - DNA, 20 bp, Artificial Sequence
  sgRNA
cctgttcaaggacacttgac

SEQ ID NO: 21642 - DNA, 20 bp, Artificial Sequence
  sgRNA
tcccactaagaatactcaag

SEQ ID NO: 21643 - DNA, 20 bp, Artificial Sequence
  sgRNA
atggctgattcctccaccta

SEQ ID NO: 21644 - DNA, 20 bp, Artificial Sequence
  sgRNA
agagaatctgggaaggcaag

SEQ ID NO: 21645 - DNA, 20 bp, Artificial Sequence
  sgRNA
atctactaatttactggctc

SEQ ID NO: 21646 - DNA, 20 bp, Artificial Sequence
  sgRNA
aacaccctgagcctgagtca

SEQ ID NO: 21647 - DNA, 20 bp, Artificial Sequence
  sgRNA
agagggtcagaagtcacacc

SEQ ID NO: 21648 - DNA, 20 bp, Artificial Sequence
  sgRNA
tttatggttctgctgtctcc

SEQ ID NO: 21649 - DNA, 20 bp, Artificial Sequence
  sgRNA
taaacaaggaaggacagctc

SEQ ID NO: 21650 - DNA, 20 bp, Artificial Sequence
  sgRNA
gtcagcagaggaagtggtaa

SEQ ID NO: 21651 - DNA, 20 bp, Artificial Sequence
  sgRNA
gagaccatatttgttcacag

SEQ ID NO: 21652 - DNA, 20 bp, Artificial Sequence
  sgRNA
ggagccaggagtgcgagagt

SEQ ID NO: 21653 - DNA, 20 bp, Artificial Sequence
  sgRNA
ggccaccagcggtcaaattc

SEQ ID NO: 21654 - DNA, 20 bp, Artificial Sequence
  sgRNA
ctttggacccgacaggctgc

SEQ ID NO: 21655 - DNA, 20 bp, Artificial Sequence
  sgRNA
cacgtggtgcaaccctgggc

SEQ ID NO: 21656 - DNA, 20 bp, Artificial Sequence
  sgRNA
acaggcagggtgtctcacgt

SEQ ID NO: 21657 - DNA, 20 bp, Artificial Sequence
  sgRNA
gggcatgaagacattggtgc

SEQ ID NO: 21658 - DNA, 20 bp, Artificial Sequence
  sgRNA
tcacggacagcgctgagagg

SEQ ID NO: 21659 - DNA, 20 bp, Artificial Sequence
  sgRNA
gagcccaccctatcagattc

SEQ ID NO: 21660 - DNA, 20 bp, Artificial Sequence
  sgRNA
gggacgtctgcagtggagga

SEQ ID NO: 21661 - DNA, 20 bp, Artificial Sequence
  sgRNA
gctctggtcgcgccgccgaa

SEQ ID NO: 21662 - DNA, 20 bp, Artificial Sequence
  sgRNA
aagtttcctgctgtcaactc

SEQ ID NO: 21663 - DNA, 20 bp, Artificial Sequence
  sgRNA
tgagcccaccgcggcccggg

SEQ ID NO: 21664 - DNA, 20 bp, Artificial Sequence
  sgRNA
agtgaggttcccgaaggctt

SEQ ID NO: 21665 - DNA, 20 bp, Artificial Sequence
  sgRNA
ttcgcgttgctatggtgtcc

SEQ ID NO: 21666 - DNA, 20 bp, Artificial Sequence
  sgRNA
actaggagtgacacattcat

SEQ ID NO: 21667 - DNA, 20 bp, Artificial Sequence
  sgRNA
ggaagagggtgtggctagcg

SEQ ID NO: 21668 - DNA, 20 bp, Artificial Sequence
  sgRNA
aggcagcgccagtttgctat

SEQ ID NO: 21669 - DNA, 20 bp, Artificial Sequence
  sgRNA
gctgccaatgctaggagctc

SEQ ID NO: 21670 - DNA, 20 bp, Artificial Sequence
  sgRNA
gactgggatcagacttagaa

SEQ ID NO: 21671 - DNA, 20 bp, Artificial Sequence
  sgRNA
gttccctttaagggcggtgg

SEQ ID NO: 21672 - DNA, 20 bp, Artificial Sequence
  sgRNA
ccgggcggctggatccaggg

SEQ ID NO: 21673 - DNA, 20 bp, Artificial Sequence
  sgRNA
tggcagcaacaacacggccc

SEQ ID NO: 21674 - DNA, 20 bp, Artificial Sequence
  sgRNA
ggacactgagcatgcgcgcg

SEQ ID NO: 21675 - DNA, 20 bp, Artificial Sequence
  sgRNA
gaccacatccgggtaatttc

SEQ ID NO: 21676 - DNA, 20 bp, Artificial Sequence
  sgRNA
ggctgagaagccggaagcgg

SEQ ID NO: 21677 - DNA, 20 bp, Artificial Sequence
  sgRNA
gaggccagaagaggaaagac

SEQ ID NO: 21678 - DNA, 20 bp, Artificial Sequence
  sgRNA
ccaagcaccgggtttccggg

SEQ ID NO: 21679 - DNA, 20 bp, Artificial Sequence
  sgRNA
ctaacgttcgtactttagct

SEQ ID NO: 21680 - DNA, 20 bp, Artificial Sequence
  sgRNA
gggaggtgcaggtcttcggg

SEQ ID NO: 21681 - DNA, 20 bp, Artificial Sequence
  sgRNA
cggagccggcgcgagaatcc

SEQ ID NO: 21682 - DNA, 20 bp, Artificial Sequence
  sgRNA
ggtgcccacgtgactgacga

SEQ ID NO: 21683 - DNA, 20 bp, Artificial Sequence
  sgRNA
agtgaagacactaattgcta

SEQ ID NO: 21684 - DNA, 20 bp, Artificial Sequence
  sgRNA
gaggactaggcgtgcatctc

SEQ ID NO: 21685 - DNA, 20 bp, Artificial Sequence
  sgRNA
tgggagtatttaagagatgg

SEQ ID NO: 21686 - DNA, 20 bp, Artificial Sequence
  sgRNA
ctcagccagctaaacctcta

SEQ ID NO: 21687 - DNA, 20 bp, Artificial Sequence
  sgRNA
aacactgaacacatagcatt

SEQ ID NO: 21688 - DNA, 20 bp, Artificial Sequence
  sgRNA
aaagtcttggtgttgaaact

SEQ ID NO: 21689 - DNA, 20 bp, Artificial Sequence
  sgRNA
ctagacagctcagaggcatt

SEQ ID NO: 21690 - DNA, 20 bp, Artificial Sequence
  sgRNA
gcaatgttgcgggcagccaa

SEQ ID NO: 21691 - DNA, 20 bp, Artificial Sequence
  sgRNA
gctagacagttgccttcttt

SEQ ID NO: 21692 - DNA, 20 bp, Artificial Sequence
  sgRNA
tggattcagatggaaatgtc

SEQ ID NO: 21693 - DNA, 20 bp, Artificial Sequence
  sgRNA
ggtacttggagctgaaacct

SEQ ID NO: 21694 - DNA, 20 bp, Artificial Sequence
  sgRNA
ggcgctgcattaaggcgagg

SEQ ID NO: 21695 - DNA, 20 bp, Artificial Sequence
  sgRNA
cagactgccgtgacgtcggc

SEQ ID NO: 21696 - DNA, 20 bp, Artificial Sequence
  sgRNA
gaccgcgtttagaggatcag

SEQ ID NO: 21697 - DNA, 20 bp, Artificial Sequence
  sgRNA
tttaatcaagcagaacaggg

SEQ ID NO: 21698 - DNA, 20 bp, Artificial Sequence
  sgRNA
acagggagagaaagcgaatc

SEQ ID NO: 21699 - DNA, 20 bp, Artificial Sequence
  sgRNA
gagggattaagggctgcagc

SEQ ID NO: 21700 - DNA, 20 bp, Artificial Sequence
  sgRNA
atagggcttgattctcatcc

SEQ ID NO: 21701 - DNA, 20 bp, Artificial Sequence
  sgRNA
ggagtatctttagaacatcc

SEQ ID NO: 21702 - DNA, 20 bp, Artificial Sequence
  sgRNA
gcacgatctcctgggattct

SEQ ID NO: 21703 - DNA, 20 bp, Artificial Sequence
  sgRNA
gggtgtgcgctcccgagtgt

SEQ ID NO: 21704 - DNA, 20 bp, Artificial Sequence
  sgRNA
gacgcacgcacagcacaccg

SEQ ID NO: 21705 - DNA, 20 bp, Artificial Sequence
  sgRNA
gaggtggccgatagcgccct

SEQ ID NO: 21706 - DNA, 20 bp, Artificial Sequence
  sgRNA
acctgcccatagtgtgaccc

SEQ ID NO: 21707 - DNA, 20 bp, Artificial Sequence
  sgRNA
aggagctcagtcggcgggaa

SEQ ID NO: 21708 - DNA, 20 bp, Artificial Sequence
  sgRNA
tgcgggtgacgcaagcgcgg

SEQ ID NO: 21709 - DNA, 20 bp, Artificial Sequence
  sgRNA
aggcatgtctccaccaaata

SEQ ID NO: 21710 - DNA, 20 bp, Artificial Sequence
  sgRNA
cgcagctctcatgatggtcg

SEQ ID NO: 21711 - DNA, 20 bp, Artificial Sequence
  sgRNA
gcaggccatgtcaactcacc

SEQ ID NO: 21712 - DNA, 20 bp, Artificial Sequence
  sgRNA
tctatgacaactgaattgtg

SEQ ID NO: 21713 - DNA, 20 bp, Artificial Sequence
  sgRNA
tactatcctcattctgacac

SEQ ID NO: 21714 - DNA, 20 bp, Artificial Sequence
  sgRNA
cagttgggtgtaaaggaaga

SEQ ID NO: 21715 - DNA, 20 bp, Artificial Sequence
  sgRNA
tgagaagtgctgaatcagcc

SEQ ID NO: 21716 - DNA, 20 bp, Artificial Sequence
  sgRNA
tttcatttcttgaacagcac

SEQ ID NO: 21717 - DNA, 20 bp, Artificial Sequence
  sgRNA
gacaagcgtgagcccggtcg

SEQ ID NO: 21718 - DNA, 20 bp, Artificial Sequence
  sgRNA
cggtcccgtcaggccgctgg

SEQ ID NO: 21719 - DNA, 20 bp, Artificial Sequence
  sgRNA
acgcgccatgcgctgcattc

SEQ ID NO: 21720 - DNA, 20 bp, Artificial Sequence
  sgRNA
aactttcacccgtcacacaa

SEQ ID NO: 21721 - DNA, 20 bp, Artificial Sequence
  sgRNA
tttaaatagctgcctgtgca

SEQ ID NO: 21722 - DNA, 20 bp, Artificial Sequence
  sgRNA
agtaattagtcacaagtgat

SEQ ID NO: 21723 - DNA, 20 bp, Artificial Sequence
  sgRNA
acggtggcgtggaggattct

SEQ ID NO: 21724 - DNA, 20 bp, Artificial Sequence
  sgRNA
gccgaaccacaggacttgac

SEQ ID NO: 21725 - DNA, 20 bp, Artificial Sequence
  sgRNA
gtccgtcgcccgttcactag

SEQ ID NO: 21726 - DNA, 20 bp, Artificial Sequence
  sgRNA
atttataactcgctctgagg

SEQ ID NO: 21727 - DNA, 20 bp, Artificial Sequence
  sgRNA
ctccggtaggcagcctgaaa

SEQ ID NO: 21728 - DNA, 20 bp, Artificial Sequence
  sgRNA
tgcaagcagacctccctcaa

SEQ ID NO: 21729 - DNA, 20 bp, Artificial Sequence
  sgRNA
cggaaacggaaattcctacc

SEQ ID NO: 21730 - DNA, 20 bp, Artificial Sequence
  sgRNA
gtctcctggatcccgttagg

SEQ ID NO: 21731 - DNA, 20 bp, Artificial Sequence
  sgRNA
aaagcaacctaccctctgct

SEQ ID NO: 21732 - DNA, 20 bp, Artificial Sequence
  sgRNA
cttcccggcccgccctctat

SEQ ID NO: 21733 - DNA, 20 bp, Artificial Sequence
  sgRNA
gctcgcagaggactctcagc

SEQ ID NO: 21734 - DNA, 20 bp, Artificial Sequence
  sgRNA
gcagagagcagctaggcagg

SEQ ID NO: 21735 - DNA, 20 bp, Artificial Sequence
  sgRNA
cacttgttatcctgtgacca

SEQ ID NO: 21736 - DNA, 20 bp, Artificial Sequence
  sgRNA
gttaactcaagagtccggtg

SEQ ID NO: 21737 - DNA, 20 bp, Artificial Sequence
  sgRNA
acagagtgccgctcaaacta

SEQ ID NO: 21738 - DNA, 20 bp, Artificial Sequence
  sgRNA
ggccaggttcagatgaaaca

SEQ ID NO: 21739 - DNA, 20 bp, Artificial Sequence
  sgRNA
cgaggtccctatcacgcgcg

SEQ ID NO: 21740 - DNA, 20 bp, Artificial Sequence
  sgRNA
aacgagggtgtggcgaggcg

SEQ ID NO: 21741 - DNA, 20 bp, Artificial Sequence
  sgRNA
ttcaaagctttgggaggagc

SEQ ID NO: 21742 - DNA, 20 bp, Artificial Sequence
  sgRNA
agtgtttgtgtgtcggaagc

SEQ ID NO: 21743 - DNA, 20 bp, Artificial Sequence
  sgRNA
ggaagacaacaaagccggga

SEQ ID NO: 21744 - DNA, 20 bp, Artificial Sequence
  sgRNA
cagactggaaggaatagttc

SEQ ID NO: 21745 - DNA, 20 bp, Artificial Sequence
  sgRNA
gggcggagcttcttgaacga

SEQ ID NO: 21746 - DNA, 20 bp, Artificial Sequence
  sgRNA
gtccgggaggaaacgcagac

SEQ ID NO: 21747 - DNA, 20 bp, Artificial Sequence
  sgRNA
aaacaaagctttatcacgtg

SEQ ID NO: 21748 - DNA, 20 bp, Artificial Sequence
  sgRNA
gggtgaggaaacagaagcca

SEQ ID NO: 21749 - DNA, 20 bp, Artificial Sequence
  sgRNA
actaacttccttccctgccc

SEQ ID NO: 21750 - DNA, 20 bp, Artificial Sequence
  sgRNA
gctgttgagagtcacatgaa

SEQ ID NO: 21751 - DNA, 20 bp, Artificial Sequence
  sgRNA
gtagcaaccataggttctaa

SEQ ID NO: 21752 - DNA, 20 bp, Artificial Sequence
  sgRNA
cattctacaactgaagacag

SEQ ID NO: 21753 - DNA, 20 bp, Artificial Sequence
  sgRNA
cgagcgggcacgcgctgtcc

SEQ ID NO: 21754 - DNA, 20 bp, Artificial Sequence
  sgRNA
gggctcgccgggcagagaca

SEQ ID NO: 21755 - DNA, 20 bp, Artificial Sequence
  sgRNA
gggcagtgcactctgacagt

SEQ ID NO: 21756 - DNA, 20 bp, Artificial Sequence
  sgRNA
tctgctcctgatcacgtgac

SEQ ID NO: 21757 - DNA, 20 bp, Artificial Sequence
  sgRNA
ggaacgtcaccagtgggctc

SEQ ID NO: 21758 - DNA, 20 bp, Artificial Sequence
  sgRNA
cactttcttgtgcttgggag

SEQ ID NO: 21759 - DNA, 20 bp, Artificial Sequence
  sgRNA
aatctgccgctgtactctgt

SEQ ID NO: 21760 - DNA, 20 bp, Artificial Sequence
  sgRNA
ccaaggctctgcgactagga

SEQ ID NO: 21761 - DNA, 20 bp, Artificial Sequence
  sgRNA
tggctcttagttatgctaat

SEQ ID NO: 21762 - DNA, 20 bp, Artificial Sequence
  sgRNA
tacggtcttctgtgtgacct

SEQ ID NO: 21763 - DNA, 20 bp, Artificial Sequence
  sgRNA
gggcaagtgactgctatctc

SEQ ID NO: 21764 - DNA, 20 bp, Artificial Sequence
  sgRNA
gggtgcgtgacagaaaccat

SEQ ID NO: 21765 - DNA, 20 bp, Artificial Sequence
  sgRNA
ctaagagagcctgccctttc

SEQ ID NO: 21766 - DNA, 20 bp, Artificial Sequence
  sgRNA
tcagtttgcaaagtccagaa

SEQ ID NO: 21767 - DNA, 20 bp, Artificial Sequence
  sgRNA
aaacaaccaacaacagagat

SEQ ID NO: 21768 - DNA, 20 bp, Artificial Sequence
  sgRNA
gagcagctgcagtgcagtgt

SEQ ID NO: 21769 - DNA, 20 bp, Artificial Sequence
  sgRNA
agtgtggctgatgtgctcac

SEQ ID NO: 21770 - DNA, 20 bp, Artificial Sequence
  sgRNA
atcggatcaatagcagtctg

SEQ ID NO: 21771 - DNA, 20 bp, Artificial Sequence
  sgRNA
ggaggaagtgctggtgcccg

SEQ ID NO: 21772 - DNA, 20 bp, Artificial Sequence
  sgRNA
tggaagttcatttagactgc

SEQ ID NO: 21773 - DNA, 20 bp, Artificial Sequence
  sgRNA
gttacgtcataccaccaccg

SEQ ID NO: 21774 - DNA, 20 bp, Artificial Sequence
  sgRNA
gaaagcgcgtgcgagtgttt

SEQ ID NO: 21775 - DNA, 20 bp, Artificial Sequence
  sgRNA
ggcgtacttaaggcgggcgc

SEQ ID NO: 21776 - DNA, 20 bp, Artificial Sequence
  sgRNA
gtaccaagtggagaagcgcg

SEQ ID NO: 21777 - DNA, 20 bp, Artificial Sequence
  sgRNA
aggctggtgtctgggtgtcc

SEQ ID NO: 21778 - DNA, 20 bp, Artificial Sequence
  sgRNA
tctccggagcctgggcggtg

SEQ ID NO: 21779 - DNA, 20 bp, Artificial Sequence
  sgRNA
ctcccacggctcggccggag

SEQ ID NO: 21780 - DNA, 20 bp, Artificial Sequence
  sgRNA
ccgggtcgtcgagcgtgcag

SEQ ID NO: 21781 - DNA, 20 bp, Artificial Sequence
  sgRNA
cctcggcatgggcggccggt

SEQ ID NO: 21782 - DNA, 20 bp, Artificial Sequence
  sgRNA
gagaacgagtacttggctta

SEQ ID NO: 21783 - DNA, 20 bp, Artificial Sequence
  sgRNA
cccgccactcagtgtgtggc

SEQ ID NO: 21784 - DNA, 20 bp, Artificial Sequence
  sgRNA
cggaatcacggtcgtgggcg

SEQ ID NO: 21785 - DNA, 20 bp, Artificial Sequence
  sgRNA
gctgcagtaatagcaaactg

SEQ ID NO: 21786 - DNA, 20 bp, Artificial Sequence
  sgRNA
cagcgcttgtacgcatattc

SEQ ID NO: 21787 - DNA, 20 bp, Artificial Sequence
  sgRNA
gaagtcgcccggtaaatagc

SEQ ID NO: 21788 - DNA, 20 bp, Artificial Sequence
  sgRNA
tcagctacgggaagtcgcgg

SEQ ID NO: 21789 - DNA, 20 bp, Artificial Sequence
  sgRNA
ctatctgttcaggtctttaa

SEQ ID NO: 21790 - DNA, 20 bp, Artificial Sequence
  sgRNA
gaaccgcactcacattatga

SEQ ID NO: 21791 - DNA, 20 bp, Artificial Sequence
  sgRNA
ttccgttagaattctgttac

SEQ ID NO: 21792 - DNA, 20 bp, Artificial Sequence
  sgRNA
ggaagctctcacatccaagc

SEQ ID NO: 21793 - DNA, 20 bp, Artificial Sequence
  sgRNA
agacgtgctctgaagactac

SEQ ID NO: 21794 - DNA, 20 bp, Artificial Sequence
  sgRNA
cctaccttattaacttagtg

SEQ ID NO: 21795 - DNA, 20 bp, Artificial Sequence
  sgRNA
tttaagcggcaccagaaagc

SEQ ID NO: 21796 - DNA, 20 bp, Artificial Sequence
  sgRNA
tgaggcctatcaatcttacg

SEQ ID NO: 21797 - DNA, 20 bp, Artificial Sequence
  sgRNA
tttaccacatgagcctctat

SEQ ID NO: 21798 - DNA, 20 bp, Artificial Sequence
  sgRNA
tgaatgtgaaatacccacac

SEQ ID NO: 21799 - DNA, 20 bp, Artificial Sequence
  sgRNA
ctgtgtctgggcctacactg

SEQ ID NO: 21800 - DNA, 20 bp, Artificial Sequence
  sgRNA
cagctcatggtttgagaatt

SEQ ID NO: 21801 - DNA, 20 bp, Artificial Sequence
  sgRNA
ctcaaggaagctgcttctcc

SEQ ID NO: 21802 - DNA, 20 bp, Artificial Sequence
  sgRNA
gaaactgaagccgagagcgc

SEQ ID NO: 21803 - DNA, 20 bp, Artificial Sequence
  sgRNA
tttgttgtgcgcccagtccg

SEQ ID NO: 21804 - DNA, 20 bp, Artificial Sequence
  sgRNA
tgtagatgaaatgtgcagtc

SEQ ID NO: 21805 - DNA, 20 bp, Artificial Sequence
  sgRNA
tgctggagaaattgcgaaac

SEQ ID NO: 21806 - DNA, 20 bp, Artificial Sequence
  sgRNA
tacttgagtcaagctgggcc

SEQ ID NO: 21807 - DNA, 20 bp, Artificial Sequence
  sgRNA
cgctctgagaggtcccaact

SEQ ID NO: 21808 - DNA, 20 bp, Artificial Sequence
  sgRNA
ctattgcgcacgcgtagctg

SEQ ID NO: 21809 - DNA, 20 bp, Artificial Sequence
  sgRNA
cctccggttgctaatatgta

SEQ ID NO: 21810 - DNA, 20 bp, Artificial Sequence
  sgRNA
gtagtacaggccagtggcaa

SEQ ID NO: 21811 - DNA, 20 bp, Artificial Sequence
  sgRNA
agttcagagcatctgcccaa

SEQ ID NO: 21812 - DNA, 20 bp, Artificial Sequence
  sgRNA
gggccagaccacatagcttt

SEQ ID NO: 21813 - DNA, 20 bp, Artificial Sequence
  sgRNA
gggcgggaacctagtccgcc

SEQ ID NO: 21814 - DNA, 20 bp, Artificial Sequence
  sgRNA
cctagggcctttcgcttagc

SEQ ID NO: 21815 - DNA, 20 bp, Artificial Sequence
  sgRNA
cagctatctgcatattcatg

SEQ ID NO: 21816 - DNA, 20 bp, Artificial Sequence
  sgRNA
tgccaaactccagaaatacc

SEQ ID NO: 21817 - DNA, 20 bp, Artificial Sequence
  sgRNA
gggtccggaaccggtttggg

SEQ ID NO: 21818 - DNA, 20 bp, Artificial Sequence
  sgRNA
agtaagccagctcgacccgc

SEQ ID NO: 21819 - DNA, 20 bp, Artificial Sequence
  sgRNA
gcctcctgattggctaccta

SEQ ID NO: 21820 - DNA, 20 bp, Artificial Sequence
  sgRNA
ttcttgacgcgagggctgct

SEQ ID NO: 21821 - DNA, 20 bp, Artificial Sequence
  sgRNA
ggtcgccggagtcctgtgat

SEQ ID NO: 21822 - DNA, 20 bp, Artificial Sequence
  sgRNA
agcggcggcgtggtcccgtc

SEQ ID NO: 21823 - DNA, 20 bp, Artificial Sequence
  sgRNA
ccgcgcgactcggctcaggc

SEQ ID NO: 21824 - DNA, 20 bp, Artificial Sequence
  sgRNA
cctccgggagccgcgcttcg

SEQ ID NO: 21825 - DNA, 20 bp, Artificial Sequence
  sgRNA
ttccgagaagccactttatg

SEQ ID NO: 21826 - DNA, 20 bp, Artificial Sequence
  sgRNA
ttagcactgaactggaggga

SEQ ID NO: 21827 - DNA, 20 bp, Artificial Sequence
  sgRNA
aaggcagagaagaatgacaa

SEQ ID NO: 21828 - DNA, 20 bp, Artificial Sequence
  sgRNA
ggaaggaacgggagaactag

SEQ ID NO: 21829 - DNA, 20 bp, Artificial Sequence
  sgRNA
aaagggaggagacaaacgtt

SEQ ID NO: 21830 - DNA, 20 bp, Artificial Sequence
  sgRNA
ggccaattccttcttagctg

SEQ ID NO: 21831 - DNA, 20 bp, Artificial Sequence
  sgRNA
gccggtgatggcgtgaagtc

SEQ ID NO: 21832 - DNA, 20 bp, Artificial Sequence
  sgRNA
gtcggaggtggaagtcgtct

SEQ ID NO: 21833 - DNA, 20 bp, Artificial Sequence
  sgRNA
ccctcagcggtccaggactg

SEQ ID NO: 21834 - DNA, 20 bp, Artificial Sequence
  sgRNA
gaattatggagctgggtcct

SEQ ID NO: 21835 - DNA, 20 bp, Artificial Sequence
  sgRNA
ttatacacaccatgtatcac

SEQ ID NO: 21836 - DNA, 20 bp, Artificial Sequence
  sgRNA
tatatgtccaagacctagag

SEQ ID NO: 21837 - DNA, 20 bp, Artificial Sequence
  sgRNA
gatgtgttcccagcattctc

SEQ ID NO: 21838 - DNA, 20 bp, Artificial Sequence
  sgRNA
cagtgcttgagtcccttcag

SEQ ID NO: 21839 - DNA, 20 bp, Artificial Sequence
  sgRNA
gggaaggagctctgctacgt

SEQ ID NO: 21840 - DNA, 20 bp, Artificial Sequence
  sgRNA
agtccctaatgggagaaccg

SEQ ID NO: 21841 - DNA, 20 bp, Artificial Sequence
  sgRNA
acttccagttctagagacaa

SEQ ID NO: 21842 - DNA, 20 bp, Artificial Sequence
  sgRNA
gttcgcggacgccgggcact

SEQ ID NO: 21843 - DNA, 20 bp, Artificial Sequence
  sgRNA
taagcgcccggcctcggtgg

SEQ ID NO: 21844 - DNA, 20 bp, Artificial Sequence
  sgRNA
tcgtcgagccctttcgggtg

SEQ ID NO: 21845 - DNA, 20 bp, Artificial Sequence
  sgRNA
ccggaagaaggaagctgtac

SEQ ID NO: 21846 - DNA, 20 bp, Artificial Sequence
  sgRNA
acaaagctgtaagttagctg

SEQ ID NO: 21847 - DNA, 20 bp, Artificial Sequence
  sgRNA
tcttaccttatctgagaccc

SEQ ID NO: 21848 - DNA, 20 bp, Artificial Sequence
  sgRNA
ttgtaggcgggaccaggtgt

SEQ ID NO: 21849 - DNA, 20 bp, Artificial Sequence
  sgRNA
cggtgctttccgatggtggg

SEQ ID NO: 21850 - DNA, 20 bp, Artificial Sequence
  sgRNA
ggcctgacgcgcccacaact

SEQ ID NO: 21851 - DNA, 20 bp, Artificial Sequence
  sgRNA
ctggcaaggtgaggactagc

SEQ ID NO: 21852 - DNA, 20 bp, Artificial Sequence
  sgRNA
taagagtcgcatggactcct

SEQ ID NO: 21853 - DNA, 20 bp, Artificial Sequence
  sgRNA
acgcggtagccaacctagac

SEQ ID NO: 21854 - DNA, 20 bp, Artificial Sequence
  sgRNA
ccgagtcagatcttaaccaa

SEQ ID NO: 21855 - DNA, 20 bp, Artificial Sequence
  sgRNA
aggctcagttcttcgatccc

SEQ ID NO: 21856 - DNA, 20 bp, Artificial Sequence
  sgRNA
ggacggtcatgagcaccaat

SEQ ID NO: 21857 - DNA, 20 bp, Artificial Sequence
  sgRNA
taaggtgggcggagtctcaa

SEQ ID NO: 21858 - DNA, 20 bp, Artificial Sequence
  sgRNA
aaagggtgtggactcagtaa

SEQ ID NO: 21859 - DNA, 20 bp, Artificial Sequence
  sgRNA
tgtctccagctgatccagcc

SEQ ID NO: 21860 - DNA, 20 bp, Artificial Sequence
  sgRNA
gccacggaacagcatcaaca

SEQ ID NO: 21861 - DNA, 20 bp, Artificial Sequence
  sgRNA
ggccgctgctgatcccgggc

SEQ ID NO: 21862 - DNA, 20 bp, Artificial Sequence
  sgRNA
tccgggagcccggaagagcc

SEQ ID NO: 21863 - DNA, 20 bp, Artificial Sequence
  sgRNA
acagggacatgtaggaaaga

SEQ ID NO: 21864 - DNA, 20 bp, Artificial Sequence
  sgRNA
taaacatgatggcctggaaa

SEQ ID NO: 21865 - DNA, 20 bp, Artificial Sequence
  sgRNA
gtggcaagttctgtcagatg

SEQ ID NO: 21866 - DNA, 20 bp, Artificial Sequence
  sgRNA
tgcctgcaaccttgtctgag

SEQ ID NO: 21867 - DNA, 20 bp, Artificial Sequence
  sgRNA
actcacataagtgatagtct

SEQ ID NO: 21868 - DNA, 20 bp, Artificial Sequence
  sgRNA
atgctcaggtcttctctctt

SEQ ID NO: 21869 - DNA, 20 bp, Artificial Sequence
  sgRNA
aagctcaagaaattctagca

SEQ ID NO: 21870 - DNA, 20 bp, Artificial Sequence
  sgRNA
gcataaactgttccctctta

SEQ ID NO: 21871 - DNA, 20 bp, Artificial Sequence
  sgRNA
gtgagaaatcagcgctcgga

SEQ ID NO: 21872 - DNA, 20 bp, Artificial Sequence
  sgRNA
agggcggtgcaaacactagt

SEQ ID NO: 21873 - DNA, 20 bp, Artificial Sequence
  sgRNA
ggtgcgtcgtcggcccgagg

SEQ ID NO: 21874 - DNA, 20 bp, Artificial Sequence
  sgRNA
cggaggaggagaagcgaaac

SEQ ID NO: 21875 - DNA, 20 bp, Artificial Sequence
  sgRNA
tcgagcggcggagagtttcg

SEQ ID NO: 21876 - DNA, 20 bp, Artificial Sequence
  sgRNA
cctgtgtaagcatgggactc

SEQ ID NO: 21877 - DNA, 20 bp, Artificial Sequence
  sgRNA
tacatgtagtgtgtagctct

SEQ ID NO: 21878 - DNA, 20 bp, Artificial Sequence
  sgRNA
catgctcacccaatgctaag

SEQ ID NO: 21879 - DNA, 20 bp, Artificial Sequence
  sgRNA
ctcagctaacacagcgactg

SEQ ID NO: 21880 - DNA, 20 bp, Artificial Sequence
  sgRNA
gccggacaaagacaacttcc

SEQ ID NO: 21881 - DNA, 20 bp, Artificial Sequence
  sgRNA
agagggactttccgcgttgt

SEQ ID NO: 21882 - DNA, 20 bp, Artificial Sequence
  sgRNA
gtcggcccacgaccgggacg

SEQ ID NO: 21883 - DNA, 20 bp, Artificial Sequence
  sgRNA
ggagcccgtacccgtgcggc

SEQ ID NO: 21884 - DNA, 20 bp, Artificial Sequence
  sgRNA
tgggttcctgttgtaccgag

SEQ ID NO: 21885 - DNA, 20 bp, Artificial Sequence
  sgRNA
cctagcaacaagagactctc

SEQ ID NO: 21886 - DNA, 20 bp, Artificial Sequence
  sgRNA
ggattcaatagaaagctaag

SEQ ID NO: 21887 - DNA, 20 bp, Artificial Sequence
  sgRNA
cagaacagtgcaactagcta

SEQ ID NO: 21888 - DNA, 20 bp, Artificial Sequence
  sgRNA
agatgtagctcattggtaat

SEQ ID NO: 21889 - DNA, 20 bp, Artificial Sequence
  sgRNA
ctcactattcaatggtgcct

SEQ ID NO: 21890 - DNA, 20 bp, Artificial Sequence
  sgRNA
gcatgacagggttggagttt

SEQ ID NO: 21891 - DNA, 20 bp, Artificial Sequence
  sgRNA
agggtgtactggaggagagc

SEQ ID NO: 21892 - DNA, 20 bp, Artificial Sequence
  sgRNA
tctgagggcactggcaagcc

SEQ ID NO: 21893 - DNA, 20 bp, Artificial Sequence
  sgRNA
ggagccaggagcaacgtgcg

SEQ ID NO: 21894 - DNA, 20 bp, Artificial Sequence
  sgRNA
ctggatgctccggaccactg

SEQ ID NO: 21895 - DNA, 20 bp, Artificial Sequence
  sgRNA
cgacacgacccggcagctca

SEQ ID NO: 21896 - DNA, 20 bp, Artificial Sequence
  sgRNA
gagtctaggtcagcgacctc

SEQ ID NO: 21897 - DNA, 20 bp, Artificial Sequence
  sgRNA
gggccggaccgcgcaaatgg

SEQ ID NO: 21898 - DNA, 20 bp, Artificial Sequence
  sgRNA
gttaaacggacccgccgcag

SEQ ID NO: 21899 - DNA, 20 bp, Artificial Sequence
  sgRNA
cggcgccgcgcacgtaatat

SEQ ID NO: 21900 - DNA, 20 bp, Artificial Sequence
  sgRNA
ccattcaacccaagtctgcc

SEQ ID NO: 21901 - DNA, 20 bp, Artificial Sequence
  sgRNA
gctatgttcggagtattaag

SEQ ID NO: 21902 - DNA, 20 bp, Artificial Sequence
  sgRNA
ggaatcagttacaattcctc

SEQ ID NO: 21903 - DNA, 20 bp, Artificial Sequence
  sgRNA
cagggctaactaaccatcag

SEQ ID NO: 21904 - DNA, 20 bp, Artificial Sequence
  sgRNA
cctgcttccgggaagccgac

SEQ ID NO: 21905 - DNA, 20 bp, Artificial Sequence
  sgRNA
agctgtgaggtcttccctcg

SEQ ID NO: 21906 - DNA, 20 bp, Artificial Sequence
  sgRNA
cagttcagcaaacctacctt

SEQ ID NO: 21907 - DNA, 20 bp, Artificial Sequence
  sgRNA
tgtgcctcccgctcaggcgg

SEQ ID NO: 21908 - DNA, 20 bp, Artificial Sequence
  sgRNA
ggactatgtgctgcagtggc

SEQ ID NO: 21909 - DNA, 20 bp, Artificial Sequence
  sgRNA
gggtttggtgcacgtgggag

SEQ ID NO: 21910 - DNA, 20 bp, Artificial Sequence
  sgRNA
cagccttcagagctaagtgc

SEQ ID NO: 21911 - DNA, 20 bp, Artificial Sequence
  sgRNA
gctatgacgatgagactggc

SEQ ID NO: 21912 - DNA, 20 bp, Artificial Sequence
  sgRNA
aggccggttaagatcggagg

SEQ ID NO: 21913 - DNA, 20 bp, Artificial Sequence
  sgRNA
ccgaggagccaatcagaggg

SEQ ID NO: 21914 - DNA, 20 bp, Artificial Sequence
  sgRNA
atcagagggcggcgttcgtc

SEQ ID NO: 21915 - DNA, 20 bp, Artificial Sequence
  sgRNA
cagggttcctgtcaccggag

SEQ ID NO: 21916 - DNA, 20 bp, Artificial Sequence
  sgRNA
caaggaagagggaaaggatt

SEQ ID NO: 21917 - DNA, 20 bp, Artificial Sequence
  sgRNA
ggcggaacgcttgggtcagg

SEQ ID NO: 21918 - DNA, 20 bp, Artificial Sequence
  sgRNA
gcgtggacgcgtgggcactc

SEQ ID NO: 21919 - DNA, 20 bp, Artificial Sequence
  sgRNA
agaggaccactctttgcctt

SEQ ID NO: 21920 - DNA, 20 bp, Artificial Sequence
  sgRNA
cccgcctcctgctagcggga

SEQ ID NO: 21921 - DNA, 20 bp, Artificial Sequence
  sgRNA
tgaggtaactgtgtgttgat

SEQ ID NO: 21922 - DNA, 20 bp, Artificial Sequence
  sgRNA
ttggtgtgtgggcggtgctt

SEQ ID NO: 21923 - DNA, 20 bp, Artificial Sequence
  sgRNA
tctccagggctagggcggca

SEQ ID NO: 21924 - DNA, 20 bp, Artificial Sequence
  sgRNA
gagtctgttgcgcacgccca

SEQ ID NO: 21925 - DNA, 20 bp, Artificial Sequence
  sgRNA
gcgtggcaagctggagcacg

SEQ ID NO: 21926 - DNA, 20 bp, Artificial Sequence
  sgRNA
ctttgcagcattcttcaaac

SEQ ID NO: 21927 - DNA, 20 bp, Artificial Sequence
  sgRNA
ctcctgcgtccctacgcgcc

SEQ ID NO: 21928 - DNA, 20 bp, Artificial Sequence
  sgRNA
gtaagtatgacacgagcgat

SEQ ID NO: 21929 - DNA, 20 bp, Artificial Sequence
  sgRNA
ttgacgacagagggtttgat

SEQ ID NO: 21930 - DNA, 20 bp, Artificial Sequence
  sgRNA
gccgatcaatatttaatgct

SEQ ID NO: 21931 - DNA, 20 bp, Artificial Sequence
  sgRNA
gctcaagcagattggctctc

SEQ ID NO: 21932 - DNA, 20 bp, Artificial Sequence
  sgRNA
ctctgcgggagtcatgtcag

SEQ ID NO: 21933 - DNA, 20 bp, Artificial Sequence
  sgRNA
gtggctagagggattggcgc

SEQ ID NO: 21934 - DNA, 20 bp, Artificial Sequence
  sgRNA
cgcgtagcagcgtcgaggcg

SEQ ID NO: 21935 - DNA, 20 bp, Artificial Sequence
  sgRNA
gggcaggagcatacccacag

SEQ ID NO: 21936 - DNA, 20 bp, Artificial Sequence
  sgRNA
gcgcttagccagaggcgcga

SEQ ID NO: 21937 - DNA, 20 bp, Artificial Sequence
  sgRNA
ctttctccaccgtgcaagcc

SEQ ID NO: 21938 - DNA, 20 bp, Artificial Sequence
  sgRNA
gggctagatggacaggtgcc

SEQ ID NO: 21939 - DNA, 20 bp, Artificial Sequence
  sgRNA
atcatcacgaaatctaaacc

SEQ ID NO: 21940 - DNA, 20 bp, Artificial Sequence
  sgRNA
ctaccaaaggccgacttccc

SEQ ID NO: 21941 - DNA, 20 bp, Artificial Sequence
  sgRNA
ccacgcgacgccctagcaac

SEQ ID NO: 21942 - DNA, 20 bp, Artificial Sequence
  sgRNA
aagtgtgaggcggctgcggg

SEQ ID NO: 21943 - DNA, 20 bp, Artificial Sequence
  sgRNA
gagctcggcgggaggaaagc

SEQ ID NO: 21944 - DNA, 20 bp, Artificial Sequence
  sgRNA
ttctttaaaccggcgctacc

SEQ ID NO: 21945 - DNA, 20 bp, Artificial Sequence
  sgRNA
tcagtgcaatctgtcactgt

SEQ ID NO: 21946 - DNA, 20 bp, Artificial Sequence
  sgRNA
tgccaaactcctcaggtctg

SEQ ID NO: 21947 - DNA, 20 bp, Artificial Sequence
  sgRNA
tggaccgagcagttagaatg

SEQ ID NO: 21948 - DNA, 20 bp, Artificial Sequence
  sgRNA
agagcaaattccaagattct

SEQ ID NO: 21949 - DNA, 20 bp, Artificial Sequence
  sgRNA
agttgaaggaagagggaaag

SEQ ID NO: 21950 - DNA, 20 bp, Artificial Sequence
  sgRNA
tcataggaaagaagtgaatc

SEQ ID NO: 21951 - DNA, 20 bp, Artificial Sequence
  sgRNA
ctactccatccacaccagcg

SEQ ID NO: 21952 - DNA, 20 bp, Artificial Sequence
  sgRNA
ttcgcttgagcttgtaattg

SEQ ID NO: 21953 - DNA, 20 bp, Artificial Sequence
  sgRNA
acgacagacaactcctttgc

SEQ ID NO: 21954 - DNA, 20 bp, Artificial Sequence
  sgRNA
taagccctcattgatcaggg

SEQ ID NO: 21955 - DNA, 20 bp, Artificial Sequence
  sgRNA
ttaaatgatctctgaggtct

SEQ ID NO: 21956 - DNA, 20 bp, Artificial Sequence
  sgRNA
gcctttgtcacatgtagggc

SEQ ID NO: 21957 - DNA, 20 bp, Artificial Sequence
  sgRNA
agaatgagttccagcccaga

SEQ ID NO: 21958 - DNA, 20 bp, Artificial Sequence
  sgRNA
tccgaggtgatcagagttcc

SEQ ID NO: 21959 - DNA, 20 bp, Artificial Sequence
  sgRNA
tctctagtatccatggtgag

SEQ ID NO: 21960 - DNA, 20 bp, Artificial Sequence
  sgRNA
ctgcacctctgccgtcactg

SEQ ID NO: 21961 - DNA, 20 bp, Artificial Sequence
  sgRNA
ggaggagaatagcgcgcctg

SEQ ID NO: 21962 - DNA, 20 bp, Artificial Sequence
  sgRNA
cgtggcctcccgcagggagg

SEQ ID NO: 21963 - DNA, 20 bp, Artificial Sequence
  sgRNA
ggctgagcgccaggtttgca

SEQ ID NO: 21964 - DNA, 20 bp, Artificial Sequence
  sgRNA
tctgagcgcctagtccagct

SEQ ID NO: 21965 - DNA, 20 bp, Artificial Sequence
  sgRNA
cagggcagcgcagatggatc

SEQ ID NO: 21966 - DNA, 20 bp, Artificial Sequence
  sgRNA
cccactccggcctggcacgg

SEQ ID NO: 21967 - DNA, 20 bp, Artificial Sequence
  sgRNA
ctctctctgggcaccctggc

SEQ ID NO: 21968 - DNA, 20 bp, Artificial Sequence
  sgRNA
ttccacatcgcacaatcctg

SEQ ID NO: 21969 - DNA, 20 bp, Artificial Sequence
  sgRNA
gggacagaactttgggattg

SEQ ID NO: 21970 - DNA, 20 bp, Artificial Sequence
  sgRNA
tgcctcttctgggaccctat

SEQ ID NO: 21971 - DNA, 20 bp, Artificial Sequence
  sgRNA
tgacctgaaaccctagtggg

SEQ ID NO: 21972 - DNA, 20 bp, Artificial Sequence
  sgRNA
aaattaaggtgtgacgaaac

SEQ ID NO: 21973 - DNA, 20 bp, Artificial Sequence
  sgRNA
gttcctatagctttcaaacg

SEQ ID NO: 21974 - DNA, 20 bp, Artificial Sequence
  sgRNA
tacgctggcaggctgtgggc

SEQ ID NO: 21975 - DNA, 20 bp, Artificial Sequence
  sgRNA
taactgtgcgcagtgttcaa

SEQ ID NO: 21976 - DNA, 20 bp, Artificial Sequence
  sgRNA
tcgtcctatgcctgagcggc

SEQ ID NO: 21977 - DNA, 20 bp, Artificial Sequence
  sgRNA
gttactagtgtgacaaaggc

SEQ ID NO: 21978 - DNA, 20 bp, Artificial Sequence
  sgRNA
aactcgtgacaacccgtcgg

SEQ ID NO: 21979 - DNA, 20 bp, Artificial Sequence
  sgRNA
gttctgacgcgcggaaaccc

SEQ ID NO: 21980 - DNA, 20 bp, Artificial Sequence
  sgRNA
acctagtttactgtggttgg

SEQ ID NO: 21981 - DNA, 20 bp, Artificial Sequence
  sgRNA
taatctcattaacgcgcgcg

SEQ ID NO: 21982 - DNA, 20 bp, Artificial Sequence
  sgRNA
cccaccctagcctcggcggg

SEQ ID NO: 21983 - DNA, 20 bp, Artificial Sequence
  sgRNA
ccacacgcagggccaaggag

SEQ ID NO: 21984 - DNA, 20 bp, Artificial Sequence
  sgRNA
gttcagaaactaatactcct

SEQ ID NO: 21985 - DNA, 20 bp, Artificial Sequence
  sgRNA
cagagggacgtcacttataa

SEQ ID NO: 21986 - DNA, 20 bp, Artificial Sequence
  sgRNA
tcaagtatgaagttgctgtc

SEQ ID NO: 21987 - DNA, 20 bp, Artificial Sequence
  sgRNA
ctgcttcagtgacacgatct

SEQ ID NO: 21988 - DNA, 20 bp, Artificial Sequence
  sgRNA
ggaggcgagaggctcctccc

SEQ ID NO: 21989 - DNA, 20 bp, Artificial Sequence
  sgRNA
atcgagggagggcggacggc

SEQ ID NO: 21990 - DNA, 20 bp, Artificial Sequence
  sgRNA
gcgcggtctcgaagcggagg

SEQ ID NO: 21991 - DNA, 20 bp, Artificial Sequence
  sgRNA
gcgcagacttcgcgaggacg

SEQ ID NO: 21992 - DNA, 20 bp, Artificial Sequence
  sgRNA
ccttcctcacattcctgacg

SEQ ID NO: 21993 - DNA, 20 bp, Artificial Sequence
  sgRNA
aggagaccagaagtgtaaag

SEQ ID NO: 21994 - DNA, 20 bp, Artificial Sequence
  sgRNA
tggtgggacagctaagaaag

SEQ ID NO: 21995 - DNA, 20 bp, Artificial Sequence
  sgRNA
gggagttgagcagcacagtc

SEQ ID NO: 21996 - DNA, 20 bp, Artificial Sequence
  sgRNA
gggtgcctgagtaacacgtg

SEQ ID NO: 21997 - DNA, 20 bp, Artificial Sequence
  sgRNA
aatgtggttgtgcgtgcacg

SEQ ID NO: 21998 - DNA, 20 bp, Artificial Sequence
  sgRNA
gcgccttccctggatgtgca

SEQ ID NO: 21999 - DNA, 20 bp, Artificial Sequence
  sgRNA
gaagagttaacagcggcagc

SEQ ID NO: 22000 - DNA, 20 bp, Artificial Sequence
  sgRNA
gccatgggatcaactggcga

SEQ ID NO: 22001 - DNA, 20 bp, Artificial Sequence
  sgRNA
tagatgcctggcttgcctcc

SEQ ID NO: 22002 - DNA, 20 bp, Artificial Sequence
  sgRNA
ccaccagatcctgttaagaa

SEQ ID NO: 22003 - DNA, 20 bp, Artificial Sequence
  sgRNA
ggcaagaggcagagcattgt

SEQ ID NO: 22004 - DNA, 20 bp, Artificial Sequence
  sgRNA
ctctccggcatctctagttt

SEQ ID NO: 22005 - DNA, 20 bp, Artificial Sequence
  sgRNA
atctatgaggccatctgttg

SEQ ID NO: 22006 - DNA, 20 bp, Artificial Sequence
  sgRNA
ttaacagaaggtcatatgcc

SEQ ID NO: 22007 - DNA, 20 bp, Artificial Sequence
  sgRNA
gtcagcaggatgctcccggt

SEQ ID NO: 22008 - DNA, 20 bp, Artificial Sequence
  sgRNA
ggctcgagaagggagggctt

SEQ ID NO: 22009 - DNA, 20 bp, Artificial Sequence
  sgRNA
tgagcccagtgaagtgggcg

SEQ ID NO: 22010 - DNA, 20 bp, Artificial Sequence
  sgRNA
cacgtgaccgtcgcctcacg

SEQ ID NO: 22011 - DNA, 20 bp, Artificial Sequence
  sgRNA
attacttctggtaggagtcg

SEQ ID NO: 22012 - DNA, 20 bp, Artificial Sequence
  sgRNA
gggcgcctcccgggtcctcc

SEQ ID NO: 22013 - DNA, 20 bp, Artificial Sequence
  sgRNA
gggctgagggcggagctcgg

SEQ ID NO: 22014 - DNA, 20 bp, Artificial Sequence
  sgRNA
ggtcaggatgggatttgaac

SEQ ID NO: 22015 - DNA, 20 bp, Artificial Sequence
  sgRNA
atacacgcactccctttggg

SEQ ID NO: 22016 - DNA, 20 bp, Artificial Sequence
  sgRNA
gaagagacccttcttgagaa

SEQ ID NO: 22017 - DNA, 20 bp, Artificial Sequence
  sgRNA
gtagggaagcaaagcatcat

SEQ ID NO: 22018 - DNA, 20 bp, Artificial Sequence
  sgRNA
cagcatgcattgccttcaag

SEQ ID NO: 22019 - DNA, 20 bp, Artificial Sequence
  sgRNA
aaagggccagcgacacactc

SEQ ID NO: 22020 - DNA, 20 bp, Artificial Sequence
  sgRNA
ccagtgcttggaatgtccct

SEQ ID NO: 22021 - DNA, 20 bp, Artificial Sequence
  sgRNA
ggcgaggcttctgcaagccc

SEQ ID NO: 22022 - DNA, 20 bp, Artificial Sequence
  sgRNA
aacaagaaccctgtgacata

SEQ ID NO: 22023 - DNA, 20 bp, Artificial Sequence
  sgRNA
ttctgatagccacttatgct

SEQ ID NO: 22024 - DNA, 20 bp, Artificial Sequence
  sgRNA
tgtgggctcctcgcgagcct

SEQ ID NO: 22025 - DNA, 20 bp, Artificial Sequence
  sgRNA
gacaatcttggcgtccgaaa

SEQ ID NO: 22026 - DNA, 20 bp, Artificial Sequence
  sgRNA
agcgtgtggaccgggccacg

SEQ ID NO: 22027 - DNA, 20 bp, Artificial Sequence
  sgRNA
agcggcgcctgtgaggtcag

SEQ ID NO: 22028 - DNA, 20 bp, Artificial Sequence
  sgRNA
tctcgagcgcatataagcct

SEQ ID NO: 22029 - DNA, 20 bp, Artificial Sequence
  sgRNA
ccgcccgctttccggaaacc

SEQ ID NO: 22030 - DNA, 20 bp, Artificial Sequence
  sgRNA
gaccttaacccttccgaccc

SEQ ID NO: 22031 - DNA, 20 bp, Artificial Sequence
  sgRNA
cccgcctgtccgaggacgtc

SEQ ID NO: 22032 - DNA, 20 bp, Artificial Sequence
  sgRNA
cgagccttatgccctggaga

SEQ ID NO: 22033 - DNA, 20 bp, Artificial Sequence
  sgRNA
acagtgctagagaatcgatt

SEQ ID NO: 22034 - DNA, 20 bp, Artificial Sequence
  sgRNA
tactcaagaatgcagcatct

SEQ ID NO: 22035 - DNA, 20 bp, Artificial Sequence
  sgRNA
tatctagtcctcatttgcag

SEQ ID NO: 22036 - DNA, 20 bp, Artificial Sequence
  sgRNA
acgatgtttgaggctaactt

SEQ ID NO: 22037 - DNA, 20 bp, Artificial Sequence
  sgRNA
ctagtgatcaaatttcagtt

SEQ ID NO: 22038 - DNA, 20 bp, Artificial Sequence
  sgRNA
taatgttatggctttgaaac

SEQ ID NO: 22039 - DNA, 20 bp, Artificial Sequence
  sgRNA
agcggagaagactttcagcc

SEQ ID NO: 22040 - DNA, 20 bp, Artificial Sequence
  sgRNA
cccagcctcagatcagctgt

SEQ ID NO: 22041 - DNA, 20 bp, Artificial Sequence
  sgRNA
tttatccaccagtggctggg

SEQ ID NO: 22042 - DNA, 20 bp, Artificial Sequence
  sgRNA
cgccttgctggctggcgacc

SEQ ID NO: 22043 - DNA, 20 bp, Artificial Sequence
  sgRNA
ctgagcctgtcgcctcatcc

SEQ ID NO: 22044 - DNA, 20 bp, Artificial Sequence
  sgRNA
gggcaggacgtcgagggctc

SEQ ID NO: 22045 - DNA, 20 bp, Artificial Sequence
  sgRNA
ttggtccttaggtaccagtt

SEQ ID NO: 22046 - DNA, 20 bp, Artificial Sequence
  sgRNA
ggaggcatctgtctgtctta

SEQ ID NO: 22047 - DNA, 20 bp, Artificial Sequence
  sgRNA
tagcagtcagatgaccacaa

SEQ ID NO: 22048 - DNA, 20 bp, Artificial Sequence
  sgRNA
ccggcgtccagccatgaatc

SEQ ID NO: 22049 - DNA, 20 bp, Artificial Sequence
  sgRNA
acgagtcccagaagaatgtg

SEQ ID NO: 22050 - DNA, 20 bp, Artificial Sequence
  sgRNA
tttgggctgggcttctgtta

SEQ ID NO: 22051 - DNA, 20 bp, Artificial Sequence
  sgRNA
gggatcacaaaggcggagag

SEQ ID NO: 22052 - DNA, 20 bp, Artificial Sequence
  sgRNA
accttgacaacagcaataaa

SEQ ID NO: 22053 - DNA, 20 bp, Artificial Sequence
  sgRNA
gttgagctagaggagataaa

SEQ ID NO: 22054 - DNA, 20 bp, Artificial Sequence
  sgRNA
tggaggaaacgtgcatcatg

SEQ ID NO: 22055 - DNA, 20 bp, Artificial Sequence
  sgRNA
ccggcgagagcccgcgttcc

SEQ ID NO: 22056 - DNA, 20 bp, Artificial Sequence
  sgRNA
gttatcctcacggaggtggg

SEQ ID NO: 22057 - DNA, 20 bp, Artificial Sequence
  sgRNA
ttgtgcagaaatgccaagtc

SEQ ID NO: 22058 - DNA, 20 bp, Artificial Sequence
  sgRNA
tgcctctccgcattgccctc

SEQ ID NO: 22059 - DNA, 20 bp, Artificial Sequence
  sgRNA
cacgcttccgtcctggaagg

SEQ ID NO: 22060 - DNA, 20 bp, Artificial Sequence
  sgRNA
tgcgtggtgaggatgctaag

SEQ ID NO: 22061 - DNA, 20 bp, Artificial Sequence
  sgRNA
gcacgcgcagtacggcacga

SEQ ID NO: 22062 - DNA, 20 bp, Artificial Sequence
  sgRNA
gaggagcgggaacagcagtt

SEQ ID NO: 22063 - DNA, 20 bp, Artificial Sequence
  sgRNA
gtcgcacgggcgcctcctgt

SEQ ID NO: 22064 - DNA, 20 bp, Artificial Sequence
  sgRNA
gggaccgctccgcgggtgga

SEQ ID NO: 22065 - DNA, 20 bp, Artificial Sequence
  sgRNA
caggcgctgcgcgtacccgt

SEQ ID NO: 22066 - DNA, 20 bp, Artificial Sequence
  sgRNA
gaaactagcgtttcaacgtt

SEQ ID NO: 22067 - DNA, 20 bp, Artificial Sequence
  sgRNA
acccgaagcgaggattatgc

SEQ ID NO: 22068 - DNA, 20 bp, Artificial Sequence
  sgRNA
ctgttctcggacggagcagt

SEQ ID NO: 22069 - DNA, 20 bp, Artificial Sequence
  sgRNA
ggccctcagagtattaccca

SEQ ID NO: 22070 - DNA, 20 bp, Artificial Sequence
  sgRNA
ctgttagagggaccaatgac

SEQ ID NO: 22071 - DNA, 20 bp, Artificial Sequence
  sgRNA
gatcaggtgttcagtggctc

SEQ ID NO: 22072 - DNA, 20 bp, Artificial Sequence
  sgRNA
gtattacagaagcccacaag

SEQ ID NO: 22073 - DNA, 20 bp, Artificial Sequence
  sgRNA
attgaatccagtgctgtcac

SEQ ID NO: 22074 - DNA, 20 bp, Artificial Sequence
  sgRNA
gagcatttaccagtagttat

SEQ ID NO: 22075 - DNA, 20 bp, Artificial Sequence
  sgRNA
tgactgaagccaattctgcg

SEQ ID NO: 22076 - DNA, 20 bp, Artificial Sequence
  sgRNA
tttggctgacgtgttgataa

SEQ ID NO: 22077 - DNA, 20 bp, Artificial Sequence
  sgRNA
caacagaagcggcttccatt

SEQ ID NO: 22078 - DNA, 20 bp, Artificial Sequence
  sgRNA
tttcccgcagaaagaagcgc

SEQ ID NO: 22079 - DNA, 20 bp, Artificial Sequence
  sgRNA
aagtttctggctgcgccgcg

SEQ ID NO: 22080 - DNA, 20 bp, Artificial Sequence
  sgRNA
ggtcgagcgggcggagtacg

SEQ ID NO: 22081 - DNA, 20 bp, Artificial Sequence
  sgRNA
gtgacctcactagaccctag

SEQ ID NO: 22082 - DNA, 20 bp, Artificial Sequence
  sgRNA
ccgtgggtggaacctttgag

SEQ ID NO: 22083 - DNA, 20 bp, Artificial Sequence
  sgRNA
ggcctcaccattccagaata

SEQ ID NO: 22084 - DNA, 20 bp, Artificial Sequence
  sgRNA
caccatatctggaagtttcc

SEQ ID NO: 22085 - DNA, 20 bp, Artificial Sequence
  sgRNA
gccaatcgtgacggcttccc

SEQ ID NO: 22086 - DNA, 20 bp, Artificial Sequence
  sgRNA
tcgtttcactttcaagggcc

SEQ ID NO: 22087 - DNA, 20 bp, Artificial Sequence
  sgRNA
tgacagatgcctactatgag

SEQ ID NO: 22088 - DNA, 20 bp, Artificial Sequence
  sgRNA
agtctccaacatggctacca

SEQ ID NO: 22089 - DNA, 20 bp, Artificial Sequence
  sgRNA
agcaaatagtgagtgaaata

SEQ ID NO: 22090 - DNA, 20 bp, Artificial Sequence
  sgRNA
atgtgatgcacataaatctg

SEQ ID NO: 22091 - DNA, 20 bp, Artificial Sequence
  sgRNA
gggaacgcattaatttcctt

SEQ ID NO: 22092 - DNA, 20 bp, Artificial Sequence
  sgRNA
acctatagaagtgtctttgc

SEQ ID NO: 22093 - DNA, 20 bp, Artificial Sequence
  sgRNA
tgctcttgtcagagtgagaa

SEQ ID NO: 22094 - DNA, 20 bp, Artificial Sequence
  sgRNA
cctaacactaagtgcaggcg

SEQ ID NO: 22095 - DNA, 20 bp, Artificial Sequence
  sgRNA
tgtaagcgatcagcagcaga

SEQ ID NO: 22096 - DNA, 20 bp, Artificial Sequence
  sgRNA
tgggcgtagcgcgcagctgc

SEQ ID NO: 22097 - DNA, 20 bp, Artificial Sequence
  sgRNA
cgcctcgggcgacacattct

SEQ ID NO: 22098 - DNA, 20 bp, Artificial Sequence
  sgRNA
ggcggagggtggcgggctac

SEQ ID NO: 22099 - DNA, 20 bp, Artificial Sequence
  sgRNA
gtaatgggaggctcctaggc

SEQ ID NO: 22100 - DNA, 20 bp, Artificial Sequence
  sgRNA
gcaaagaaagtaggcgttaa

SEQ ID NO: 22101 - DNA, 20 bp, Artificial Sequence
  sgRNA
tcccattaccgctcgaagag

SEQ ID NO: 22102 - DNA, 20 bp, Artificial Sequence
  sgRNA
tcaagacctgttcatcccat

SEQ ID NO: 22103 - DNA, 20 bp, Artificial Sequence
  sgRNA
cactactgtgacgtctttcg

SEQ ID NO: 22104 - DNA, 20 bp, Artificial Sequence
  sgRNA
agcaaacaagttcaagagag

SEQ ID NO: 22105 - DNA, 20 bp, Artificial Sequence
  sgRNA
gcctggcctggaatcacgtg

SEQ ID NO: 22106 - DNA, 20 bp, Artificial Sequence
  sgRNA
gcattcgaattccatcagag

SEQ ID NO: 22107 - DNA, 20 bp, Artificial Sequence
  sgRNA
agttctgtacagacttacac

SEQ ID NO: 22108 - DNA, 20 bp, Artificial Sequence
  sgRNA
gagtagcagcctatgagatt

SEQ ID NO: 22109 - DNA, 20 bp, Artificial Sequence
  sgRNA
tgtgggtctaggtcgggagc

SEQ ID NO: 22110 - DNA, 20 bp, Artificial Sequence
  sgRNA
ccaatcacccgccactgccc

SEQ ID NO: 22111 - DNA, 20 bp, Artificial Sequence
  sgRNA
cgcctccgcgtgactgacgg

SEQ ID NO: 22112 - DNA, 20 bp, Artificial Sequence
  sgRNA
ctgcggaccaacgggctggg

SEQ ID NO: 22113 - DNA, 20 bp, Artificial Sequence
  sgRNA
tcgcggaggcgcggcttggt

SEQ ID NO: 22114 - DNA, 20 bp, Artificial Sequence
  sgRNA
aatagagggttgagaagaaa

SEQ ID NO: 22115 - DNA, 20 bp, Artificial Sequence
  sgRNA
gtgggagtgtgacgctgcag

SEQ ID NO: 22116 - DNA, 20 bp, Artificial Sequence
  sgRNA
ttgtgacccggtaggtttgg

SEQ ID NO: 22117 - DNA, 20 bp, Artificial Sequence
  sgRNA
ctgggacgtccgagtgaggg

SEQ ID NO: 22118 - DNA, 20 bp, Artificial Sequence
  sgRNA
gaagccacttccaacctgct

SEQ ID NO: 22119 - DNA, 20 bp, Artificial Sequence
  sgRNA
aagggaaaggcaaggccgta

SEQ ID NO: 22120 - DNA, 20 bp, Artificial Sequence
  sgRNA
ggcgaggccgggccaactct

SEQ ID NO: 22121 - DNA, 20 bp, Artificial Sequence
  sgRNA
gggaggagccttctctggag

SEQ ID NO: 22122 - DNA, 20 bp, Artificial Sequence
  sgRNA
cccagccgcggaaccaagac

SEQ ID NO: 22123 - DNA, 20 bp, Artificial Sequence
  sgRNA
tctctaagatgattgcagaa

SEQ ID NO: 22124 - DNA, 20 bp, Artificial Sequence
  sgRNA
ctcaagctagaagctatata

SEQ ID NO: 22125 - DNA, 20 bp, Artificial Sequence
  sgRNA
tgtcttcattgtggaaggtg

SEQ ID NO: 22126 - DNA, 20 bp, Artificial Sequence
  sgRNA
gtggtagctgggatacatac

SEQ ID NO: 22127 - DNA, 20 bp, Artificial Sequence
  sgRNA
aggaagttggccagtttatg

SEQ ID NO: 22128 - DNA, 20 bp, Artificial Sequence
  sgRNA
gctcagtagtaggtaagagg

SEQ ID NO: 22129 - DNA, 20 bp, Artificial Sequence
  sgRNA
gtgccggagccggttccggg

SEQ ID NO: 22130 - DNA, 20 bp, Artificial Sequence
  sgRNA
aagggacactgtgactgagc

SEQ ID NO: 22131 - DNA, 20 bp, Artificial Sequence
  sgRNA
atcaggccggcggccgcggc

SEQ ID NO: 22132 - DNA, 20 bp, Artificial Sequence
  sgRNA
gtcctggagcaagacaaaca

SEQ ID NO: 22133 - DNA, 20 bp, Artificial Sequence
  sgRNA
agagatgacatgaaggagcc

SEQ ID NO: 22134 - DNA, 20 bp, Artificial Sequence
  sgRNA
ttgcagctggagtctgcttg

SEQ ID NO: 22135 - DNA, 20 bp, Artificial Sequence
  sgRNA
tccggcgcctgtgtaggtcg

SEQ ID NO: 22136 - DNA, 20 bp, Artificial Sequence
  sgRNA
atcagaaaccttccttagaa

SEQ ID NO: 22137 - DNA, 20 bp, Artificial Sequence
  sgRNA
cctggctttggagcacatct

SEQ ID NO: 22138 - DNA, 20 bp, Artificial Sequence
  sgRNA
ctaatcgttctccgctccaa

SEQ ID NO: 22139 - DNA, 20 bp, Artificial Sequence
  sgRNA
gtctggcgcctgcgtcttgc

SEQ ID NO: 22140 - DNA, 20 bp, Artificial Sequence
  sgRNA
cccgaccaatcgcggcgggt

SEQ ID NO: 22141 - DNA, 20 bp, Artificial Sequence
  sgRNA
ggctgtgattggtgtgggcg

SEQ ID NO: 22142 - DNA, 20 bp, Artificial Sequence
  sgRNA
cgcccgcggaactgcggctg

SEQ ID NO: 22143 - DNA, 20 bp, Artificial Sequence
  sgRNA
ttctggcggtcccaggttgt

SEQ ID NO: 22144 - DNA, 20 bp, Artificial Sequence
  sgRNA
tttcccgtgtgtgtcgtcct

SEQ ID NO: 22145 - DNA, 20 bp, Artificial Sequence
  sgRNA
gaaagatgaacgcctcgcta

SEQ ID NO: 22146 - DNA, 20 bp, Artificial Sequence
  sgRNA
ttctccggagtgggtggccg

SEQ ID NO: 22147 - DNA, 20 bp, Artificial Sequence
  sgRNA
gatcgcctggatcgcgtccc

SEQ ID NO: 22148 - DNA, 20 bp, Artificial Sequence
  sgRNA
gggcatctgtcccgggcggg

SEQ ID NO: 22149 - DNA, 20 bp, Artificial Sequence
  sgRNA
aggcgttgccatgacgacca

SEQ ID NO: 22150 - DNA, 20 bp, Artificial Sequence
  sgRNA
cattccgcaggctctatgca

SEQ ID NO: 22151 - DNA, 20 bp, Artificial Sequence
  sgRNA
cccgggcgctgctggtcgaa

SEQ ID NO: 22152 - DNA, 20 bp, Artificial Sequence
  sgRNA
gggtataaatggagcggtgg

SEQ ID NO: 22153 - DNA, 20 bp, Artificial Sequence
  sgRNA
gtgtccgcactgcccttcgc

SEQ ID NO: 22154 - DNA, 20 bp, Artificial Sequence
  sgRNA
ttctccagtgagacccatgc

SEQ ID NO: 22155 - DNA, 20 bp, Artificial Sequence
  sgRNA
gcagtccagggaatgcttcc

SEQ ID NO: 22156 - DNA, 20 bp, Artificial Sequence
  sgRNA
gtgatgggtttgccgcaaag

SEQ ID NO: 22157 - DNA, 20 bp, Artificial Sequence
  sgRNA
acgcaacactgacggacgag

SEQ ID NO: 22158 - DNA, 20 bp, Artificial Sequence
  sgRNA
gaaagggctcggatgccctg

SEQ ID NO: 22159 - DNA, 20 bp, Artificial Sequence
  sgRNA
gcccaatgcgtgtgcttggg

SEQ ID NO: 22160 - DNA, 20 bp, Artificial Sequence
  sgRNA
attccagtcagcaggattca

SEQ ID NO: 22161 - DNA, 20 bp, Artificial Sequence
  sgRNA
gaaacaggaatgccagactg

SEQ ID NO: 22162 - DNA, 20 bp, Artificial Sequence
  sgRNA
caccctcgtccagcgacagt

SEQ ID NO: 22163 - DNA, 20 bp, Artificial Sequence
  sgRNA
atcaggagggtttgattgaa

SEQ ID NO: 22164 - DNA, 20 bp, Artificial Sequence
  sgRNA
aggcagtcaggagcagccag

SEQ ID NO: 22165 - DNA, 20 bp, Artificial Sequence
  sgRNA
aagcagtgcccgtgaccctg

SEQ ID NO: 22166 - DNA, 20 bp, Artificial Sequence
  sgRNA
caaatgttgggtgagaatta

SEQ ID NO: 22167 - DNA, 20 bp, Artificial Sequence
  sgRNA
catctatcttgacaatttca

SEQ ID NO: 22168 - DNA, 20 bp, Artificial Sequence
  sgRNA
tcaatgctcctccttcacgt

SEQ ID NO: 22169 - DNA, 20 bp, Artificial Sequence
  sgRNA
gggcggccggcgtcgctggc

SEQ ID NO: 22170 - DNA, 20 bp, Artificial Sequence
  sgRNA
cgcccgccctgcagccttgc

SEQ ID NO: 22171 - DNA, 20 bp, Artificial Sequence
  sgRNA
gcttcgggagtgagtgtgtg

SEQ ID NO: 22172 - DNA, 20 bp, Artificial Sequence
  sgRNA
aatactctgggaacaccgat

SEQ ID NO: 22173 - DNA, 20 bp, Artificial Sequence
  sgRNA
gtcattagttgtcagggagc

SEQ ID NO: 22174 - DNA, 20 bp, Artificial Sequence
  sgRNA
agtgcagtaagcgtccttgg

SEQ ID NO: 22175 - DNA, 20 bp, Artificial Sequence
  sgRNA
ggagagaaagcgtcttagga

SEQ ID NO: 22176 - DNA, 20 bp, Artificial Sequence
  sgRNA
ttccagtctgcctttcaagg

SEQ ID NO: 22177 - DNA, 20 bp, Artificial Sequence
  sgRNA
ttccgtaggattggcgggcg

SEQ ID NO: 22178 - DNA, 20 bp, Artificial Sequence
  sgRNA
gcggccgttgccctggcgag

SEQ ID NO: 22179 - DNA, 20 bp, Artificial Sequence
  sgRNA
cttgcgggtagcagatgctt

SEQ ID NO: 22180 - DNA, 20 bp, Artificial Sequence
  sgRNA
aaccggagcaggcaggactg

SEQ ID NO: 22181 - DNA, 20 bp, Artificial Sequence
  sgRNA
cggccaccgagacgaggcgg

SEQ ID NO: 22182 - DNA, 20 bp, Artificial Sequence
  sgRNA
acttcaaaccgagttcccgt

SEQ ID NO: 22183 - DNA, 20 bp, Artificial Sequence
  sgRNA
ctgggctagagcggccaagc

SEQ ID NO: 22184 - DNA, 20 bp, Artificial Sequence
  sgRNA
gtccatgggcgggtccgcgg

SEQ ID NO: 22185 - DNA, 20 bp, Artificial Sequence
  sgRNA
tgtgcgcccactttgcagct

SEQ ID NO: 22186 - DNA, 20 bp, Artificial Sequence
  sgRNA
cccttagacccgaggacgtc

SEQ ID NO: 22187 - DNA, 20 bp, Artificial Sequence
  sgRNA
gggaggaggacggtccaccc

SEQ ID NO: 22188 - DNA, 20 bp, Artificial Sequence
  sgRNA
cagggagcccgtcgggtctg

SEQ ID NO: 22189 - DNA, 20 bp, Artificial Sequence
  sgRNA
agcccgccgagtccaggagg

SEQ ID NO: 22190 - DNA, 20 bp, Artificial Sequence
  sgRNA
gccggttgcgagcgtacacc

SEQ ID NO: 22191 - DNA, 20 bp, Artificial Sequence
  sgRNA
tgacggcagagtttgtcaga

SEQ ID NO: 22192 - DNA, 20 bp, Artificial Sequence
  sgRNA
cagatgcccagaggagggcg

SEQ ID NO: 22193 - DNA, 20 bp, Artificial Sequence
  sgRNA
ggacttcatacgccaccgac

SEQ ID NO: 22194 - DNA, 20 bp, Artificial Sequence
  sgRNA
gtgaagctaggacgtaggtc

SEQ ID NO: 22195 - DNA, 20 bp, Artificial Sequence
  sgRNA
ttcataggcgcggctctcta

SEQ ID NO: 22196 - DNA, 20 bp, Artificial Sequence
  sgRNA
aatgacacggagctggagag

SEQ ID NO: 22197 - DNA, 20 bp, Artificial Sequence
  sgRNA
ccgggagagtaggcggagcg

SEQ ID NO: 22198 - DNA, 20 bp, Artificial Sequence
  sgRNA
tcaggcagcttgtgagctct

SEQ ID NO: 22199 - DNA, 20 bp, Artificial Sequence
  sgRNA
gctggagatgtagggatggg

SEQ ID NO: 22200 - DNA, 20 bp, Artificial Sequence
  sgRNA
gggagtctcatgctcagatc

SEQ ID NO: 22201 - DNA, 20 bp, Artificial Sequence
  sgRNA
catcaagatccttagggatg

SEQ ID NO: 22202 - DNA, 20 bp, Artificial Sequence
  sgRNA
tataattggtttaagcctcg

SEQ ID NO: 22203 - DNA, 20 bp, Artificial Sequence
  sgRNA
aaagtgagggccaggtttgg

SEQ ID NO: 22204 - DNA, 20 bp, Artificial Sequence
  sgRNA
ctggcgggcggccgcctcac

SEQ ID NO: 22205 - DNA, 20 bp, Artificial Sequence
  sgRNA
agtattagtaatcccagaca

SEQ ID NO: 22206 - DNA, 20 bp, Artificial Sequence
  sgRNA
cagggaaaggaggagtttca

SEQ ID NO: 22207 - DNA, 20 bp, Artificial Sequence
  sgRNA
tggaattaatgaagcagcca

SEQ ID NO: 22208 - DNA, 20 bp, Artificial Sequence
  sgRNA
gttagatgcagttcctaccc

SEQ ID NO: 22209 - DNA, 20 bp, Artificial Sequence
  sgRNA
ctctctgctgttaccgcctt

SEQ ID NO: 22210 - DNA, 20 bp, Artificial Sequence
  sgRNA
agcttacccagacagccaat

SEQ ID NO: 22211 - DNA, 20 bp, Artificial Sequence
  sgRNA
ttcagggcttagaagcccat

SEQ ID NO: 22212 - DNA, 20 bp, Artificial Sequence
  sgRNA
agggataccttcgcattcta

SEQ ID NO: 22213 - DNA, 20 bp, Artificial Sequence
  sgRNA
attgttaacggtccgtttcc

SEQ ID NO: 22214 - DNA, 20 bp, Artificial Sequence
  sgRNA
atcgtttcgtgaactagaac

SEQ ID NO: 22215 - DNA, 20 bp, Artificial Sequence
  sgRNA
caccgcttctttccgagaaa

SEQ ID NO: 22216 - DNA, 20 bp, Artificial Sequence
  sgRNA
atcaaagaccgattggagcc

SEQ ID NO: 22217 - DNA, 20 bp, Artificial Sequence
  sgRNA
gatgggcgggacaagggacc

SEQ ID NO: 22218 - DNA, 20 bp, Artificial Sequence
  sgRNA
tgtttcgtcagtagttgctg

SEQ ID NO: 22219 - DNA, 20 bp, Artificial Sequence
  sgRNA
attggatcagtcaaaggcgg

SEQ ID NO: 22220 - DNA, 20 bp, Artificial Sequence
  sgRNA
acgtgacacgctgacaccga

SEQ ID NO: 22221 - DNA, 20 bp, Artificial Sequence
  sgRNA
ctggactcttgcccttctcg

SEQ ID NO: 22222 - DNA, 20 bp, Artificial Sequence
  sgRNA
gggtcaaagggtcttggtgc

SEQ ID NO: 22223 - DNA, 20 bp, Artificial Sequence
  sgRNA
gcaaccacaggcctcgggtg

SEQ ID NO: 22224 - DNA, 20 bp, Artificial Sequence
  sgRNA
attcacatcctcatcattgc

SEQ ID NO: 22225 - DNA, 20 bp, Artificial Sequence
  sgRNA
cattcattggtcacagcaga

SEQ ID NO: 22226 - DNA, 20 bp, Artificial Sequence
  sgRNA
ctcctaaatgtgacttccaa

SEQ ID NO: 22227 - DNA, 20 bp, Artificial Sequence
  sgRNA
gaacgaccggcgcacgggcc

SEQ ID NO: 22228 - DNA, 20 bp, Artificial Sequence
  sgRNA
gctgcgggaagccgtgacgc

SEQ ID NO: 22229 - DNA, 20 bp, Artificial Sequence
  sgRNA
gccagggttactgacctggc

SEQ ID NO: 22230 - DNA, 20 bp, Artificial Sequence
  sgRNA
ctccaccttaaagctgaaac

SEQ ID NO: 22231 - DNA, 20 bp, Artificial Sequence
  sgRNA
aatccttagtccagcctcag

SEQ ID NO: 22232 - DNA, 20 bp, Artificial Sequence
  sgRNA
gtgcactgtgggcaccactc

SEQ ID NO: 22233 - DNA, 20 bp, Artificial Sequence
  sgRNA
ggtgagtgtctgcctctagg

SEQ ID NO: 22234 - DNA, 20 bp, Artificial Sequence
  sgRNA
ggtatgcacacacatgacct

SEQ ID NO: 22235 - DNA, 20 bp, Artificial Sequence
  sgRNA
aaagcagctagcaagttaag

SEQ ID NO: 22236 - DNA, 20 bp, Artificial Sequence
  sgRNA
caaaggtcacgtgaggcgag

SEQ ID NO: 22237 - DNA, 20 bp, Artificial Sequence
  sgRNA
caattacaacaactttgtgc

SEQ ID NO: 22238 - DNA, 20 bp, Artificial Sequence
  sgRNA
gctgcctctgtattgtgtta

SEQ ID NO: 22239 - DNA, 20 bp, Artificial Sequence
  sgRNA
gaaaccagctctttctcagc

SEQ ID NO: 22240 - DNA, 20 bp, Artificial Sequence
  sgRNA
gaagtatcattatacaactc

SEQ ID NO: 22241 - DNA, 20 bp, Artificial Sequence
  sgRNA
gataaactcaagtggtgatt

SEQ ID NO: 22242 - DNA, 20 bp, Artificial Sequence
  sgRNA
gagcccttgttccacaaatc

SEQ ID NO: 22243 - DNA, 20 bp, Artificial Sequence
  sgRNA
gcctcacagaagatataacc

SEQ ID NO: 22244 - DNA, 20 bp, Artificial Sequence
  sgRNA
aggtacgtgtatggcttgca

SEQ ID NO: 22245 - DNA, 20 bp, Artificial Sequence
  sgRNA
cagagcagcagggagtattt

SEQ ID NO: 22246 - DNA, 20 bp, Artificial Sequence
  sgRNA
tagggagtatttgggaaata

SEQ ID NO: 22247 - DNA, 20 bp, Artificial Sequence
  sgRNA
aagctgcatttggctctgca

SEQ ID NO: 22248 - DNA, 20 bp, Artificial Sequence
  sgRNA
tgggcggatcgccctgacca

SEQ ID NO: 22249 - DNA, 20 bp, Artificial Sequence
  sgRNA
ggatgctatggaaaccaagt

SEQ ID NO: 22250 - DNA, 20 bp, Artificial Sequence
  sgRNA
catacatcttggaacaacct

SEQ ID NO: 22251 - DNA, 20 bp, Artificial Sequence
  sgRNA
ccggccctacactgaaatga

SEQ ID NO: 22252 - DNA, 20 bp, Artificial Sequence
  sgRNA
caacataaagctgcttgatg

SEQ ID NO: 22253 - DNA, 20 bp, Artificial Sequence
  sgRNA
aatcagagagcactgataat

SEQ ID NO: 22254 - DNA, 20 bp, Artificial Sequence
  sgRNA
ctcttctgagcagcgtacct

SEQ ID NO: 22255 - DNA, 20 bp, Artificial Sequence
  sgRNA
ggagagactctaacagtact

SEQ ID NO: 22256 - DNA, 20 bp, Artificial Sequence
  sgRNA
ggtagttacaaaggcataga

SEQ ID NO: 22257 - DNA, 20 bp, Artificial Sequence
  sgRNA
tcaacttatggtaatgagct

SEQ ID NO: 22258 - DNA, 20 bp, Artificial Sequence
  sgRNA
acaaagactggtctgtagcc

SEQ ID NO: 22259 - DNA, 20 bp, Artificial Sequence
  sgRNA
caccgcccattggacgcagc

SEQ ID NO: 22260 - DNA, 20 bp, Artificial Sequence
  sgRNA
cgggtaggctcattgcccaa

SEQ ID NO: 22261 - DNA, 20 bp, Artificial Sequence
  sgRNA
gctttgtgattggccagccg

SEQ ID NO: 22262 - DNA, 20 bp, Artificial Sequence
  sgRNA
aagtcactcaagcccaagcc

SEQ ID NO: 22263 - DNA, 20 bp, Artificial Sequence
  sgRNA
atattctctgatgacacagc

SEQ ID NO: 22264 - DNA, 20 bp, Artificial Sequence
  sgRNA
ggcctccaggtctccaactg

SEQ ID NO: 22265 - DNA, 20 bp, Artificial Sequence
  sgRNA
agcagaacaacgcctaaagc

SEQ ID NO: 22266 - DNA, 20 bp, Artificial Sequence
  sgRNA
tctatacagaaccctgtatt

SEQ ID NO: 22267 - DNA, 20 bp, Artificial Sequence
  sgRNA
gagacgccagagcgtgcacc

SEQ ID NO: 22268 - DNA, 20 bp, Artificial Sequence
  sgRNA
tctaattggcttctctgacg

SEQ ID NO: 22269 - DNA, 20 bp, Artificial Sequence
  sgRNA
gcgcccaagttataggcctg

SEQ ID NO: 22270 - DNA, 20 bp, Artificial Sequence
  sgRNA
ggatggacctcggttacaag

SEQ ID NO: 22271 - DNA, 20 bp, Artificial Sequence
  sgRNA
tcagctgagagcctagaggt

SEQ ID NO: 22272 - DNA, 20 bp, Artificial Sequence
  sgRNA
caattgagcaatggctttac

SEQ ID NO: 22273 - DNA, 20 bp, Artificial Sequence
  sgRNA
agttgaaagagaatgcacca

SEQ ID NO: 22274 - DNA, 20 bp, Artificial Sequence
  sgRNA
attgtgtaggatttcgcatc

SEQ ID NO: 22275 - DNA, 20 bp, Artificial Sequence
  sgRNA
acttcaattaacgcagaatg

SEQ ID NO: 22276 - DNA, 20 bp, Artificial Sequence
  sgRNA
ctgatttcagttgtcatatg

SEQ ID NO: 22277 - DNA, 20 bp, Artificial Sequence
  sgRNA
gcatcctctcgagtgtactg

SEQ ID NO: 22278 - DNA, 20 bp, Artificial Sequence
  sgRNA
gaggcgtgcacgtgactcac

SEQ ID NO: 22279 - DNA, 20 bp, Artificial Sequence
  sgRNA
aaacctctaatccgaacgta

SEQ ID NO: 22280 - DNA, 20 bp, Artificial Sequence
  sgRNA
acatggctggccttcaccca

SEQ ID NO: 22281 - DNA, 20 bp, Artificial Sequence
  sgRNA
cattcctgcggaaccgtctc

SEQ ID NO: 22282 - DNA, 20 bp, Artificial Sequence
  sgRNA
ccatctttggtgtggcgctt

SEQ ID NO: 22283 - DNA, 20 bp, Artificial Sequence
  sgRNA
cgaactcctcacaagttctc

SEQ ID NO: 22284 - DNA, 20 bp, Artificial Sequence
  sgRNA
ctcaggtagagattgataaa

SEQ ID NO: 22285 - DNA, 20 bp, Artificial Sequence
  sgRNA
gctcatgggaggagggtctc

SEQ ID NO: 22286 - DNA, 20 bp, Artificial Sequence
  sgRNA
ctatatgctggtggaactgg

SEQ ID NO: 22287 - DNA, 20 bp, Artificial Sequence
  sgRNA
gcgcggcctctgcaaagatg

SEQ ID NO: 22288 - DNA, 20 bp, Artificial Sequence
  sgRNA
tctgggtttctttagctctt

SEQ ID NO: 22289 - DNA, 20 bp, Artificial Sequence
  sgRNA
tggattcagcatgcgttcct

SEQ ID NO: 22290 - DNA, 20 bp, Artificial Sequence
  sgRNA
gctgggctgacaacccagag

SEQ ID NO: 22291 - DNA, 20 bp, Artificial Sequence
  sgRNA
gcacagctctgatgagctga

SEQ ID NO: 22292 - DNA, 20 bp, Artificial Sequence
  sgRNA
aagagcaggcattaggagtc

SEQ ID NO: 22293 - DNA, 20 bp, Artificial Sequence
  sgRNA
atgctgggctggtatagact

SEQ ID NO: 22294 - DNA, 20 bp, Artificial Sequence
  sgRNA
ccacctgagtcaaacagaac

SEQ ID NO: 22295 - DNA, 20 bp, Artificial Sequence
  sgRNA
ctcggcgctcgctggagcct

SEQ ID NO: 22296 - DNA, 20 bp, Artificial Sequence
  sgRNA
ccctgtcccgggagggaggg

SEQ ID NO: 22297 - DNA, 20 bp, Artificial Sequence
  sgRNA
cgccgcctcccgcccgcgct

SEQ ID NO: 22298 - DNA, 20 bp, Artificial Sequence
  sgRNA
gcgcctgagcgtctaccgac

SEQ ID NO: 22299 - DNA, 20 bp, Artificial Sequence
  sgRNA
tcggctccgctcgtaggccc

SEQ ID NO: 22300 - DNA, 20 bp, Artificial Sequence
  sgRNA
tacctggacgcggcgctctc

SEQ ID NO: 22301 - DNA, 20 bp, Artificial Sequence
  sgRNA
ttcttcattaacgattgaca

SEQ ID NO: 22302 - DNA, 20 bp, Artificial Sequence
  sgRNA
tgaggaataactccatcaga

SEQ ID NO: 22303 - DNA, 20 bp, Artificial Sequence
  sgRNA
gccctgtaagcgcatctgtg

SEQ ID NO: 22304 - DNA, 20 bp, Artificial Sequence
  sgRNA
catcgcagtgtctgtggcct

SEQ ID NO: 22305 - DNA, 20 bp, Artificial Sequence
  sgRNA
ccatagccacctcttaagcc

SEQ ID NO: 22306 - DNA, 20 bp, Artificial Sequence
  sgRNA
gcacatccgctgccaccagg

SEQ ID NO: 22307 - DNA, 20 bp, Artificial Sequence
  sgRNA
gggcggccacacgcactccc

SEQ ID NO: 22308 - DNA, 20 bp, Artificial Sequence
  sgRNA
gcccggcacacacagggccg

SEQ ID NO: 22309 - DNA, 20 bp, Artificial Sequence
  sgRNA
gtgtccgcggcgctgcggcg

SEQ ID NO: 22310 - DNA, 20 bp, Artificial Sequence
  sgRNA
aaggcatcagggttcttaag

SEQ ID NO: 22311 - DNA, 20 bp, Artificial Sequence
  sgRNA
caggcttaggtcgagaggaa

SEQ ID NO: 22312 - DNA, 20 bp, Artificial Sequence
  sgRNA
aaccaagagtgcgtaagtcc

SEQ ID NO: 22313 - DNA, 20 bp, Artificial Sequence
  sgRNA
ctcgctgacatcctcaaacc

SEQ ID NO: 22314 - DNA, 20 bp, Artificial Sequence
  sgRNA
gtagttcagcctgtcaatca

SEQ ID NO: 22315 - DNA, 20 bp, Artificial Sequence
  sgRNA
caatcagcgcccgcggccta

SEQ ID NO: 22316 - DNA, 20 bp, Artificial Sequence
  sgRNA
gcgtcccaggcctccctgcc

SEQ ID NO: 22317 - DNA, 20 bp, Artificial Sequence
  sgRNA
gacgagagtgatggacaagc

SEQ ID NO: 22318 - DNA, 20 bp, Artificial Sequence
  sgRNA
aggctgcgcggtgcctacgt

SEQ ID NO: 22319 - DNA, 20 bp, Artificial Sequence
  sgRNA
cacagttgcccattgtttgt

SEQ ID NO: 22320 - DNA, 20 bp, Artificial Sequence
  sgRNA
tagatggaaacttaaccaat

SEQ ID NO: 22321 - DNA, 20 bp, Artificial Sequence
  sgRNA
ttcagaagctgagtggcgcg

SEQ ID NO: 22322 - DNA, 20 bp, Artificial Sequence
  sgRNA
ggtggtggtggtagcggtgg

SEQ ID NO: 22323 - DNA, 20 bp, Artificial Sequence
  sgRNA
ccctcctcagacgccggccc

SEQ ID NO: 22324 - DNA, 20 bp, Artificial Sequence
  sgRNA
cgccgccgaggaggaggagg

SEQ ID NO: 22325 - DNA, 20 bp, Artificial Sequence
  sgRNA
ggcgcgcctctgagtgttgc

SEQ ID NO: 22326 - DNA, 20 bp, Artificial Sequence
  sgRNA
gggctgggctggccgtaaca

SEQ ID NO: 22327 - DNA, 20 bp, Artificial Sequence
  sgRNA
gggccgctcactggttacct

SEQ ID NO: 22328 - DNA, 20 bp, Artificial Sequence
  sgRNA
cgggctcctggtgtcgagcg

SEQ ID NO: 22329 - DNA, 20 bp, Artificial Sequence
  sgRNA
ccagggcccgcccacccttt

SEQ ID NO: 22330 - DNA, 20 bp, Artificial Sequence
  sgRNA
ggactggaattcgttattcc

SEQ ID NO: 22331 - DNA, 20 bp, Artificial Sequence
  sgRNA
gtctggtctgggagctctcc

SEQ ID NO: 22332 - DNA, 20 bp, Artificial Sequence
  sgRNA
ctcattagcatctcaattaa

SEQ ID NO: 22333 - DNA, 20 bp, Artificial Sequence
  sgRNA
cagagaccgcccgtcggcca

SEQ ID NO: 22334 - DNA, 20 bp, Artificial Sequence
  sgRNA
gcttaggagaagccaatcac

SEQ ID NO: 22335 - DNA, 20 bp, Artificial Sequence
  sgRNA
tttaccctcagcgtcagagc

SEQ ID NO: 22336 - DNA, 20 bp, Artificial Sequence
  sgRNA
tctaagtctggtcccacaac

SEQ ID NO: 22337 - DNA, 20 bp, Artificial Sequence
  sgRNA
gaggagggcgagcgatgacg

SEQ ID NO: 22338 - DNA, 20 bp, Artificial Sequence
  sgRNA
actgctttctgaccagtggg

SEQ ID NO: 22339 - DNA, 20 bp, Artificial Sequence
  sgRNA
ttgcctgtgcgtacagaagg

SEQ ID NO: 22340 - DNA, 20 bp, Artificial Sequence
  sgRNA
cagagtttgcaaagtcgccg

SEQ ID NO: 22341 - DNA, 20 bp, Artificial Sequence
  sgRNA
cacaggaagtggtgacttgt

SEQ ID NO: 22342 - DNA, 20 bp, Artificial Sequence
  sgRNA
cccgctcaactcacaagagg

SEQ ID NO: 22343 - DNA, 20 bp, Artificial Sequence
  sgRNA
ctgctgtccgtctgatccct

SEQ ID NO: 22344 - DNA, 20 bp, Artificial Sequence
  sgRNA
actgtcttcggttcttctac

SEQ ID NO: 22345 - DNA, 20 bp, Artificial Sequence
  sgRNA
gcaccacccgtagcgcttgg

SEQ ID NO: 22346 - DNA, 20 bp, Artificial Sequence
  sgRNA
ccgacctatcgcgatagtgg

SEQ ID NO: 22347 - DNA, 20 bp, Artificial Sequence
  sgRNA
gctcgacgctggccctttaa

SEQ ID NO: 22348 - DNA, 20 bp, Artificial Sequence
  sgRNA
tggctcgcctctcctttaat

SEQ ID NO: 22349 - DNA, 20 bp, Artificial Sequence
  sgRNA
cggcgtctgaggaggagcta

SEQ ID NO: 22350 - DNA, 20 bp, Artificial Sequence
  sgRNA
ttgtaatttgtctcgaaact

SEQ ID NO: 22351 - DNA, 20 bp, Artificial Sequence
  sgRNA
ggagctacgggtcttagctt

SEQ ID NO: 22352 - DNA, 20 bp, Artificial Sequence
  sgRNA
ctctgcgcgggatgacgccc

SEQ ID NO: 22353 - DNA, 20 bp, Artificial Sequence
  sgRNA
cccagttatccaaggaaacc

SEQ ID NO: 22354 - DNA, 20 bp, Artificial Sequence
  sgRNA
agtactttatatttagccac

SEQ ID NO: 22355 - DNA, 20 bp, Artificial Sequence
  sgRNA
tgcgcgagacacaggtcctg

SEQ ID NO: 22356 - DNA, 20 bp, Artificial Sequence
  sgRNA
atgcgccgtgcaattggcgc

SEQ ID NO: 22357 - DNA, 20 bp, Artificial Sequence
  sgRNA
ccgattcgcttcgaaacttg

SEQ ID NO: 22358 - DNA, 20 bp, Artificial Sequence
  sgRNA
ctgcgggacacctccttgtc

SEQ ID NO: 22359 - DNA, 20 bp, Artificial Sequence
  sgRNA
ttgacgtcaactccgtgcct

SEQ ID NO: 22360 - DNA, 20 bp, Artificial Sequence
  sgRNA
cgtggtgagggcccaaagcg

SEQ ID NO: 22361 - DNA, 20 bp, Artificial Sequence
  sgRNA
gtttatggcagacccgcctt

SEQ ID NO: 22362 - DNA, 20 bp, Artificial Sequence
  sgRNA
cgactcacgggccgcggcgg

SEQ ID NO: 22363 - DNA, 20 bp, Artificial Sequence
  sgRNA
gctcggtcacacgtggaccg

SEQ ID NO: 22364 - DNA, 20 bp, Artificial Sequence
  sgRNA
ttgaagcccagggagctgca

SEQ ID NO: 22365 - DNA, 20 bp, Artificial Sequence
  sgRNA
gcctgttggacagccgtgga

SEQ ID NO: 22366 - DNA, 20 bp, Artificial Sequence
  sgRNA
actcacaacactcacagcgc

SEQ ID NO: 22367 - DNA, 20 bp, Artificial Sequence
  sgRNA
ctagcggagcttataaagat

SEQ ID NO: 22368 - DNA, 20 bp, Artificial Sequence
  sgRNA
gggcggaaggcgagtcgtgg

SEQ ID NO: 22369 - DNA, 20 bp, Artificial Sequence
  sgRNA
tttcagagagcgctgggagc

SEQ ID NO: 22370 - DNA, 20 bp, Artificial Sequence
  sgRNA
tcctgggcccttgctgtaaa

SEQ ID NO: 22371 - DNA, 20 bp, Artificial Sequence
  sgRNA
ttgcaattattcagagtagg

SEQ ID NO: 22372 - DNA, 20 bp, Artificial Sequence
  sgRNA
tgtgggcggtgactcgccgt

SEQ ID NO: 22373 - DNA, 20 bp, Artificial Sequence
  sgRNA
cacaccagtcattagccctg

SEQ ID NO: 22374 - DNA, 20 bp, Artificial Sequence
  sgRNA
tgcgtgtgcgacgctaatgt

SEQ ID NO: 22375 - DNA, 20 bp, Artificial Sequence
  sgRNA
gttgatgtggtacttacagt

SEQ ID NO: 22376 - DNA, 20 bp, Artificial Sequence
  sgRNA
ggctggaggcctgtcgggtg

SEQ ID NO: 22377 - DNA, 20 bp, Artificial Sequence
  sgRNA
gagaccctagacagctggcc

SEQ ID NO: 22378 - DNA, 20 bp, Artificial Sequence
  sgRNA
ctctgacccagtccatgctc

SEQ ID NO: 22379 - DNA, 20 bp, Artificial Sequence
  sgRNA
gggacccagccctgtgtgga

SEQ ID NO: 22380 - DNA, 20 bp, Artificial Sequence
  sgRNA
tataaatgtctttggacttc

SEQ ID NO: 22381 - DNA, 20 bp, Artificial Sequence
  sgRNA
gagaggtgatcacatgaagc

SEQ ID NO: 22382 - DNA, 20 bp, Artificial Sequence
  sgRNA
attccgtcctttcttgatat

SEQ ID NO: 22383 - DNA, 20 bp, Artificial Sequence
  sgRNA
tgacgcttactgcgcagggc

SEQ ID NO: 22384 - DNA, 20 bp, Artificial Sequence
  sgRNA
gccacacaggttctgctggg

SEQ ID NO: 22385 - DNA, 20 bp, Artificial Sequence
  sgRNA
acttcgccggctccctgaga

SEQ ID NO: 22386 - DNA, 20 bp, Artificial Sequence
  sgRNA
gctgcaaatacctgctgctc

SEQ ID NO: 22387 - DNA, 20 bp, Artificial Sequence
  sgRNA
ttgcaactgcgcagaccaga

SEQ ID NO: 22388 - DNA, 20 bp, Artificial Sequence
  sgRNA
ggaggcttgcaaagtattgt

SEQ ID NO: 22389 - DNA, 20 bp, Artificial Sequence
  sgRNA
ggcgctccaggattggtcga

SEQ ID NO: 22390 - DNA, 20 bp, Artificial Sequence
  sgRNA
gcgttgtcgcgcgtgattag

SEQ ID NO: 22391 - DNA, 20 bp, Artificial Sequence
  sgRNA
catagctgcactctagactt

SEQ ID NO: 22392 - DNA, 20 bp, Artificial Sequence
  sgRNA
gggcctggtaggacagctga

SEQ ID NO: 22393 - DNA, 20 bp, Artificial Sequence
  sgRNA
ccagaggctctgcactattt

SEQ ID NO: 22394 - DNA, 20 bp, Artificial Sequence
  sgRNA
taagacaatggctgtgtgtc

SEQ ID NO: 22395 - DNA, 20 bp, Artificial Sequence
  sgRNA
tgcatagttccagagctcag

SEQ ID NO: 22396 - DNA, 20 bp, Artificial Sequence
  sgRNA
tgaatcgatataaagaggag

SEQ ID NO: 22397 - DNA, 20 bp, Artificial Sequence
  sgRNA
caattgggaaggtggagtgc

SEQ ID NO: 22398 - DNA, 20 bp, Artificial Sequence
  sgRNA
ggctgtggcttgtgttataa

SEQ ID NO: 22399 - DNA, 20 bp, Artificial Sequence
  sgRNA
cttgtttactcgtcttctaa

SEQ ID NO: 22400 - DNA, 20 bp, Artificial Sequence
  sgRNA
agaacgcgcgccgccattgg

SEQ ID NO: 22401 - DNA, 20 bp, Artificial Sequence
  sgRNA
gtttgcgacatagtcatttc

SEQ ID NO: 22402 - DNA, 20 bp, Artificial Sequence
  sgRNA
gtgtcagagcgctccctgga

SEQ ID NO: 22403 - DNA, 20 bp, Artificial Sequence
  sgRNA
ggaagtgtccgcagttcgcc

SEQ ID NO: 22404 - DNA, 20 bp, Artificial Sequence
  sgRNA
acgcctagacaccgacttaa

SEQ ID NO: 22405 - DNA, 20 bp, Artificial Sequence
  sgRNA
tggcggacatcacctgttcg

SEQ ID NO: 22406 - DNA, 20 bp, Artificial Sequence
  sgRNA
gggcgccggccagctgggct

SEQ ID NO: 22407 - DNA, 20 bp, Artificial Sequence
  sgRNA
ctataagagggcggcggtcg

SEQ ID NO: 22408 - DNA, 20 bp, Artificial Sequence
  sgRNA
cgggcgcgcagctcggattt

SEQ ID NO: 22409 - DNA, 20 bp, Artificial Sequence
  sgRNA
gctgaacttgctttgcaact

SEQ ID NO: 22410 - DNA, 20 bp, Artificial Sequence
  sgRNA
ccctaataggcatggagaat

SEQ ID NO: 22411 - DNA, 20 bp, Artificial Sequence
  sgRNA
agcgctacgcgggccggacc

SEQ ID NO: 22412 - DNA, 20 bp, Artificial Sequence
  sgRNA
ttacccaaatgtttgaaaga

SEQ ID NO: 22413 - DNA, 20 bp, Artificial Sequence
  sgRNA
tgcaggctgccactagctca

SEQ ID NO: 22414 - DNA, 20 bp, Artificial Sequence
  sgRNA
gtttactttcactgcccatc

SEQ ID NO: 22415 - DNA, 20 bp, Artificial Sequence
  sgRNA
gggaacagctcatctttcaa

SEQ ID NO: 22416 - DNA, 20 bp, Artificial Sequence
  sgRNA
gttcttagcggtggtgcttt

SEQ ID NO: 22417 - DNA, 20 bp, Artificial Sequence
  sgRNA
cggtgatgtcatcactctcc

SEQ ID NO: 22418 - DNA, 20 bp, Artificial Sequence
  sgRNA
aactaggacctctcgacgct

SEQ ID NO: 22419 - DNA, 20 bp, Artificial Sequence
  sgRNA
cgctgaacttccgtcattga

SEQ ID NO: 22420 - DNA, 20 bp, Artificial Sequence
  sgRNA
gcactcgacactattacctg

SEQ ID NO: 22421 - DNA, 20 bp, Artificial Sequence
  sgRNA
gctcagaaatgtcatctctt

SEQ ID NO: 22422 - DNA, 20 bp, Artificial Sequence
  sgRNA
ggaaattggagctaaattca

SEQ ID NO: 22423 - DNA, 20 bp, Artificial Sequence
  sgRNA
agcctccgtcccggttgctg

SEQ ID NO: 22424 - DNA, 20 bp, Artificial Sequence
  sgRNA
cgggcgggactgcagctgcg

SEQ ID NO: 22425 - DNA, 20 bp, Artificial Sequence
  sgRNA
tggcggcgcgggctggatcc

SEQ ID NO: 22426 - DNA, 20 bp, Artificial Sequence
  sgRNA
gttcctgagacctgagcgct

SEQ ID NO: 22427 - DNA, 20 bp, Artificial Sequence
  sgRNA
ggagacgcggtgacacggcg

SEQ ID NO: 22428 - DNA, 20 bp, Artificial Sequence
  sgRNA
gcgtgatcacacgcttagcc

SEQ ID NO: 22429 - DNA, 20 bp, Artificial Sequence
  sgRNA
gaaacactacggcggcgttc

SEQ ID NO: 22430 - DNA, 20 bp, Artificial Sequence
  sgRNA
caggacccttcaggaacggg

SEQ ID NO: 22431 - DNA, 20 bp, Artificial Sequence
  sgRNA
cttcagctctttcatacaag

SEQ ID NO: 22432 - DNA, 20 bp, Artificial Sequence
  sgRNA
aaattcataggcaccagcct

SEQ ID NO: 22433 - DNA, 20 bp, Artificial Sequence
  sgRNA
gaagagtgtctgtttaaggg

SEQ ID NO: 22434 - DNA, 20 bp, Artificial Sequence
  sgRNA
tggaagaatcgctcactcgg

SEQ ID NO: 22435 - DNA, 20 bp, Artificial Sequence
  sgRNA
taaatggaaagagactccca

SEQ ID NO: 22436 - DNA, 20 bp, Artificial Sequence
  sgRNA
cccgctctgtgcttagagta

SEQ ID NO: 22437 - DNA, 20 bp, Artificial Sequence
  sgRNA
gaagtggccacagcatctga

SEQ ID NO: 22438 - DNA, 20 bp, Artificial Sequence
  sgRNA
ttccatgactatgccaatat

SEQ ID NO: 22439 - DNA, 20 bp, Artificial Sequence
  sgRNA
ctcaatagggtgggaagtgg

SEQ ID NO: 22440 - DNA, 20 bp, Artificial Sequence
  sgRNA
aggttgaacttatatagaac

SEQ ID NO: 22441 - DNA, 20 bp, Artificial Sequence
  sgRNA
gcccgctagctgcgcgcgcc

SEQ ID NO: 22442 - DNA, 20 bp, Artificial Sequence
  sgRNA
tggcggtcgctcactctggc

SEQ ID NO: 22443 - DNA, 20 bp, Artificial Sequence
  sgRNA
gggagtccggcgccgcctct

SEQ ID NO: 22444 - DNA, 20 bp, Artificial Sequence
  sgRNA
aattaactctacgaagagct

SEQ ID NO: 22445 - DNA, 20 bp, Artificial Sequence
  sgRNA
gacggcgaagcccgcacacc

SEQ ID NO: 22446 - DNA, 20 bp, Artificial Sequence
  sgRNA
gcgtttccgcggcggacgcc

SEQ ID NO: 22447 - DNA, 20 bp, Artificial Sequence
  sgRNA
cagctcagtctaaggactgc

SEQ ID NO: 22448 - DNA, 20 bp, Artificial Sequence
  sgRNA
tagtagtgacgctttgacta

SEQ ID NO: 22449 - DNA, 20 bp, Artificial Sequence
  sgRNA
cgttaagactccgttatatc

SEQ ID NO: 22450 - DNA, 20 bp, Artificial Sequence
  sgRNA
ggaaatcctgtcactcagcc

SEQ ID NO: 22451 - DNA, 20 bp, Artificial Sequence
  sgRNA
tttcctttccctggttagga

SEQ ID NO: 22452 - DNA, 20 bp, Artificial Sequence
  sgRNA
tctgagctgtatataagtcc

SEQ ID NO: 22453 - DNA, 20 bp, Artificial Sequence
  sgRNA
ggctgcagagatggccaaag

SEQ ID NO: 22454 - DNA, 20 bp, Artificial Sequence
  sgRNA
aggtcgagccgggcggagag

SEQ ID NO: 22455 - DNA, 20 bp, Artificial Sequence
  sgRNA
gcggcgctcttcgcctttcg

SEQ ID NO: 22456 - DNA, 20 bp, Artificial Sequence
  sgRNA
tttcccgacgtgcttcgaga

SEQ ID NO: 22457 - DNA, 20 bp, Artificial Sequence
  sgRNA
gtcccagctctccgatgaca

SEQ ID NO: 22458 - DNA, 20 bp, Artificial Sequence
  sgRNA
ggcctctctggaagttgtcc

SEQ ID NO: 22459 - DNA, 20 bp, Artificial Sequence
  sgRNA
tggtggagcgtcacgtcgcc

SEQ ID NO: 22460 - DNA, 20 bp, Artificial Sequence
  sgRNA
ctgaaaggcgcaccctgccc

SEQ ID NO: 22461 - DNA, 20 bp, Artificial Sequence
  sgRNA
gttagagactccctctgccc

SEQ ID NO: 22462 - DNA, 20 bp, Artificial Sequence
  sgRNA
tgcactgccctctagcggcg

SEQ ID NO: 22463 - DNA, 20 bp, Artificial Sequence
  sgRNA
gagactccgcccaagtagtg

SEQ ID NO: 22464 - DNA, 20 bp, Artificial Sequence
  sgRNA
gctcgctgactgagaggacg

SEQ ID NO: 22465 - DNA, 20 bp, Artificial Sequence
  sgRNA
cggtgctcagttccggtcct

SEQ ID NO: 22466 - DNA, 20 bp, Artificial Sequence
  sgRNA
gtcttatttcggttcggtgg

SEQ ID NO: 22467 - DNA, 20 bp, Artificial Sequence
  sgRNA
catttaataaggaacctcct

SEQ ID NO: 22468 - DNA, 20 bp, Artificial Sequence
  sgRNA
gtgacttagttctgttcttg

SEQ ID NO: 22469 - DNA, 20 bp, Artificial Sequence
  sgRNA
ggtatgagtcagtacttcct

SEQ ID NO: 22470 - DNA, 20 bp, Artificial Sequence
  sgRNA
agtgaatactcctgagacag

SEQ ID NO: 22471 - DNA, 20 bp, Artificial Sequence
  sgRNA
ggaagggctccaagcggaac

SEQ ID NO: 22472 - DNA, 20 bp, Artificial Sequence
  sgRNA
gggcatacgtaatttatgac

SEQ ID NO: 22473 - DNA, 20 bp, Artificial Sequence
  sgRNA
ggagcgcgctgtggactccg

SEQ ID NO: 22474 - DNA, 20 bp, Artificial Sequence
  sgRNA
ggaggagcgagcggactggt

SEQ ID NO: 22475 - DNA, 20 bp, Artificial Sequence
  sgRNA
agaccgccgaggtttggtgc

SEQ ID NO: 22476 - DNA, 20 bp, Artificial Sequence
  sgRNA
gtttgaaggctactgctgtc

SEQ ID NO: 22477 - DNA, 20 bp, Artificial Sequence
  sgRNA
agagttggactaatctaggg

SEQ ID NO: 22478 - DNA, 20 bp, Artificial Sequence
  sgRNA
tcttcagttaggaacagtcc

SEQ ID NO: 22479 - DNA, 20 bp, Artificial Sequence
  sgRNA
gggctctgaaagactaagaa

SEQ ID NO: 22480 - DNA, 20 bp, Artificial Sequence
  sgRNA
gatccgcccaccaaagtcac

SEQ ID NO: 22481 - DNA, 20 bp, Artificial Sequence
  sgRNA
gtctcgggactgaaagctac

SEQ ID NO: 22482 - DNA, 20 bp, Artificial Sequence
  sgRNA
gtggttgctaaccgcttagg

SEQ ID NO: 22483 - DNA, 20 bp, Artificial Sequence
  sgRNA
cttggagtcgagatcggtgg

SEQ ID NO: 22484 - DNA, 20 bp, Artificial Sequence
  sgRNA
ctttgtttcttctctcaact

SEQ ID NO: 22485 - DNA, 20 bp, Artificial Sequence
  sgRNA
tccagaaccttgtgcacgct

SEQ ID NO: 22486 - DNA, 20 bp, Artificial Sequence
  sgRNA
agggagtcgcggcgcgcgcg

SEQ ID NO: 22487 - DNA, 20 bp, Artificial Sequence
  sgRNA
gcacccgacgagccacgcgg

SEQ ID NO: 22488 - DNA, 20 bp, Artificial Sequence
  sgRNA
aggcggaagcaacagggcgg

SEQ ID NO: 22489 - DNA, 20 bp, Artificial Sequence
  sgRNA
gagagcagcagcactgattt

SEQ ID NO: 22490 - DNA, 20 bp, Artificial Sequence
  sgRNA
cagcgcttcggaaatcctgc

SEQ ID NO: 22491 - DNA, 20 bp, Artificial Sequence
  sgRNA
ccctggcttgtaaggcagga

SEQ ID NO: 22492 - DNA, 20 bp, Artificial Sequence
  sgRNA
cgagggtagcggccttgcct

SEQ ID NO: 22493 - DNA, 20 bp, Artificial Sequence
  sgRNA
cactttcgctacaaggactg

SEQ ID NO: 22494 - DNA, 20 bp, Artificial Sequence
  sgRNA
ggtgtttggtgcgcgcgccg

SEQ ID NO: 22495 - DNA, 20 bp, Artificial Sequence
  sgRNA
gaaacaagatccctctaagt

SEQ ID NO: 22496 - DNA, 20 bp, Artificial Sequence
  sgRNA
gaggctcttcaaagtcactc

SEQ ID NO: 22497 - DNA, 20 bp, Artificial Sequence
  sgRNA
agccaaagttcagactctga

SEQ ID NO: 22498 - DNA, 20 bp, Artificial Sequence
  sgRNA
ggacgctgaaagcgtctcca

SEQ ID NO: 22499 - DNA, 20 bp, Artificial Sequence
  sgRNA
gctccaagactcttcaagtg

SEQ ID NO: 22500 - DNA, 20 bp, Artificial Sequence
  sgRNA
agagtgggcctgttagtgag

SEQ ID NO: 22501 - DNA, 20 bp, Artificial Sequence
  sgRNA
ggatggaggccgggcaagct

SEQ ID NO: 22502 - DNA, 20 bp, Artificial Sequence
  sgRNA
caactcaggccgcccgcgga

SEQ ID NO: 22503 - DNA, 20 bp, Artificial Sequence
  sgRNA
gaagtggcacgtggaggcgc

SEQ ID NO: 22504 - DNA, 20 bp, Artificial Sequence
  sgRNA
gcaaagtcgctgtatttatc

SEQ ID NO: 22505 - DNA, 20 bp, Artificial Sequence
  sgRNA
ttctataagccctgctactc

SEQ ID NO: 22506 - DNA, 20 bp, Artificial Sequence
  sgRNA
actgtttagtcagaagtaac

SEQ ID NO: 22507 - DNA, 20 bp, Artificial Sequence
  sgRNA
gtccggaggacgtcacactg

SEQ ID NO: 22508 - DNA, 20 bp, Artificial Sequence
  sgRNA
tcctatgaccgtaaacgcca

SEQ ID NO: 22509 - DNA, 20 bp, Artificial Sequence
  sgRNA
gtggagcaagaacgaaaggc

SEQ ID NO: 22510 - DNA, 20 bp, Artificial Sequence
  sgRNA
cctgggtggacctgtaggag

SEQ ID NO: 22511 - DNA, 20 bp, Artificial Sequence
  sgRNA
tttatttcctgagagaagac

SEQ ID NO: 22512 - DNA, 20 bp, Artificial Sequence
  sgRNA
ggagtcccagccaatcttgc

SEQ ID NO: 22513 - DNA, 20 bp, Artificial Sequence
  sgRNA
atccagagaagataacgtta

SEQ ID NO: 22514 - DNA, 20 bp, Artificial Sequence
  sgRNA
cagatcttcagcggcctttg

SEQ ID NO: 22515 - DNA, 20 bp, Artificial Sequence
  sgRNA
cgggtgcttcgtgccaaatg

SEQ ID NO: 22516 - DNA, 20 bp, Artificial Sequence
  sgRNA
aacatggagagagtgttaga

SEQ ID NO: 22517 - DNA, 20 bp, Artificial Sequence
  sgRNA
gaaaggaaactgtgtttaaa

SEQ ID NO: 22518 - DNA, 20 bp, Artificial Sequence
  sgRNA
aacaatcacagatgaagtca

SEQ ID NO: 22519 - DNA, 20 bp, Artificial Sequence
  sgRNA
tctcttcctgccagcactgc

SEQ ID NO: 22520 - DNA, 20 bp, Artificial Sequence
  sgRNA
ctatatttaagacggttaca

SEQ ID NO: 22521 - DNA, 20 bp, Artificial Sequence
  sgRNA
ctgagacagtgcggtgacaa

SEQ ID NO: 22522 - DNA, 20 bp, Artificial Sequence
  sgRNA
gggacagccgtgcgaagcgg

SEQ ID NO: 22523 - DNA, 20 bp, Artificial Sequence
  sgRNA
gggtagggagaagtgctccc

SEQ ID NO: 22524 - DNA, 20 bp, Artificial Sequence
  sgRNA
ggcggtgctcgggatcctcg

SEQ ID NO: 22525 - DNA, 20 bp, Artificial Sequence
  sgRNA
cgcatggctggctttggccc

SEQ ID NO: 22526 - DNA, 20 bp, Artificial Sequence
  sgRNA
attgcgcgcgcgccgtgcgg

SEQ ID NO: 22527 - DNA, 20 bp, Artificial Sequence
  sgRNA
tttaagagtcaacgcggtgg

SEQ ID NO: 22528 - DNA, 20 bp, Artificial Sequence
  sgRNA
gtgtggcctagttcgctgat

SEQ ID NO: 22529 - DNA, 20 bp, Artificial Sequence
  sgRNA
taaattacctcgtgtgagca

SEQ ID NO: 22530 - DNA, 20 bp, Artificial Sequence
  sgRNA
ttcattggccagccgtcaca

SEQ ID NO: 22531 - DNA, 20 bp, Artificial Sequence
  sgRNA
tggctgagagatctacagcc

SEQ ID NO: 22532 - DNA, 20 bp, Artificial Sequence
  sgRNA
cacacactgaataggaatag

SEQ ID NO: 22533 - DNA, 20 bp, Artificial Sequence
  sgRNA
ggtgaagactcaggagctct

SEQ ID NO: 22534 - DNA, 20 bp, Artificial Sequence
  sgRNA
agaggaaaggacagagggag

SEQ ID NO: 22535 - DNA, 20 bp, Artificial Sequence
  sgRNA
ggaaaggaaggagagaggaa

SEQ ID NO: 22536 - DNA, 20 bp, Artificial Sequence
  sgRNA
agagggaagggagggaggaa

SEQ ID NO: 22537 - DNA, 20 bp, Artificial Sequence
  sgRNA
cgccacagcagcccatgaga

SEQ ID NO: 22538 - DNA, 20 bp, Artificial Sequence
  sgRNA
gggtggccgtactcagcacg

SEQ ID NO: 22539 - DNA, 20 bp, Artificial Sequence
  sgRNA
cagataccggcccattcgct

SEQ ID NO: 22540 - DNA, 20 bp, Artificial Sequence
  sgRNA
cccacgctgtcggaaccgcg

SEQ ID NO: 22541 - DNA, 20 bp, Artificial Sequence
  sgRNA
gcgcttggagaagttgcggg

SEQ ID NO: 22542 - DNA, 20 bp, Artificial Sequence
  sgRNA
ccggcgggcggcgtcacgag

SEQ ID NO: 22543 - DNA, 20 bp, Artificial Sequence
  sgRNA
gagccctaacccagatgcca

SEQ ID NO: 22544 - DNA, 20 bp, Artificial Sequence
  sgRNA
tgctgtttgctgtaacattc

SEQ ID NO: 22545 - DNA, 20 bp, Artificial Sequence
  sgRNA
gcagtgcaacattctcaaga

SEQ ID NO: 22546 - DNA, 20 bp, Artificial Sequence
  sgRNA
tggtaagctgtgggccttcc

SEQ ID NO: 22547 - DNA, 20 bp, Artificial Sequence
  sgRNA
ttggttaaattggcctctcc

SEQ ID NO: 22548 - DNA, 20 bp, Artificial Sequence
  sgRNA
tagaatgtggtacaggcgac

SEQ ID NO: 22549 - DNA, 20 bp, Artificial Sequence
  sgRNA
cttgagtgggttgggagtgg

SEQ ID NO: 22550 - DNA, 20 bp, Artificial Sequence
  sgRNA
gctcctcccacggcgttcgc

SEQ ID NO: 22551 - DNA, 20 bp, Artificial Sequence
  sgRNA
ctccggcgcaagccgcaaga

SEQ ID NO: 22552 - DNA, 20 bp, Artificial Sequence
  sgRNA
ccacccacagcacgcggcag

SEQ ID NO: 22553 - DNA, 20 bp, Artificial Sequence
  sgRNA
tgagagacggcttcagccaa

SEQ ID NO: 22554 - DNA, 20 bp, Artificial Sequence
  sgRNA
tgcgcccgcccaatagcgca

SEQ ID NO: 22555 - DNA, 20 bp, Artificial Sequence
  sgRNA
tgagcgggtgagtctcaaga

SEQ ID NO: 22556 - DNA, 20 bp, Artificial Sequence
  sgRNA
acgaaatccgtagttcctgt

SEQ ID NO: 22557 - DNA, 20 bp, Artificial Sequence
  sgRNA
cgccacacctctcgtctgag

SEQ ID NO: 22558 - DNA, 20 bp, Artificial Sequence
  sgRNA
cgctacaatcagcggatccg

SEQ ID NO: 22559 - DNA, 20 bp, Artificial Sequence
  sgRNA
tgagttctgaaggctgctct

SEQ ID NO: 22560 - DNA, 20 bp, Artificial Sequence
  sgRNA
gggaccaggcaggtttgaca

SEQ ID NO: 22561 - DNA, 20 bp, Artificial Sequence
  sgRNA
ggattggagctggatagcgg

SEQ ID NO: 22562 - DNA, 20 bp, Artificial Sequence
  sgRNA
ctaccgcggaggacggtccg

SEQ ID NO: 22563 - DNA, 20 bp, Artificial Sequence
  sgRNA
ggaaggacggcctgagggcg

SEQ ID NO: 22564 - DNA, 20 bp, Artificial Sequence
  sgRNA
ggccttcgcgtagctggcgg

SEQ ID NO: 22565 - DNA, 20 bp, Artificial Sequence
  sgRNA
ctgaagcagtctgattgcag

SEQ ID NO: 22566 - DNA, 20 bp, Artificial Sequence
  sgRNA
tgagaccagacgcctaagtg

SEQ ID NO: 22567 - DNA, 20 bp, Artificial Sequence
  sgRNA
ggaagtgtcccgggttcatg

SEQ ID NO: 22568 - DNA, 20 bp, Artificial Sequence
  sgRNA
aagggttggcctccgggacc

SEQ ID NO: 22569 - DNA, 20 bp, Artificial Sequence
  sgRNA
tcagcacgcatggtggacgt

SEQ ID NO: 22570 - DNA, 20 bp, Artificial Sequence
  sgRNA
ctcccacggagcaccgggcg

SEQ ID NO: 22571 - DNA, 20 bp, Artificial Sequence
  sgRNA
gattaattcagaagaaagtg

SEQ ID NO: 22572 - DNA, 20 bp, Artificial Sequence
  sgRNA
ctctgtgtttacttccagga

SEQ ID NO: 22573 - DNA, 20 bp, Artificial Sequence
  sgRNA
atcatatcacatgtccgtcc

SEQ ID NO: 22574 - DNA, 20 bp, Artificial Sequence
  sgRNA
actgttgcaggctgggctct

SEQ ID NO: 22575 - DNA, 20 bp, Artificial Sequence
  sgRNA
cgagccgaagaagccgcgtt

SEQ ID NO: 22576 - DNA, 20 bp, Artificial Sequence
  sgRNA
ccaccgcctttgaacgctgg

SEQ ID NO: 22577 - DNA, 20 bp, Artificial Sequence
  sgRNA
ctcttcagttaggagatcac

SEQ ID NO: 22578 - DNA, 20 bp, Artificial Sequence
  sgRNA
agtttaaatcatacttcagg

SEQ ID NO: 22579 - DNA, 20 bp, Artificial Sequence
  sgRNA
acacacacacagtttgcata

SEQ ID NO: 22580 - DNA, 20 bp, Artificial Sequence
  sgRNA
tagaaacctattgggctgtg

SEQ ID NO: 22581 - DNA, 20 bp, Artificial Sequence
  sgRNA
tctatagaaacaattcgcca

SEQ ID NO: 22582 - DNA, 20 bp, Artificial Sequence
  sgRNA
acagcagggaaggcaatgtc

SEQ ID NO: 22583 - DNA, 20 bp, Artificial Sequence
  sgRNA
atacttggattcatgattga

SEQ ID NO: 22584 - DNA, 20 bp, Artificial Sequence
  sgRNA
gcgtggtcgcatgggcaccc

SEQ ID NO: 22585 - DNA, 20 bp, Artificial Sequence
  sgRNA
atcaagagttgactgaagac

SEQ ID NO: 22586 - DNA, 20 bp, Artificial Sequence
  sgRNA
catcagatcccaacaccctc

SEQ ID NO: 22587 - DNA, 20 bp, Artificial Sequence
  sgRNA
aggcggctcgcgtcactgtc

SEQ ID NO: 22588 - DNA, 20 bp, Artificial Sequence
  sgRNA
tggcgaccttaggatgcgac

SEQ ID NO: 22589 - DNA, 20 bp, Artificial Sequence
  sgRNA
aatatactgactgacacttc

SEQ ID NO: 22590 - DNA, 20 bp, Artificial Sequence
  sgRNA
cgcggaccaatggaatgaat

SEQ ID NO: 22591 - DNA, 20 bp, Artificial Sequence
  sgRNA
cagacacccaatgagtgatc

SEQ ID NO: 22592 - DNA, 20 bp, Artificial Sequence
  sgRNA
tgacagaggttgaggctctt

SEQ ID NO: 22593 - DNA, 20 bp, Artificial Sequence
  sgRNA
ggccggaagtgcgccctctg

SEQ ID NO: 22594 - DNA, 20 bp, Artificial Sequence
  sgRNA
ttctaagagtctttgtactc

SEQ ID NO: 22595 - DNA, 20 bp, Artificial Sequence
  sgRNA
ggaccgagcgatccgccgag

SEQ ID NO: 22596 - DNA, 20 bp, Artificial Sequence
  sgRNA
atgaataatgtgagcgttgg

SEQ ID NO: 22597 - DNA, 20 bp, Artificial Sequence
  sgRNA
agcgataggccgtaatatcg

SEQ ID NO: 22598 - DNA, 20 bp, Artificial Sequence
  sgRNA
gcaacaggagtacaaccaga

SEQ ID NO: 22599 - DNA, 20 bp, Artificial Sequence
  sgRNA
agccactatttaactgccgg

SEQ ID NO: 22600 - DNA, 20 bp, Artificial Sequence
  sgRNA
atagggtgcgcgtgcacgag

SEQ ID NO: 22601 - DNA, 20 bp, Artificial Sequence
  sgRNA
ggcgcccggccctagtttcc

SEQ ID NO: 22602 - DNA, 20 bp, Artificial Sequence
  sgRNA
acaggacagagtgaggtctg

SEQ ID NO: 22603 - DNA, 20 bp, Artificial Sequence
  sgRNA
cctgctgggagttggccgtt

SEQ ID NO: 22604 - DNA, 20 bp, Artificial Sequence
  sgRNA
accaacttcccttgccagtg

SEQ ID NO: 22605 - DNA, 20 bp, Artificial Sequence
  sgRNA
ttctctcactgctgcagctg

SEQ ID NO: 22606 - DNA, 20 bp, Artificial Sequence
  sgRNA
agatgctccagtgggttgcc

SEQ ID NO: 22607 - DNA, 20 bp, Artificial Sequence
  sgRNA
ggtttccatggtgctcattg

SEQ ID NO: 22608 - DNA, 20 bp, Artificial Sequence
  sgRNA
agtcccacgtgaagccgcgg

SEQ ID NO: 22609 - DNA, 20 bp, Artificial Sequence
  sgRNA
ggagcggccactcataaatt

SEQ ID NO: 22610 - DNA, 20 bp, Artificial Sequence
  sgRNA
atactaacagattctctcca

SEQ ID NO: 22611 - DNA, 20 bp, Artificial Sequence
  sgRNA
acagaagccctccctgtggg

SEQ ID NO: 22612 - DNA, 20 bp, Artificial Sequence
  sgRNA
aggagtaggaggagatatca

SEQ ID NO: 22613 - DNA, 20 bp, Artificial Sequence
  sgRNA
cacaaggttgctggaaggtc

SEQ ID NO: 22614 - DNA, 20 bp, Artificial Sequence
  sgRNA
tagggagtggcgcgagtcca

SEQ ID NO: 22615 - DNA, 20 bp, Artificial Sequence
  sgRNA
agcagccactgggcctcctg

SEQ ID NO: 22616 - DNA, 20 bp, Artificial Sequence
  sgRNA
tacagaatcacagagagatg

SEQ ID NO: 22617 - DNA, 20 bp, Artificial Sequence
  sgRNA
agctcactaagttacaaata

SEQ ID NO: 22618 - DNA, 20 bp, Artificial Sequence
  sgRNA
taactaagggctgctgagtg

SEQ ID NO: 22619 - DNA, 20 bp, Artificial Sequence
  sgRNA
tatggatgtttgtcatgcca

SEQ ID NO: 22620 - DNA, 20 bp, Artificial Sequence
  sgRNA
tatgattaaccacgaagcca

SEQ ID NO: 22621 - DNA, 20 bp, Artificial Sequence
  sgRNA
tcttgatcatttcttccaaa

SEQ ID NO: 22622 - DNA, 20 bp, Artificial Sequence
  sgRNA
agaatttcctctcttgcaca

SEQ ID NO: 22623 - DNA, 20 bp, Artificial Sequence
  sgRNA
atgatagtgagtatgtgtgt

SEQ ID NO: 22624 - DNA, 20 bp, Artificial Sequence
  sgRNA
cgcgcctgcggtcagtaccg

SEQ ID NO: 22625 - DNA, 20 bp, Artificial Sequence
  sgRNA
tttctcggttcgggctctgt

SEQ ID NO: 22626 - DNA, 20 bp, Artificial Sequence
  sgRNA
tgctcgctcactgaagactc

SEQ ID NO: 22627 - DNA, 20 bp, Artificial Sequence
  sgRNA
gtttagctgcctagaaacag

SEQ ID NO: 22628 - DNA, 20 bp, Artificial Sequence
  sgRNA
ctagctctagttgtgttgct

SEQ ID NO: 22629 - DNA, 20 bp, Artificial Sequence
  sgRNA
tagacccggaatctgaaccc

SEQ ID NO: 22630 - DNA, 20 bp, Artificial Sequence
  sgRNA
tggttaaggaagtaacatga

SEQ ID NO: 22631 - DNA, 20 bp, Artificial Sequence
  sgRNA
ggacaggcaccaattcacac

SEQ ID NO: 22632 - DNA, 20 bp, Artificial Sequence
  sgRNA
aagcaacccgcagtgccttg

SEQ ID NO: 22633 - DNA, 20 bp, Artificial Sequence
  sgRNA
gggcgtagactgggcgggtg

SEQ ID NO: 22634 - DNA, 20 bp, Artificial Sequence
  sgRNA
cttcattgttagacttcaca

SEQ ID NO: 22635 - DNA, 20 bp, Artificial Sequence
  sgRNA
gcaagcgctccttgtagcgt

SEQ ID NO: 22636 - DNA, 20 bp, Artificial Sequence
  sgRNA
tatagggttgagtctcaaga

SEQ ID NO: 22637 - DNA, 20 bp, Artificial Sequence
  sgRNA
gctgcctcagtgctgacttg

SEQ ID NO: 22638 - DNA, 20 bp, Artificial Sequence
  sgRNA
cctgaggttaaccaagcaga

SEQ ID NO: 22639 - DNA, 20 bp, Artificial Sequence
  sgRNA
ggtcggagaggccagccgtg

SEQ ID NO: 22640 - DNA, 20 bp, Artificial Sequence
  sgRNA
tggacaacttgaacaatttc

SEQ ID NO: 22641 - DNA, 20 bp, Artificial Sequence
  sgRNA
tttgttcttcagattgggag

SEQ ID NO: 22642 - DNA, 20 bp, Artificial Sequence
  sgRNA
tgccattggtcgcatggccc

SEQ ID NO: 22643 - DNA, 20 bp, Artificial Sequence
  sgRNA
atatctggaggtagctgctc

SEQ ID NO: 22644 - DNA, 20 bp, Artificial Sequence
  sgRNA
aaacccgggcccggaaatag

SEQ ID NO: 22645 - DNA, 20 bp, Artificial Sequence
  sgRNA
taaatggtttcaagcggctc

SEQ ID NO: 22646 - DNA, 20 bp, Artificial Sequence
  sgRNA
gtgtccagtacatatatgct

SEQ ID NO: 22647 - DNA, 20 bp, Artificial Sequence
  sgRNA
tgcgaatgactcagagcatt

SEQ ID NO: 22648 - DNA, 20 bp, Artificial Sequence
  sgRNA
cctgaattgtgatcatggcc

SEQ ID NO: 22649 - DNA, 20 bp, Artificial Sequence
  sgRNA
gtgttgcgcaaagaggccgg

SEQ ID NO: 22650 - DNA, 20 bp, Artificial Sequence
  sgRNA
ggactatctggccagtcgag

SEQ ID NO: 22651 - DNA, 20 bp, Artificial Sequence
  sgRNA
tctgatccagatccaccgct

SEQ ID NO: 22652 - DNA, 20 bp, Artificial Sequence
  sgRNA
gcggtgaagggcgaaacttg

SEQ ID NO: 22653 - DNA, 20 bp, Artificial Sequence
  sgRNA
tcacatctcgaccacatctg

SEQ ID NO: 22654 - DNA, 20 bp, Artificial Sequence
  sgRNA
ttgaagtgcatcacctaaga

SEQ ID NO: 22655 - DNA, 20 bp, Artificial Sequence
  sgRNA
cgcgtgccgaactagaactg

SEQ ID NO: 22656 - DNA, 20 bp, Artificial Sequence
  sgRNA
cacacaagacagacacactc

SEQ ID NO: 22657 - DNA, 20 bp, Artificial Sequence
  sgRNA
taggcatcccggcggccggc

SEQ ID NO: 22658 - DNA, 20 bp, Artificial Sequence
  sgRNA
aaacctctcgtgggcgggct

SEQ ID NO: 22659 - DNA, 20 bp, Artificial Sequence
  sgRNA
gtcatggtgagaacagtaag

SEQ ID NO: 22660 - DNA, 20 bp, Artificial Sequence
  sgRNA
agtaactggcaaagcatgaa

SEQ ID NO: 22661 - DNA, 20 bp, Artificial Sequence
  sgRNA
gtgtatgtagaccgggaagg

SEQ ID NO: 22662 - DNA, 20 bp, Artificial Sequence
  sgRNA
gtagcttgtgggtggatctg

SEQ ID NO: 22663 - DNA, 20 bp, Artificial Sequence
  sgRNA
cggaaagctgagattgaggg

SEQ ID NO: 22664 - DNA, 20 bp, Artificial Sequence
  sgRNA
ggcaggtcacttgcagtgct

SEQ ID NO: 22665 - DNA, 20 bp, Artificial Sequence
  sgRNA
atgggagtgcattgctttct

SEQ ID NO: 22666 - DNA, 20 bp, Artificial Sequence
  sgRNA
caaaggtcactctcttgagt

SEQ ID NO: 22667 - DNA, 20 bp, Artificial Sequence
  sgRNA
gggcgcgtcgtggaggagcc

SEQ ID NO: 22668 - DNA, 20 bp, Artificial Sequence
  sgRNA
cctaaagagagttacttacc

SEQ ID NO: 22669 - DNA, 20 bp, Artificial Sequence
  sgRNA
ctcatcagcctgctataaat

SEQ ID NO: 22670 - DNA, 20 bp, Artificial Sequence
  sgRNA
gcctcagagtgcgatgtcac

SEQ ID NO: 22671 - DNA, 20 bp, Artificial Sequence
  sgRNA
gtcctctagaacccggcaag

SEQ ID NO: 22672 - DNA, 20 bp, Artificial Sequence
  sgRNA
tttgcgacgctgtcgcggaa

SEQ ID NO: 22673 - DNA, 20 bp, Artificial Sequence
  sgRNA
ctggactttaagtttcagtg

SEQ ID NO: 22674 - DNA, 20 bp, Artificial Sequence
  sgRNA
cacgacagggtttaagtccc

SEQ ID NO: 22675 - DNA, 20 bp, Artificial Sequence
  sgRNA
gtctgtgcctagggaccaac

SEQ ID NO: 22676 - DNA, 20 bp, Artificial Sequence
  sgRNA
cccaaatgcaggcagtgctg

SEQ ID NO: 22677 - DNA, 20 bp, Artificial Sequence
  sgRNA
tgcccgccgttcctccggcc

SEQ ID NO: 22678 - DNA, 20 bp, Artificial Sequence
  sgRNA
tggagtagcaacacttcacc

SEQ ID NO: 22679 - DNA, 20 bp, Artificial Sequence
  sgRNA
cgcgcggaagtggccgcttc

SEQ ID NO: 22680 - DNA, 20 bp, Artificial Sequence
  sgRNA
gagaacaggtagcagagcca

SEQ ID NO: 22681 - DNA, 20 bp, Artificial Sequence
  sgRNA
taaacttactaaggatatgg

SEQ ID NO: 22682 - DNA, 20 bp, Artificial Sequence
  sgRNA
tctgtatggctaaccctagt

SEQ ID NO: 22683 - DNA, 20 bp, Artificial Sequence
  sgRNA
gggaaagcttcccgtagaga

SEQ ID NO: 22684 - DNA, 20 bp, Artificial Sequence
  sgRNA
agtcactgaagtaacttgat

SEQ ID NO: 22685 - DNA, 20 bp, Artificial Sequence
  sgRNA
gatgatggagaggctaaact

SEQ ID NO: 22686 - DNA, 20 bp, Artificial Sequence
  sgRNA
attgaccaatcaaggctgag

SEQ ID NO: 22687 - DNA, 20 bp, Artificial Sequence
  sgRNA
gaggacgggtagtcaggcaa

SEQ ID NO: 22688 - DNA, 20 bp, Artificial Sequence
  sgRNA
gagccgtcggtggcgcccat

SEQ ID NO: 22689 - DNA, 20 bp, Artificial Sequence
  sgRNA
cagcattcagagaacattcc

SEQ ID NO: 22690 - DNA, 20 bp, Artificial Sequence
  sgRNA
ctgatgaagcctcctttctg

SEQ ID NO: 22691 - DNA, 20 bp, Artificial Sequence
  sgRNA
gggctttactggaggcgcgc

SEQ ID NO: 22692 - DNA, 20 bp, Artificial Sequence
  sgRNA
gaataaaggagtgtcagcct

SEQ ID NO: 22693 - DNA, 20 bp, Artificial Sequence
  sgRNA
cccttcactgctgcacggag

SEQ ID NO: 22694 - DNA, 20 bp, Artificial Sequence
  sgRNA
aaatttgaacatcagccagg

SEQ ID NO: 22695 - DNA, 20 bp, Artificial Sequence
  sgRNA
accagcgcgaaactgagttt

SEQ ID NO: 22696 - DNA, 20 bp, Artificial Sequence
  sgRNA
cctcttgtcttgcagcgcag

SEQ ID NO: 22697 - DNA, 20 bp, Artificial Sequence
  sgRNA
cagggtaatcatgggagccg

SEQ ID NO: 22698 - DNA, 20 bp, Artificial Sequence
  sgRNA
tgccctgtgctctgtgagca

SEQ ID NO: 22699 - DNA, 20 bp, Artificial Sequence
  sgRNA
tcagcgagccaccatctaaa

SEQ ID NO: 22700 - DNA, 20 bp, Artificial Sequence
  sgRNA
gtacctcaggtttcctgcag

SEQ ID NO: 22701 - DNA, 20 bp, Artificial Sequence
  sgRNA
taagatccatgagagtacca

SEQ ID NO: 22702 - DNA, 20 bp, Artificial Sequence
  sgRNA
tggactgttacactgcgaac

SEQ ID NO: 22703 - DNA, 20 bp, Artificial Sequence
  sgRNA
atcttctaactcaactgccc

SEQ ID NO: 22704 - DNA, 20 bp, Artificial Sequence
  sgRNA
tggtattgaaatcaggtccc

SEQ ID NO: 22705 - DNA, 20 bp, Artificial Sequence
  sgRNA
gaggcaaccgttgctctaat

SEQ ID NO: 22706 - DNA, 20 bp, Artificial Sequence
  sgRNA
ctatatctttgtgattccag

SEQ ID NO: 22707 - DNA, 20 bp, Artificial Sequence
  sgRNA
tgataccgataatcatgaag

SEQ ID NO: 22708 - DNA, 20 bp, Artificial Sequence
  sgRNA
atcctagcacacgtacagta

SEQ ID NO: 22709 - DNA, 20 bp, Artificial Sequence
  sgRNA
tttatatgcgagggaactac

SEQ ID NO: 22710 - DNA, 20 bp, Artificial Sequence
  sgRNA
tctggatagtggtcacctgc

SEQ ID NO: 22711 - DNA, 20 bp, Artificial Sequence
  sgRNA
ccaatcgtagcttctcttgg

SEQ ID NO: 22712 - DNA, 20 bp, Artificial Sequence
  sgRNA
ggccggaggcctttgcgtcc

SEQ ID NO: 22713 - DNA, 20 bp, Artificial Sequence
  sgRNA
gatcaaagagttggatgcca

SEQ ID NO: 22714 - DNA, 20 bp, Artificial Sequence
  sgRNA
gctcttcgctgatgcggctg

SEQ ID NO: 22715 - DNA, 20 bp, Artificial Sequence
  sgRNA
gcactgcggatctgttgccc

SEQ ID NO: 22716 - DNA, 20 bp, Artificial Sequence
  sgRNA
atgtgctcctgtgtcctgtg

SEQ ID NO: 22717 - DNA, 20 bp, Artificial Sequence
  sgRNA
tgcagcagcgccctgctcct

SEQ ID NO: 22718 - DNA, 20 bp, Artificial Sequence
  sgRNA
cttcgtggcaccataaagcc

SEQ ID NO: 22719 - DNA, 20 bp, Artificial Sequence
  sgRNA
aacgaggaggagcgagttgg

SEQ ID NO: 22720 - DNA, 20 bp, Artificial Sequence
  sgRNA
ctggtgtgttctgtacgttt

SEQ ID NO: 22721 - DNA, 20 bp, Artificial Sequence
  sgRNA
ctcccactacacactcaggc

SEQ ID NO: 22722 - DNA, 20 bp, Artificial Sequence
  sgRNA
cgcgtgtgcccggagccaat

SEQ ID NO: 22723 - DNA, 20 bp, Artificial Sequence
  sgRNA
tcacggtccgctcttcctat

SEQ ID NO: 22724 - DNA, 20 bp, Artificial Sequence
  sgRNA
ttgaagtcaagcaagccgct

SEQ ID NO: 22725 - DNA, 20 bp, Artificial Sequence
  sgRNA
actaggtttcatctgtgact

SEQ ID NO: 22726 - DNA, 20 bp, Artificial Sequence
  sgRNA
tttctctttctaccgcagag

SEQ ID NO: 22727 - DNA, 20 bp, Artificial Sequence
  sgRNA
taaggattccctgcacccag

SEQ ID NO: 22728 - DNA, 20 bp, Artificial Sequence
  sgRNA
ctgcacgcgacgtaccaggc

SEQ ID NO: 22729 - DNA, 20 bp, Artificial Sequence
  sgRNA
gttatagatccctagaatct

SEQ ID NO: 22730 - DNA, 20 bp, Artificial Sequence
  sgRNA
aaagtataggaagccatgtt

SEQ ID NO: 22731 - DNA, 20 bp, Artificial Sequence
  sgRNA
gcacggaaatcctctaaccc

SEQ ID NO: 22732 - DNA, 20 bp, Artificial Sequence
  sgRNA
cgcagtggcaaagctggacc

SEQ ID NO: 22733 - DNA, 20 bp, Artificial Sequence
  sgRNA
tcatttcacaattacagacc

SEQ ID NO: 22734 - DNA, 20 bp, Artificial Sequence
  sgRNA
actacagatctgcttatttg

SEQ ID NO: 22735 - DNA, 20 bp, Artificial Sequence
  sgRNA
tgcagcaagcgcgcccgacc

SEQ ID NO: 22736 - DNA, 20 bp, Artificial Sequence
  sgRNA
acatgacaaaccaccagctg

SEQ ID NO: 22737 - DNA, 20 bp, Artificial Sequence
  sgRNA
tcctcttatttcacacttcc

SEQ ID NO: 22738 - DNA, 20 bp, Artificial Sequence
  sgRNA
aaagagaaatgcccagtacc

SEQ ID NO: 22739 - DNA, 20 bp, Artificial Sequence
  sgRNA
acagcaaagtttgcagacta

SEQ ID NO: 22740 - DNA, 20 bp, Artificial Sequence
  sgRNA
ttgagagacatggaccctaa

SEQ ID NO: 22741 - DNA, 20 bp, Artificial Sequence
  sgRNA
tctcgcccagggaagcgccg

SEQ ID NO: 22742 - DNA, 20 bp, Artificial Sequence
  sgRNA
ggctataactatagaaacca

SEQ ID NO: 22743 - DNA, 20 bp, Artificial Sequence
  sgRNA
acgctgcgcctagcccacaa

SEQ ID NO: 22744 - DNA, 20 bp, Artificial Sequence
  sgRNA
ggaggagtcaccctgtgcct

SEQ ID NO: 22745 - DNA, 20 bp, Artificial Sequence
  sgRNA
caaggctctctgcagtgctg

SEQ ID NO: 22746 - DNA, 20 bp, Artificial Sequence
  sgRNA
gggacagggttggtaaaccc

SEQ ID NO: 22747 - DNA, 20 bp, Artificial Sequence
  sgRNA
gtagatggctgctgggtacc

SEQ ID NO: 22748 - DNA, 20 bp, Artificial Sequence
  sgRNA
ttaagatatcatgtggctgt

SEQ ID NO: 22749 - DNA, 20 bp, Artificial Sequence
  sgRNA
tttggaaactctatcccggc

SEQ ID NO: 22750 - DNA, 20 bp, Artificial Sequence
  sgRNA
ttatcttgccagtgacattc

SEQ ID NO: 22751 - DNA, 20 bp, Artificial Sequence
  sgRNA
cgcagcccttccttctgcac

SEQ ID NO: 22752 - DNA, 20 bp, Artificial Sequence
  sgRNA
cttgccaatcagagaatgcc

SEQ ID NO: 22753 - DNA, 20 bp, Artificial Sequence
  sgRNA
aagaagagaatgagggaaat

SEQ ID NO: 22754 - DNA, 20 bp, Artificial Sequence
  sgRNA
aaagcatccctgtgtgctaa

SEQ ID NO: 22755 - DNA, 20 bp, Artificial Sequence
  sgRNA
atccctgaagtctgaagtta

SEQ ID NO: 22756 - DNA, 20 bp, Artificial Sequence
  sgRNA
acctactggaggcacgtgcc

SEQ ID NO: 22757 - DNA, 20 bp, Artificial Sequence
  sgRNA
ggaagaaaccagaggaattg

SEQ ID NO: 22758 - DNA, 20 bp, Artificial Sequence
  sgRNA
tgtcaattacaaggcgtcgc

SEQ ID NO: 22759 - DNA, 20 bp, Artificial Sequence
  sgRNA
tcaggtgttacatatatggc

SEQ ID NO: 22760 - DNA, 20 bp, Artificial Sequence
  sgRNA
acttggaggcgccgggcgtg

SEQ ID NO: 22761 - DNA, 20 bp, Artificial Sequence
  sgRNA
acgacctgcgccgggaatcc

SEQ ID NO: 22762 - DNA, 20 bp, Artificial Sequence
  sgRNA
aggcggcgctgcccgacggg

SEQ ID NO: 22763 - DNA, 20 bp, Artificial Sequence
  sgRNA
cgggcagagcttgaccggag

SEQ ID NO: 22764 - DNA, 20 bp, Artificial Sequence
  sgRNA
gacaacgacaacgacaatgt

SEQ ID NO: 22765 - DNA, 20 bp, Artificial Sequence
  sgRNA
ccaagcactaacgagtcaca

SEQ ID NO: 22766 - DNA, 20 bp, Artificial Sequence
  sgRNA
tcaagtgaggaatgtgggca

SEQ ID NO: 22767 - DNA, 20 bp, Artificial Sequence
  sgRNA
gtctgtattgcagggctact

SEQ ID NO: 22768 - DNA, 20 bp, Artificial Sequence
  sgRNA
gcagagtaacttcaccacaa

SEQ ID NO: 22769 - DNA, 20 bp, Artificial Sequence
  sgRNA
taaaggacttagagtatctt

SEQ ID NO: 22770 - DNA, 20 bp, Artificial Sequence
  sgRNA
ccctgctactcacaggaacc

SEQ ID NO: 22771 - DNA, 20 bp, Artificial Sequence
  sgRNA
ggccgagcgcctccgacgtc

SEQ ID NO: 22772 - DNA, 20 bp, Artificial Sequence
  sgRNA
tcccagaccgtgcggtgcag

SEQ ID NO: 22773 - DNA, 20 bp, Artificial Sequence
  sgRNA
gggtgactgacggcccggtt

SEQ ID NO: 22774 - DNA, 20 bp, Artificial Sequence
  sgRNA
catcatagcttcagagacaa

SEQ ID NO: 22775 - DNA, 20 bp, Artificial Sequence
  sgRNA
gcactccggagagactatga

SEQ ID NO: 22776 - DNA, 20 bp, Artificial Sequence
  sgRNA
tgcggtttagcggaaggatc

SEQ ID NO: 22777 - DNA, 20 bp, Artificial Sequence
  sgRNA
gaactggagaggaccgcgag

SEQ ID NO: 22778 - DNA, 20 bp, Artificial Sequence
  sgRNA
gagcggagtggcaacgtaac

SEQ ID NO: 22779 - DNA, 20 bp, Artificial Sequence
  sgRNA
attatgaggtcattgccaag

SEQ ID NO: 22780 - DNA, 20 bp, Artificial Sequence
  sgRNA
aacccgaggctggagggtgg

SEQ ID NO: 22781 - DNA, 20 bp, Artificial Sequence
  sgRNA
tgagaggtgtactcgcaggg

SEQ ID NO: 22782 - DNA, 20 bp, Artificial Sequence
  sgRNA
tggctctgagcggtccacgt

SEQ ID NO: 22783 - DNA, 20 bp, Artificial Sequence
  sgRNA
gctggccaccacacatacat

SEQ ID NO: 22784 - DNA, 20 bp, Artificial Sequence
  sgRNA
ttcactcagagttaaagaaa

SEQ ID NO: 22785 - DNA, 20 bp, Artificial Sequence
  sgRNA
tggaagagtgctggcagcac

SEQ ID NO: 22786 - DNA, 20 bp, Artificial Sequence
  sgRNA
ctttctcctgctgatctgcc

SEQ ID NO: 22787 - DNA, 20 bp, Artificial Sequence
  sgRNA
cagagtctatgacgctactc

SEQ ID NO: 22788 - DNA, 20 bp, Artificial Sequence
  sgRNA
acatggtggcagaaatagag

SEQ ID NO: 22789 - DNA, 20 bp, Artificial Sequence
  sgRNA
cattggctggcgggccgact

SEQ ID NO: 22790 - DNA, 20 bp, Artificial Sequence
  sgRNA
aatgcagtagaaagaaattg

SEQ ID NO: 22791 - DNA, 20 bp, Artificial Sequence
  sgRNA
acaaggctttgctgcccatt

SEQ ID NO: 22792 - DNA, 20 bp, Artificial Sequence
  sgRNA
gggaggtcgcggccaggtca

SEQ ID NO: 22793 - DNA, 20 bp, Artificial Sequence
  sgRNA
cgcttcccattgggtgtggg

SEQ ID NO: 22794 - DNA, 20 bp, Artificial Sequence
  sgRNA
tttcttcctctactccctct

SEQ ID NO: 22795 - DNA, 20 bp, Artificial Sequence
  sgRNA
gacatggcttcatagcacag

SEQ ID NO: 22796 - DNA, 20 bp, Artificial Sequence
  sgRNA
cctgctctgtgaggtaggcc

SEQ ID NO: 22797 - DNA, 20 bp, Artificial Sequence
  sgRNA
atcaggataatcttctcagc

SEQ ID NO: 22798 - DNA, 20 bp, Artificial Sequence
  sgRNA
aactacagagaaagcttggt

SEQ ID NO: 22799 - DNA, 20 bp, Artificial Sequence
  sgRNA
cccagattctggttgctccc

SEQ ID NO: 22800 - DNA, 20 bp, Artificial Sequence
  sgRNA
ttgttgctcaggttgctcaa

SEQ ID NO: 22801 - DNA, 20 bp, Artificial Sequence
  sgRNA
gaaataacaggtattccaga

SEQ ID NO: 22802 - DNA, 20 bp, Artificial Sequence
  sgRNA
atgggagcgcaatgtatgag

SEQ ID NO: 22803 - DNA, 20 bp, Artificial Sequence
  sgRNA
acctctcgtgggcgggcttg

SEQ ID NO: 22804 - DNA, 20 bp, Artificial Sequence
  sgRNA
ccactatgggcttgtgccat

SEQ ID NO: 22805 - DNA, 20 bp, Artificial Sequence
  sgRNA
gcgcataagatacttccggc

SEQ ID NO: 22806 - DNA, 20 bp, Artificial Sequence
  sgRNA
tataatgagacttcgctgca

SEQ ID NO: 22807 - DNA, 20 bp, Artificial Sequence
  sgRNA
cttaatggaacttgagagag

SEQ ID NO: 22808 - DNA, 20 bp, Artificial Sequence
  sgRNA
accggttcgaggaccgcaga

SEQ ID NO: 22809 - DNA, 20 bp, Artificial Sequence
  sgRNA
tcatcccagagttcatggca

SEQ ID NO: 22810 - DNA, 20 bp, Artificial Sequence
  sgRNA
ctgaccgctgatacacagca

SEQ ID NO: 22811 - DNA, 20 bp, Artificial Sequence
  sgRNA
tttcgactcgcctcgctccc

SEQ ID NO: 22812 - DNA, 20 bp, Artificial Sequence
  sgRNA
cagcgctgcgaggatctagt

SEQ ID NO: 22813 - DNA, 20 bp, Artificial Sequence
  sgRNA
cctatctctgagagacagcg

SEQ ID NO: 22814 - DNA, 20 bp, Artificial Sequence
  sgRNA
tcaagcatagaggaagaaag

SEQ ID NO: 22815 - DNA, 20 bp, Artificial Sequence
  sgRNA
atttatctccacattatctg

SEQ ID NO: 22816 - DNA, 20 bp, Artificial Sequence
  sgRNA
aggaggaaagttctcaagag

SEQ ID NO: 22817 - DNA, 20 bp, Artificial Sequence
  sgRNA
ctgaaataattctcctacaa

SEQ ID NO: 22818 - DNA, 20 bp, Artificial Sequence
  sgRNA
caactctggtttgacggatg

SEQ ID NO: 22819 - DNA, 20 bp, Artificial Sequence
  sgRNA
ggaggctgaggcggaggtga

SEQ ID NO: 22820 - DNA, 20 bp, Artificial Sequence
  sgRNA
caaaggaccttggctaaatt

SEQ ID NO: 22821 - DNA, 20 bp, Artificial Sequence
  sgRNA
ggagtcgctgtggaaataca

SEQ ID NO: 22822 - DNA, 20 bp, Artificial Sequence
  sgRNA
agggtttattcagttctttc

SEQ ID NO: 22823 - DNA, 20 bp, Artificial Sequence
  sgRNA
gaagttccattccgtgtatt

SEQ ID NO: 22824 - DNA, 20 bp, Artificial Sequence
  sgRNA
gaggattcttaagcactctc

SEQ ID NO: 22825 - DNA, 20 bp, Artificial Sequence
  sgRNA
ctcacactctctcgctaccc

SEQ ID NO: 22826 - DNA, 20 bp, Artificial Sequence
  sgRNA
gggaccaaaggactgcgacg

SEQ ID NO: 22827 - DNA, 20 bp, Artificial Sequence
  sgRNA
ggctgaagaattctgaattc

SEQ ID NO: 22828 - DNA, 20 bp, Artificial Sequence
  sgRNA
gccgtcccggaagtactccg

SEQ ID NO: 22829 - DNA, 20 bp, Artificial Sequence
  sgRNA
ctgtaaagtccttatctccc

SEQ ID NO: 22830 - DNA, 20 bp, Artificial Sequence
  sgRNA
aataggataggcggagagtc

SEQ ID NO: 22831 - DNA, 20 bp, Artificial Sequence
  sgRNA
ggaggagctgactgctataa

SEQ ID NO: 22832 - DNA, 20 bp, Artificial Sequence
  sgRNA
aaaggccaagggcgctggcg

SEQ ID NO: 22833 - DNA, 20 bp, Artificial Sequence
  sgRNA
aatcgaccggagagctgctc

SEQ ID NO: 22834 - DNA, 20 bp, Artificial Sequence
  sgRNA
agcgagggtgtaggctggcc

SEQ ID NO: 22835 - DNA, 20 bp, Artificial Sequence
  sgRNA
acaaggtctgtgtacgcagg

SEQ ID NO: 22836 - DNA, 20 bp, Artificial Sequence
  sgRNA
cgcgcttgtcctgatgctgc

SEQ ID NO: 22837 - DNA, 20 bp, Artificial Sequence
  sgRNA
ggacgcgacaagaaacacga

SEQ ID NO: 22838 - DNA, 20 bp, Artificial Sequence
  sgRNA
tgtgtgatcacttatttctt

SEQ ID NO: 22839 - DNA, 20 bp, Artificial Sequence
  sgRNA
ctataggtcactgatagaaa

SEQ ID NO: 22840 - DNA, 20 bp, Artificial Sequence
  sgRNA
catatccaatgacgcccaat

SEQ ID NO: 22841 - DNA, 20 bp, Artificial Sequence
  sgRNA
gtctaggaagtgggcattag

SEQ ID NO: 22842 - DNA, 20 bp, Artificial Sequence
  sgRNA
agagctgagctcaattcgct

SEQ ID NO: 22843 - DNA, 20 bp, Artificial Sequence
  sgRNA
ataggtcctttagaacaatt

SEQ ID NO: 22844 - DNA, 20 bp, Artificial Sequence
  sgRNA
gggcaatgcggtgaccgaga

SEQ ID NO: 22845 - DNA, 20 bp, Artificial Sequence
  sgRNA
catggatgctacatccagca

SEQ ID NO: 22846 - DNA, 20 bp, Artificial Sequence
  sgRNA
tttcggtgtgtcagcccttc

SEQ ID NO: 22847 - DNA, 20 bp, Artificial Sequence
  sgRNA
cttcgcttccggaaataacc

SEQ ID NO: 22848 - DNA, 20 bp, Artificial Sequence
  sgRNA
ccagactgacccaactatag

SEQ ID NO: 22849 - DNA, 20 bp, Artificial Sequence
  sgRNA
tatgaaaggctttaggatgc

SEQ ID NO: 22850 - DNA, 20 bp, Artificial Sequence
  sgRNA
tgcaactcatacttacagtt

SEQ ID NO: 22851 - DNA, 20 bp, Artificial Sequence
  sgRNA
gtaagatctaaagaatgagc

SEQ ID NO: 22852 - DNA, 20 bp, Artificial Sequence
  sgRNA
gcggagcgatactcctcacc

SEQ ID NO: 22853 - DNA, 20 bp, Artificial Sequence
  sgRNA
tgaggttgagtggagtcttt

SEQ ID NO: 22854 - DNA, 20 bp, Artificial Sequence
  sgRNA
accaggaaggattgagcaag

SEQ ID NO: 22855 - DNA, 20 bp, Artificial Sequence
  sgRNA
tggttgggcggcaacattac

SEQ ID NO: 22856 - DNA, 20 bp, Artificial Sequence
  sgRNA
tgattggttcatgatataca

SEQ ID NO: 22857 - DNA, 20 bp, Artificial Sequence
  sgRNA
ctttgtaagaccgggctttg

SEQ ID NO: 22858 - DNA, 20 bp, Artificial Sequence
  sgRNA
ctcgctgacaaggacgcgtc

SEQ ID NO: 22859 - DNA, 20 bp, Artificial Sequence
  sgRNA
gacttgatctagaaagaata

SEQ ID NO: 22860 - DNA, 20 bp, Artificial Sequence
  sgRNA
aaggcgtgcgtcaccacgcc

SEQ ID NO: 22861 - DNA, 20 bp, Artificial Sequence
  sgRNA
gaggcggtgtcagcgctcgc

SEQ ID NO: 22862 - DNA, 20 bp, Artificial Sequence
  sgRNA
gcaacaggaggacaaccaga

SEQ ID NO: 22863 - DNA, 20 bp, Artificial Sequence
  sgRNA
caaattccagggactccaag

SEQ ID NO: 22864 - DNA, 20 bp, Artificial Sequence
  sgRNA
aacctgctagggcgcaggcg

SEQ ID NO: 22865 - DNA, 20 bp, Artificial Sequence
  sgRNA
ccacaacacgtagaactgtt

SEQ ID NO: 22866 - DNA, 20 bp, Artificial Sequence
  sgRNA
ctgtgtgtttgattatttag

SEQ ID NO: 22867 - DNA, 20 bp, Artificial Sequence
  sgRNA
ccagatgttgccggtaccct

SEQ ID NO: 22868 - DNA, 20 bp, Artificial Sequence
  sgRNA
tgacgtaaacttagcagcag

SEQ ID NO: 22869 - DNA, 20 bp, Artificial Sequence
  sgRNA
gtcttgtcaggtaccaggac

SEQ ID NO: 22870 - DNA, 20 bp, Artificial Sequence
  sgRNA
agtttctggcagaaattcct

SEQ ID NO: 22871 - DNA, 20 bp, Artificial Sequence
  sgRNA
agcgacgggccggctagttc

SEQ ID NO: 22872 - DNA, 20 bp, Artificial Sequence
  sgRNA
aagctgatgaggccaggcgt

SEQ ID NO: 22873 - DNA, 20 bp, Artificial Sequence
  sgRNA
gttcctttccagctgggccc

SEQ ID NO: 22874 - DNA, 20 bp, Artificial Sequence
  sgRNA
aattggtcaaatggtcgcag

SEQ ID NO: 22875 - DNA, 20 bp, Artificial Sequence
  sgRNA
tgatgcaaatctttcttcag

SEQ ID NO: 22876 - DNA, 20 bp, Artificial Sequence
  sgRNA
catgggttcaccattgcata

SEQ ID NO: 22877 - DNA, 20 bp, Artificial Sequence
  sgRNA
aggttaatgaaatgacttcc

SEQ ID NO: 22878 - DNA, 20 bp, Artificial Sequence
  sgRNA
attggaggagataaccatgc

SEQ ID NO: 22879 - DNA, 20 bp, Artificial Sequence
  sgRNA
atggagatctcgaggcattg

SEQ ID NO: 22880 - DNA, 20 bp, Artificial Sequence
  sgRNA
gtatgcgcgcagtcctgaag

SEQ ID NO: 22881 - DNA, 20 bp, Artificial Sequence
  sgRNA
tgatttctcagggtaattcc

SEQ ID NO: 22882 - DNA, 20 bp, Artificial Sequence
  sgRNA
ggtgaaatgaccacagtttc

SEQ ID NO: 22883 - DNA, 20 bp, Artificial Sequence
  sgRNA
gaagattaagtgttagcgaa

SEQ ID NO: 22884 - DNA, 20 bp, Artificial Sequence
  sgRNA
ccacgcgctttcctcctccc

SEQ ID NO: 22885 - DNA, 20 bp, Artificial Sequence
  sgRNA
gcttcctgacaagcttaccg

SEQ ID NO: 22886 - DNA, 20 bp, Artificial Sequence
  sgRNA
atgagtaccttctctcagtg

SEQ ID NO: 22887 - DNA, 20 bp, Artificial Sequence
  sgRNA
gaatttagcttgatccatta

SEQ ID NO: 22888 - DNA, 20 bp, Artificial Sequence
  sgRNA
ggtgaacgtttaatgcgggt

SEQ ID NO: 22889 - DNA, 20 bp, Artificial Sequence
  sgRNA
actgttcgcagccaaagggc

SEQ ID NO: 22890 - DNA, 20 bp, Artificial Sequence
  sgRNA
agcgcgttcctgacactgaa

SEQ ID NO: 22891 - DNA, 20 bp, Artificial Sequence
  sgRNA
gacaaatatgtgagttggac

SEQ ID NO: 22892 - DNA, 20 bp, Artificial Sequence
  sgRNA
tgttgatagaatgtttgatg

SEQ ID NO: 22893 - DNA, 20 bp, Artificial Sequence
  sgRNA
atgactctatggaggaactt

SEQ ID NO: 22894 - DNA, 20 bp, Artificial Sequence
  sgRNA
ggaggcgagcatccactcag

SEQ ID NO: 22895 - DNA, 20 bp, Artificial Sequence
  sgRNA
ggagccgctgagctcgctcc

SEQ ID NO: 22896 - DNA, 20 bp, Artificial Sequence
  sgRNA
caagattcttgctacattgt

SEQ ID NO: 22897 - DNA, 20 bp, Artificial Sequence
  sgRNA
ctgggccagtcagtactgcg

SEQ ID NO: 22898 - DNA, 20 bp, Artificial Sequence
  sgRNA
gctgtgatgggatgatgtca

SEQ ID NO: 22899 - DNA, 20 bp, Artificial Sequence
  sgRNA
ggcaggagaaaggctcccat

SEQ ID NO: 22900 - DNA, 20 bp, Artificial Sequence
  sgRNA
cagaacaatcaattgcactt

SEQ ID NO: 22901 - DNA, 20 bp, Artificial Sequence
  sgRNA
gcaggcccggtggagacgcg

SEQ ID NO: 22902 - DNA, 20 bp, Artificial Sequence
  sgRNA
atatccctgctgtcactgct

SEQ ID NO: 22903 - DNA, 20 bp, Artificial Sequence
  sgRNA
cagctcgtctttacatattt

SEQ ID NO: 22904 - DNA, 20 bp, Artificial Sequence
  sgRNA
ttagggacttctctgttaag

SEQ ID NO: 22905 - DNA, 20 bp, Artificial Sequence
  sgRNA
tcattcaatgtcattctccc

SEQ ID NO: 22906 - DNA, 20 bp, Artificial Sequence
  sgRNA
gcagttaggattcctccatg

SEQ ID NO: 22907 - DNA, 20 bp, Artificial Sequence
  sgRNA
gttactagaacctgtttctg

SEQ ID NO: 22908 - DNA, 20 bp, Artificial Sequence
  sgRNA
gtgttctatctaatcatcca

SEQ ID NO: 22909 - DNA, 20 bp, Artificial Sequence
  sgRNA
gaggagagctttcgcacccg

SEQ ID NO: 22910 - DNA, 20 bp, Artificial Sequence
  sgRNA
tttcccaatgatggttgact

SEQ ID NO: 22911 - DNA, 20 bp, Artificial Sequence
  sgRNA
aaaggcgctcgctgctcggg

SEQ ID NO: 22912 - DNA, 20 bp, Artificial Sequence
  sgRNA
aattcactcagctctgagcc

SEQ ID NO: 22913 - DNA, 20 bp, Artificial Sequence
  sgRNA
cccgagactttctcacactc

SEQ ID NO: 22914 - DNA, 20 bp, Artificial Sequence
  sgRNA
tagactaaattatttgaggc

SEQ ID NO: 22915 - DNA, 20 bp, Artificial Sequence
  sgRNA
ggaactgaaagccacaaatc

SEQ ID NO: 22916 - DNA, 20 bp, Artificial Sequence
  sgRNA
tattgtgcacaatggcattc

SEQ ID NO: 22917 - DNA, 20 bp, Artificial Sequence
  sgRNA
tctgggccaagtgtgtttcc

SEQ ID NO: 22918 - DNA, 20 bp, Artificial Sequence
  sgRNA
caagtcagtgtaatttcttg

SEQ ID NO: 22919 - DNA, 20 bp, Artificial Sequence
  sgRNA
gatgatctgcaaaccatata

SEQ ID NO: 22920 - DNA, 20 bp, Artificial Sequence
  sgRNA
aagtctgtgacgtgagagaa

SEQ ID NO: 22921 - DNA, 20 bp, Artificial Sequence
  sgRNA
aatagcataattctctttcc

SEQ ID NO: 22922 - DNA, 20 bp, Artificial Sequence
  sgRNA
cagtgcctcagcgaccgtct

SEQ ID NO: 22923 - DNA, 20 bp, Artificial Sequence
  sgRNA
ccgcgactaaggagagcctg

SEQ ID NO: 22924 - DNA, 20 bp, Artificial Sequence
  sgRNA
ccaggtcaccctcccagctg

SEQ ID NO: 22925 - DNA, 20 bp, Artificial Sequence
  sgRNA
ccagccaccgcccggctcct

SEQ ID NO: 22926 - DNA, 20 bp, Artificial Sequence
  sgRNA
gctacactcggagtgttctg

SEQ ID NO: 22927 - DNA, 20 bp, Artificial Sequence
  sgRNA
cttggcaattggcggctgcg

SEQ ID NO: 22928 - DNA, 20 bp, Artificial Sequence
  sgRNA
tacatcagtagagcctgaga

SEQ ID NO: 22929 - DNA, 20 bp, Artificial Sequence
  sgRNA
ctccagcctgaagtgccgca

SEQ ID NO: 22930 - DNA, 20 bp, Artificial Sequence
  sgRNA
ggattgggcagtgctccgag

SEQ ID NO: 22931 - DNA, 20 bp, Artificial Sequence
  sgRNA
tcctaactggtttggtgcta

SEQ ID NO: 22932 - DNA, 20 bp, Artificial Sequence
  sgRNA
gaagcaaggactcaaccctt

SEQ ID NO: 22933 - DNA, 20 bp, Artificial Sequence
  sgRNA
gaacacggtgaggtccacaa

SEQ ID NO: 22934 - DNA, 20 bp, Artificial Sequence
  sgRNA
agtgaaatcgcagctagaaa

SEQ ID NO: 22935 - DNA, 20 bp, Artificial Sequence
  sgRNA
actttctgtttctattaggt

SEQ ID NO: 22936 - DNA, 20 bp, Artificial Sequence
  sgRNA
gtccttcgagcagaatgctc

SEQ ID NO: 22937 - DNA, 20 bp, Artificial Sequence
  sgRNA
gctagaggcgcggcggcgcg

SEQ ID NO: 22938 - DNA, 20 bp, Artificial Sequence
  sgRNA
cagctaaggtaaattaaaca

SEQ ID NO: 22939 - DNA, 20 bp, Artificial Sequence
  sgRNA
gacagcaggtctctcactga

SEQ ID NO: 22940 - DNA, 20 bp, Artificial Sequence
  sgRNA
ttgaccactaagtctcaggc

SEQ ID NO: 22941 - DNA, 20 bp, Artificial Sequence
  sgRNA
ggaagcagacctcaggttct

SEQ ID NO: 22942 - DNA, 20 bp, Artificial Sequence
  sgRNA
gctaagatctgaaattgggt

SEQ ID NO: 22943 - DNA, 20 bp, Artificial Sequence
  sgRNA
gacgctcagcccacaataaa

SEQ ID NO: 22944 - DNA, 20 bp, Artificial Sequence
  sgRNA
cagccataaactgaaacatg

SEQ ID NO: 22945 - DNA, 20 bp, Artificial Sequence
  sgRNA
attactgtacctactactaa

SEQ ID NO: 22946 - DNA, 20 bp, Artificial Sequence
  sgRNA
aatagtttcagtgttctaac

SEQ ID NO: 22947 - DNA, 20 bp, Artificial Sequence
  sgRNA
aaggaggctcagctggcggc

SEQ ID NO: 22948 - DNA, 20 bp, Artificial Sequence
  sgRNA
gggatagcgctcttgcagtt

SEQ ID NO: 22949 - DNA, 20 bp, Artificial Sequence
  sgRNA
atgtcaattaaatgccaaac

SEQ ID NO: 22950 - DNA, 20 bp, Artificial Sequence
  sgRNA
cccatctccggcgcagcggg

SEQ ID NO: 22951 - DNA, 20 bp, Artificial Sequence
  sgRNA
agcgagcagcgtcgtcgaag

SEQ ID NO: 22952 - DNA, 20 bp, Artificial Sequence
  sgRNA
gagcttagagtgcaggattc

SEQ ID NO: 22953 - DNA, 20 bp, Artificial Sequence
  sgRNA
ccgctccgctcatgcgcaca

SEQ ID NO: 22954 - DNA, 20 bp, Artificial Sequence
  sgRNA
tccgccgtgcgccgcacttc

SEQ ID NO: 22955 - DNA, 20 bp, Artificial Sequence
  sgRNA
aagactagcggtgcaggtgg

SEQ ID NO: 22956 - DNA, 20 bp, Artificial Sequence
  sgRNA
cctgtgcggaagggtgggcg

SEQ ID NO: 22957 - DNA, 20 bp, Artificial Sequence
  sgRNA
cagtatcccttgatgccctg

SEQ ID NO: 22958 - DNA, 20 bp, Artificial Sequence
  sgRNA
ttccaggccatgctaatgag

SEQ ID NO: 22959 - DNA, 20 bp, Artificial Sequence
  sgRNA
gtaatgatcaaagtgctcac

SEQ ID NO: 22960 - DNA, 20 bp, Artificial Sequence
  sgRNA
cagttctaaggagttgggtc

SEQ ID NO: 22961 - DNA, 20 bp, Artificial Sequence
  sgRNA
tggcgttcttggtgacccac

SEQ ID NO: 22962 - DNA, 20 bp, Artificial Sequence
  sgRNA
aaggttccttcatccagatt

SEQ ID NO: 22963 - DNA, 20 bp, Artificial Sequence
  sgRNA
aggtgtgcggcttctaggaa

SEQ ID NO: 22964 - DNA, 20 bp, Artificial Sequence
  sgRNA
atccatcctccggaacaccc

SEQ ID NO: 22965 - DNA, 20 bp, Artificial Sequence
  sgRNA
ccatgacactcagtacacgt

SEQ ID NO: 22966 - DNA, 20 bp, Artificial Sequence
  sgRNA
agctaaaggagacccatatg

SEQ ID NO: 22967 - DNA, 20 bp, Artificial Sequence
  sgRNA
aggaactgtgcgggagcctc

SEQ ID NO: 22968 - DNA, 20 bp, Artificial Sequence
  sgRNA
gcgtcatttcctgttgacag

SEQ ID NO: 22969 - DNA, 20 bp, Artificial Sequence
  sgRNA
ttaagcggctctatgtttgc

SEQ ID NO: 22970 - DNA, 20 bp, Artificial Sequence
  sgRNA
gctggattccaagattctag

SEQ ID NO: 22971 - DNA, 20 bp, Artificial Sequence
  sgRNA
acaccaaatgttaaagagaa

SEQ ID NO: 22972 - DNA, 20 bp, Artificial Sequence
  sgRNA
ggcgagcacaagaccgccac

SEQ ID NO: 22973 - DNA, 20 bp, Artificial Sequence
  sgRNA
cagtatctaggtagtgtcct

SEQ ID NO: 22974 - DNA, 20 bp, Artificial Sequence
  sgRNA
ctgatacggccatgtttgtg

SEQ ID NO: 22975 - DNA, 20 bp, Artificial Sequence
  sgRNA
ttaagtagatgattaccctc

SEQ ID NO: 22976 - DNA, 20 bp, Artificial Sequence
  sgRNA
gagccggttgcaaagctcaa

SEQ ID NO: 22977 - DNA, 20 bp, Artificial Sequence
  sgRNA
gagggattcctgccgcctag

SEQ ID NO: 22978 - DNA, 20 bp, Artificial Sequence
  sgRNA
aagaactcgtccaaattccc

SEQ ID NO: 22979 - DNA, 20 bp, Artificial Sequence
  sgRNA
gcctcggcggaggtagcgac

SEQ ID NO: 22980 - DNA, 20 bp, Artificial Sequence
  sgRNA
agctccacctttgcttagaa

SEQ ID NO: 22981 - DNA, 20 bp, Artificial Sequence
  sgRNA
gctgcatctacctttccacc

SEQ ID NO: 22982 - DNA, 20 bp, Artificial Sequence
  sgRNA
cgataggcgcgggcaggagc

SEQ ID NO: 22983 - DNA, 20 bp, Artificial Sequence
  sgRNA
cagttcaccacttcaaagtc

SEQ ID NO: 22984 - DNA, 20 bp, Artificial Sequence
  sgRNA
aaacagctatgagcaaacaa

SEQ ID NO: 22985 - DNA, 20 bp, Artificial Sequence
  sgRNA
gaagtaaatcacacttaaag

SEQ ID NO: 22986 - DNA, 20 bp, Artificial Sequence
  sgRNA
gacaggaagcccgcggaagg

SEQ ID NO: 22987 - DNA, 20 bp, Artificial Sequence
  sgRNA
gtatataaatagaggccgcg

SEQ ID NO: 22988 - DNA, 20 bp, Artificial Sequence
  sgRNA
tgagccatcttgaccgcaga

SEQ ID NO: 22989 - DNA, 20 bp, Artificial Sequence
  sgRNA
ggcatgcgctttccacccat

SEQ ID NO: 22990 - DNA, 20 bp, Artificial Sequence
  sgRNA
catgttctgtcagactgatg

SEQ ID NO: 22991 - DNA, 20 bp, Artificial Sequence
  sgRNA
gagcaaacttatttactagt

SEQ ID NO: 22992 - DNA, 20 bp, Artificial Sequence
  sgRNA
taattgcagtttaatcactg

SEQ ID NO: 22993 - DNA, 20 bp, Artificial Sequence
  sgRNA
ggatctcccgtgtgagagtt

SEQ ID NO: 22994 - DNA, 20 bp, Artificial Sequence
  sgRNA
gtaagacaatggcattgttc

SEQ ID NO: 22995 - DNA, 20 bp, Artificial Sequence
  sgRNA
agtggttggagatctttgta

SEQ ID NO: 22996 - DNA, 20 bp, Artificial Sequence
  sgRNA
acctacgactgggctgcgag

SEQ ID NO: 22997 - DNA, 20 bp, Artificial Sequence
  sgRNA
ttgatagagatcagctgctg

SEQ ID NO: 22998 - DNA, 20 bp, Artificial Sequence
  sgRNA
cacacaacttagacgaatct

SEQ ID NO: 22999 - DNA, 20 bp, Artificial Sequence
  sgRNA
caaaggttccggcgcgaacg

SEQ ID NO: 23000 - DNA, 20 bp, Artificial Sequence
  sgRNA
tctgtgctctaggaagcggc

SEQ ID NO: 23001 - DNA, 20 bp, Artificial Sequence
  sgRNA
tctaggtttcacaaggaaca

SEQ ID NO: 23002 - DNA, 20 bp, Artificial Sequence
  sgRNA
agcaaaggagctgagcgcaa

SEQ ID NO: 23003 - DNA, 20 bp, Artificial Sequence
  sgRNA
aatttgcgcgggttcggact

SEQ ID NO: 23004 - DNA, 20 bp, Artificial Sequence
  sgRNA
gggtggcgctccctattccc

SEQ ID NO: 23005 - DNA, 20 bp, Artificial Sequence
  sgRNA
atgcctagatggcgcaatct

SEQ ID NO: 23006 - DNA, 20 bp, Artificial Sequence
  sgRNA
actttcttatggtgactaaa

SEQ ID NO: 23007 - DNA, 20 bp, Artificial Sequence
  sgRNA
cagcctccacgagactatcc

SEQ ID NO: 23008 - DNA, 20 bp, Artificial Sequence
  sgRNA
tagcatgactacaaactgct

SEQ ID NO: 23009 - DNA, 20 bp, Artificial Sequence
  sgRNA
agcgaccgcgtggagcctcc

SEQ ID NO: 23010 - DNA, 20 bp, Artificial Sequence
  sgRNA
atggaagatcaattaccttt

SEQ ID NO: 23011 - DNA, 20 bp, Artificial Sequence
  sgRNA
gccaggcggccgccaaatcc

SEQ ID NO: 23012 - DNA, 20 bp, Artificial Sequence
  sgRNA
ttctgaacgcctcctgctgg

SEQ ID NO: 23013 - DNA, 20 bp, Artificial Sequence
  sgRNA
tcgttgacgtcacggaacgc

SEQ ID NO: 23014 - DNA, 20 bp, Artificial Sequence
  sgRNA
aaatgtctatgctcagctcg

SEQ ID NO: 23015 - DNA, 20 bp, Artificial Sequence
  sgRNA
agctgggctcggcgatcacg

SEQ ID NO: 23016 - DNA, 20 bp, Artificial Sequence
  sgRNA
tggctcgtgtgcgtcacttc

SEQ ID NO: 23017 - DNA, 20 bp, Artificial Sequence
  sgRNA
ggagattataatgggtcctt

SEQ ID NO: 23018 - DNA, 20 bp, Artificial Sequence
  sgRNA
aaacaaagcttctgtccacc

SEQ ID NO: 23019 - DNA, 20 bp, Artificial Sequence
  sgRNA
taatggaagcgcttaatgag

SEQ ID NO: 23020 - DNA, 20 bp, Artificial Sequence
  sgRNA
ggtctgagtgcgtgcgagcc

SEQ ID NO: 23021 - DNA, 20 bp, Artificial Sequence
  sgRNA
gacaacaggattccgttcca

SEQ ID NO: 23022 - DNA, 20 bp, Artificial Sequence
  sgRNA
tggagtatttcagaattatc

SEQ ID NO: 23023 - DNA, 20 bp, Artificial Sequence
  sgRNA
ctagcctgcgttgtggttag

SEQ ID NO: 23024 - DNA, 20 bp, Artificial Sequence
  sgRNA
gacagatcccggccttagga

SEQ ID NO: 23025 - DNA, 20 bp, Artificial Sequence
  sgRNA
cctaataggtgatagagcct

SEQ ID NO: 23026 - DNA, 20 bp, Artificial Sequence
  sgRNA
gggacttggagcgggcctcc

SEQ ID NO: 23027 - DNA, 20 bp, Artificial Sequence
  sgRNA
tccgtcaccactccaccagg

SEQ ID NO: 23028 - DNA, 20 bp, Artificial Sequence
  sgRNA
agcggaagcgtcgccaataa

SEQ ID NO: 23029 - DNA, 20 bp, Artificial Sequence
  sgRNA
cgctccgcctaagaagtgcg

SEQ ID NO: 23030 - DNA, 20 bp, Artificial Sequence
  sgRNA
tgaacacatattaacagcac

SEQ ID NO: 23031 - DNA, 20 bp, Artificial Sequence
  sgRNA
aaggcggaggcgcatccgcg

SEQ ID NO: 23032 - DNA, 20 bp, Artificial Sequence
  sgRNA
gaggcttgcgattgggcgag

SEQ ID NO: 23033 - DNA, 20 bp, Artificial Sequence
  sgRNA
acagaatgagtggaaaggaa

SEQ ID NO: 23034 - DNA, 20 bp, Artificial Sequence
  sgRNA
ttctgtgatgcaacttatgt

SEQ ID NO: 23035 - DNA, 20 bp, Artificial Sequence
  sgRNA
cgccacttaagttgcatgac

SEQ ID NO: 23036 - DNA, 20 bp, Artificial Sequence
  sgRNA
ggcgggagaatccaagcaag

SEQ ID NO: 23037 - DNA, 20 bp, Artificial Sequence
  sgRNA
agtgtgcaatgacatcataa

SEQ ID NO: 23038 - DNA, 20 bp, Artificial Sequence
  sgRNA
attctgcgcttgcgctgtag

SEQ ID NO: 23039 - DNA, 20 bp, Artificial Sequence
  sgRNA
tcccgcggatggccggcaga

SEQ ID NO: 23040 - DNA, 20 bp, Artificial Sequence
  sgRNA
tcagaagttcggagcttgtc

SEQ ID NO: 23041 - DNA, 20 bp, Artificial Sequence
  sgRNA
ggtccagggtgaagaataaa

SEQ ID NO: 23042 - DNA, 20 bp, Artificial Sequence
  sgRNA
cagaattatcagatacagtg

SEQ ID NO: 23043 - DNA, 20 bp, Artificial Sequence
  sgRNA
actcagggcaatgtacagtg

SEQ ID NO: 23044 - DNA, 20 bp, Artificial Sequence
  sgRNA
tagtagaagacgcgtctcag

SEQ ID NO: 23045 - DNA, 20 bp, Artificial Sequence
  sgRNA
tacagtggaaactctggatg

SEQ ID NO: 23046 - DNA, 20 bp, Artificial Sequence
  sgRNA
cattccacaaagcctgactg

SEQ ID NO: 23047 - DNA, 20 bp, Artificial Sequence
  sgRNA
caatgtataaacacactatg

SEQ ID NO: 23048 - DNA, 20 bp, Artificial Sequence
  sgRNA
aaactttgagcccagccggt

SEQ ID NO: 23049 - DNA, 20 bp, Artificial Sequence
  sgRNA
ggaatggagcgagcagattg

SEQ ID NO: 23050 - DNA, 20 bp, Artificial Sequence
  sgRNA
tacacagagcaggtcagttc

SEQ ID NO: 23051 - DNA, 20 bp, Artificial Sequence
  sgRNA
gaatcggagcgggaggcctg

SEQ ID NO: 23052 - DNA, 20 bp, Artificial Sequence
  sgRNA
gtctccatatcgctccgcat

SEQ ID NO: 23053 - DNA, 20 bp, Artificial Sequence
  sgRNA
aagtgcatcttcccacacgc

SEQ ID NO: 23054 - DNA, 20 bp, Artificial Sequence
  sgRNA
caccgaaggacctaagaatc

SEQ ID NO: 23055 - DNA, 20 bp, Artificial Sequence
  sgRNA
ttcaattaagatcactgtgc

SEQ ID NO: 23056 - DNA, 20 bp, Artificial Sequence
  sgRNA
aatcgcactgtcccagggcg

SEQ ID NO: 23057 - DNA, 20 bp, Artificial Sequence
  sgRNA
ttggctagcttggccggagc

SEQ ID NO: 23058 - DNA, 20 bp, Artificial Sequence
  sgRNA
aagaagggaaagggaaagaa

SEQ ID NO: 23059 - DNA, 20 bp, Artificial Sequence
  sgRNA
attcctatgaaacagctcca

SEQ ID NO: 23060 - DNA, 20 bp, Artificial Sequence
  sgRNA
tgcccaatgaggctagtctt

SEQ ID NO: 23061 - DNA, 20 bp, Artificial Sequence
  sgRNA
catacgtcgtccctggcttc

SEQ ID NO: 23062 - DNA, 20 bp, Artificial Sequence
  sgRNA
tttggagtgaaatgtgagag

SEQ ID NO: 23063 - DNA, 20 bp, Artificial Sequence
  sgRNA
aattaaatgaagggaagtcc

SEQ ID NO: 23064 - DNA, 20 bp, Artificial Sequence
  sgRNA
tcgagttaacgtaactgcat

SEQ ID NO: 23065 - DNA, 20 bp, Artificial Sequence
  sgRNA
acaaccattgtttccatatg

SEQ ID NO: 23066 - DNA, 20 bp, Artificial Sequence
  sgRNA
agtcatgtccagaacttgtt

SEQ ID NO: 23067 - DNA, 20 bp, Artificial Sequence
  sgRNA
gttccattgccaggtatgat

SEQ ID NO: 23068 - DNA, 20 bp, Artificial Sequence
  sgRNA
acaatgcgcttgtatgaaga

SEQ ID NO: 23069 - DNA, 20 bp, Artificial Sequence
  sgRNA
ccaggacgctagccttctgg

SEQ ID NO: 23070 - DNA, 20 bp, Artificial Sequence
  sgRNA
cgcggccggccggtaaagcg

SEQ ID NO: 23071 - DNA, 20 bp, Artificial Sequence
  sgRNA
cttcaccaagcgtgcgccga

SEQ ID NO: 23072 - DNA, 20 bp, Artificial Sequence
  sgRNA
gcggactccacgtgacgtag

SEQ ID NO: 23073 - DNA, 20 bp, Artificial Sequence
  sgRNA
atactttctgtctttacatc

SEQ ID NO: 23074 - DNA, 20 bp, Artificial Sequence
  sgRNA
tagggtgaccttgtacacat

SEQ ID NO: 23075 - DNA, 20 bp, Artificial Sequence
  sgRNA
tcacacagaccacaaggaca

SEQ ID NO: 23076 - DNA, 20 bp, Artificial Sequence
  sgRNA
tagagcaaatatatacactg

SEQ ID NO: 23077 - DNA, 20 bp, Artificial Sequence
  sgRNA
gccgggtgcctgccagccat

SEQ ID NO: 23078 - DNA, 20 bp, Artificial Sequence
  sgRNA
agggacatgagtggcacttt

SEQ ID NO: 23079 - DNA, 20 bp, Artificial Sequence
  sgRNA
tctaggtcctcaatcgcaaa

SEQ ID NO: 23080 - DNA, 20 bp, Artificial Sequence
  sgRNA
gagcacacgaagtggccgct

SEQ ID NO: 23081 - DNA, 20 bp, Artificial Sequence
  sgRNA
ctgggcagggcggagcacaa

SEQ ID NO: 23082 - DNA, 20 bp, Artificial Sequence
  sgRNA
ccttccttgttacccggact

SEQ ID NO: 23083 - DNA, 20 bp, Artificial Sequence
  sgRNA
tcccgatcaaagcagcagtg

SEQ ID NO: 23084 - DNA, 20 bp, Artificial Sequence
  sgRNA
acattagattccgtattctt

SEQ ID NO: 23085 - DNA, 20 bp, Artificial Sequence
  sgRNA
agcctctgcaatcctagaca

SEQ ID NO: 23086 - DNA, 20 bp, Artificial Sequence
  sgRNA
ttctctgaggctgggcagaa

SEQ ID NO: 23087 - DNA, 20 bp, Artificial Sequence
  sgRNA
aatttataagatctatcggg

SEQ ID NO: 23088 - DNA, 20 bp, Artificial Sequence
  sgRNA
gcgggcgggtgggtgtgtcc

SEQ ID NO: 23089 - DNA, 20 bp, Artificial Sequence
  sgRNA
gctcagggtctggtcttagg

SEQ ID NO: 23090 - DNA, 20 bp, Artificial Sequence
  sgRNA
ctaggccggcctctcctgcg

SEQ ID NO: 23091 - DNA, 20 bp, Artificial Sequence
  sgRNA
tctgggcgggccctaaacta

SEQ ID NO: 23092 - DNA, 20 bp, Artificial Sequence
  sgRNA
aagagaacaggatctggtat

SEQ ID NO: 23093 - DNA, 20 bp, Artificial Sequence
  sgRNA
tcacaacaacgcatcttgaa

SEQ ID NO: 23094 - DNA, 20 bp, Artificial Sequence
  sgRNA
gtgttacaatccgacctctc

SEQ ID NO: 23095 - DNA, 20 bp, Artificial Sequence
  sgRNA
cagggagaacgcctgctccc

SEQ ID NO: 23096 - DNA, 20 bp, Artificial Sequence
  sgRNA
ctggcctcacagagcggaag

SEQ ID NO: 23097 - DNA, 20 bp, Artificial Sequence
  sgRNA
gactccatgtaagtgttaga

SEQ ID NO: 23098 - DNA, 20 bp, Artificial Sequence
  sgRNA
aatccgcacccggctagtct

SEQ ID NO: 23099 - DNA, 20 bp, Artificial Sequence
  sgRNA
tctctctttgacctaggctc

SEQ ID NO: 23100 - DNA, 20 bp, Artificial Sequence
  sgRNA
gccggccgaggcccattctg

SEQ ID NO: 23101 - DNA, 20 bp, Artificial Sequence
  sgRNA
agacaggcctcggctcacct

SEQ ID NO: 23102 - DNA, 20 bp, Artificial Sequence
  sgRNA
tgcagaagcaatgacacttg

SEQ ID NO: 23103 - DNA, 20 bp, Artificial Sequence
  sgRNA
cgccgcccttggccacaaga

SEQ ID NO: 23104 - DNA, 20 bp, Artificial Sequence
  sgRNA
atcttgagccatagtggcta

SEQ ID NO: 23105 - DNA, 20 bp, Artificial Sequence
  sgRNA
aggcagaaactgtgcactcc

SEQ ID NO: 23106 - DNA, 20 bp, Artificial Sequence
  sgRNA
aagtgtatctatagtccagt

SEQ ID NO: 23107 - DNA, 20 bp, Artificial Sequence
  sgRNA
cagcggctcagggcgctggg

SEQ ID NO: 23108 - DNA, 20 bp, Artificial Sequence
  sgRNA
atgacataggatgaatggaa

SEQ ID NO: 23109 - DNA, 20 bp, Artificial Sequence
  sgRNA
aggagacccatacgggaaga

SEQ ID NO: 23110 - DNA, 20 bp, Artificial Sequence
  sgRNA
ctccgacgagcgtgtgacac

SEQ ID NO: 23111 - DNA, 20 bp, Artificial Sequence
  sgRNA
tttgctgtcaaacctccaag

SEQ ID NO: 23112 - DNA, 20 bp, Artificial Sequence
  sgRNA
tctggaaggaatgagtactt

SEQ ID NO: 23113 - DNA, 20 bp, Artificial Sequence
  sgRNA
ttaatgccatagtgaactga

SEQ ID NO: 23114 - DNA, 20 bp, Artificial Sequence
  sgRNA
aaacaccttatttatcctag

SEQ ID NO: 23115 - DNA, 20 bp, Artificial Sequence
  sgRNA
gagagaacttcggtttctat

SEQ ID NO: 23116 - DNA, 20 bp, Artificial Sequence
  sgRNA
gctttgggttgggcgaacag

SEQ ID NO: 23117 - DNA, 20 bp, Artificial Sequence
  sgRNA
ttggtcctgtctatttgatg

SEQ ID NO: 23118 - DNA, 20 bp, Artificial Sequence
  sgRNA
ggtggagccttgcacaggga

SEQ ID NO: 23119 - DNA, 20 bp, Artificial Sequence
  sgRNA
ttccggccggcgcggagcct

SEQ ID NO: 23120 - DNA, 20 bp, Artificial Sequence
  sgRNA
attgattggcattgaagtcc

SEQ ID NO: 23121 - DNA, 20 bp, Artificial Sequence
  sgRNA
acccagtccagtttcgagtc

SEQ ID NO: 23122 - DNA, 20 bp, Artificial Sequence
  sgRNA
cagttcagaagcttccaagc

SEQ ID NO: 23123 - DNA, 20 bp, Artificial Sequence
  sgRNA
gttgccatgatgaatcatca

SEQ ID NO: 23124 - DNA, 20 bp, Artificial Sequence
  sgRNA
acccacaacagacttgcgcc

SEQ ID NO: 23125 - DNA, 20 bp, Artificial Sequence
  sgRNA
gaggagccaataggaaggcg

SEQ ID NO: 23126 - DNA, 20 bp, Artificial Sequence
  sgRNA
atataaggtgaaggctcctg

SEQ ID NO: 23127 - DNA, 20 bp, Artificial Sequence
  sgRNA
agtaacggatggacgatttc

SEQ ID NO: 23128 - DNA, 20 bp, Artificial Sequence
  sgRNA
ttgatggacgctgaccctgg

SEQ ID NO: 23129 - DNA, 20 bp, Artificial Sequence
  sgRNA
agtcctttccttcctcaggc

SEQ ID NO: 23130 - DNA, 20 bp, Artificial Sequence
  sgRNA
ggcgggaccgaggtcttggg

SEQ ID NO: 23131 - DNA, 20 bp, Artificial Sequence
  sgRNA
ctgcgcgcatgcgtgccgag

SEQ ID NO: 23132 - DNA, 20 bp, Artificial Sequence
  sgRNA
gcccagaaagcaggagtttc

SEQ ID NO: 23133 - DNA, 20 bp, Artificial Sequence
  sgRNA
ttgagaactaagtaaatcag

SEQ ID NO: 23134 - DNA, 20 bp, Artificial Sequence
  sgRNA
caatccgcgctcacttattc

SEQ ID NO: 23135 - DNA, 20 bp, Artificial Sequence
  sgRNA
aggtaacaacacgcgttcgc

SEQ ID NO: 23136 - DNA, 20 bp, Artificial Sequence
  sgRNA
acataacatggagatgaagt

SEQ ID NO: 23137 - DNA, 20 bp, Artificial Sequence
  sgRNA
gtaatctaggtaggtccttg

SEQ ID NO: 23138 - DNA, 20 bp, Artificial Sequence
  sgRNA
tatggtctcgatctctcctc

SEQ ID NO: 23139 - DNA, 20 bp, Artificial Sequence
  sgRNA
aggagacgctgctgctccgc

SEQ ID NO: 23140 - DNA, 20 bp, Artificial Sequence
  sgRNA
ggagacaaatcaatacatta

SEQ ID NO: 23141 - DNA, 20 bp, Artificial Sequence
  sgRNA
catactaaagatggccactg

SEQ ID NO: 23142 - DNA, 20 bp, Artificial Sequence
  sgRNA
caatctgcacaggactttag

SEQ ID NO: 23143 - DNA, 20 bp, Artificial Sequence
  sgRNA
cacagatcagttaatcgagg

SEQ ID NO: 23144 - DNA, 20 bp, Artificial Sequence
  sgRNA
tcagtattcaacaagtgctc

SEQ ID NO: 23145 - DNA, 20 bp, Artificial Sequence
  sgRNA
tatacaccagtgtcctctca

SEQ ID NO: 23146 - DNA, 20 bp, Artificial Sequence
  sgRNA
ataaactctttctttgccag

SEQ ID NO: 23147 - DNA, 20 bp, Artificial Sequence
  sgRNA
ttaatgtgaaacactttgtc

SEQ ID NO: 23148 - DNA, 20 bp, Artificial Sequence
  sgRNA
gaggatcagcgcaaacgtgg

SEQ ID NO: 23149 - DNA, 20 bp, Artificial Sequence
  sgRNA
gcttacattgtactctaaat

SEQ ID NO: 23150 - DNA, 20 bp, Artificial Sequence
  sgRNA
atgctcagtaagctagctga

SEQ ID NO: 23151 - DNA, 20 bp, Artificial Sequence
  sgRNA
atatacaactttgagctctc

SEQ ID NO: 23152 - DNA, 20 bp, Artificial Sequence
  sgRNA
aggtccatttctgtttgcag

SEQ ID NO: 23153 - DNA, 20 bp, Artificial Sequence
  sgRNA
cccggcggccgcctgcggct

SEQ ID NO: 23154 - DNA, 20 bp, Artificial Sequence
  sgRNA
gtggaatgttgaagagggct

SEQ ID NO: 23155 - DNA, 20 bp, Artificial Sequence
  sgRNA
gccgcagctatataagtggg

SEQ ID NO: 23156 - DNA, 20 bp, Artificial Sequence
  sgRNA
ggaggagagagcaatgcagt

SEQ ID NO: 23157 - DNA, 20 bp, Artificial Sequence
  sgRNA
cagtattcctgatgcagtaa

SEQ ID NO: 23158 - DNA, 20 bp, Artificial Sequence
  sgRNA
ggagggtggaaagaaaggag

SEQ ID NO: 23159 - DNA, 20 bp, Artificial Sequence
  sgRNA
gccctacagcgcagcgtgcc

SEQ ID NO: 23160 - DNA, 20 bp, Artificial Sequence
  sgRNA
ttcctaggataatgtgatgc

SEQ ID NO: 23161 - DNA, 20 bp, Artificial Sequence
  sgRNA
ataatgtctttgctgtggga

SEQ ID NO: 23162 - DNA, 20 bp, Artificial Sequence
  sgRNA
gtctataaggaggagtgcgg

SEQ ID NO: 23163 - DNA, 20 bp, Artificial Sequence
  sgRNA
aggtgacacggcagcagagg

SEQ ID NO: 23164 - DNA, 20 bp, Artificial Sequence
  sgRNA
ctcacaaagacagcagtgaa

SEQ ID NO: 23165 - DNA, 20 bp, Artificial Sequence
  sgRNA
ctacagcaagtagacagaca

SEQ ID NO: 23166 - DNA, 20 bp, Artificial Sequence
  sgRNA
tgtgtgtgtgtgtgtgtgtt

SEQ ID NO: 23167 - DNA, 20 bp, Artificial Sequence
  sgRNA
cccgaggcaatgcaatgtaa

SEQ ID NO: 23168 - DNA, 20 bp, Artificial Sequence
  sgRNA
ggcaggactgggatggaata

SEQ ID NO: 23169 - DNA, 20 bp, Artificial Sequence
  sgRNA
tatcaagtattgcaatgtcc

SEQ ID NO: 23170 - DNA, 20 bp, Artificial Sequence
  sgRNA
agcacgcaggcgcgccgatg

SEQ ID NO: 23171 - DNA, 20 bp, Artificial Sequence
  sgRNA
cctgtagaaatgagaattaa

SEQ ID NO: 23172 - DNA, 20 bp, Artificial Sequence
  sgRNA
ccctcttggccatttgtcat

SEQ ID NO: 23173 - DNA, 20 bp, Artificial Sequence
  sgRNA
ggtccactgctatgtctttc

SEQ ID NO: 23174 - DNA, 20 bp, Artificial Sequence
  sgRNA
gttaggagtaagaaatcaga

SEQ ID NO: 23175 - DNA, 20 bp, Artificial Sequence
  sgRNA
gccctgcagagagggcggtc

SEQ ID NO: 23176 - DNA, 20 bp, Artificial Sequence
  sgRNA
gggactgtcacgtgttcccg

SEQ ID NO: 23177 - DNA, 20 bp, Artificial Sequence
  sgRNA
ttaagaggtgactcatggaa

SEQ ID NO: 23178 - DNA, 20 bp, Artificial Sequence
  sgRNA
ggcaaagaatttaaagcgca

SEQ ID NO: 23179 - DNA, 20 bp, Artificial Sequence
  sgRNA
cactggagtttctatatcca

SEQ ID NO: 23180 - DNA, 20 bp, Artificial Sequence
  sgRNA
gccaacaataacggttgttc

SEQ ID NO: 23181 - DNA, 20 bp, Artificial Sequence
  sgRNA
atagtttagttcatgggtct

SEQ ID NO: 23182 - DNA, 20 bp, Artificial Sequence
  sgRNA
tcaagctctgcagtgacacc

SEQ ID NO: 23183 - DNA, 20 bp, Artificial Sequence
  sgRNA
gcaattgtcatttcacttca

SEQ ID NO: 23184 - DNA, 20 bp, Artificial Sequence
  sgRNA
tcctgagcgtttcgggaacc

SEQ ID NO: 23185 - DNA, 20 bp, Artificial Sequence
  sgRNA
aattctcaaggcgcgatgga

SEQ ID NO: 23186 - DNA, 20 bp, Artificial Sequence
  sgRNA
acactcatctccaggaactg

SEQ ID NO: 23187 - DNA, 20 bp, Artificial Sequence
  sgRNA
cagtttgtaacgtaccctgc

SEQ ID NO: 23188 - DNA, 20 bp, Artificial Sequence
  sgRNA
gggccaaagatctgaaagag

SEQ ID NO: 23189 - DNA, 20 bp, Artificial Sequence
  sgRNA
gagcaccggaccgagcgccc

SEQ ID NO: 23190 - DNA, 20 bp, Artificial Sequence
  sgRNA
cagattcgccacgacgtcgt

SEQ ID NO: 23191 - DNA, 20 bp, Artificial Sequence
  sgRNA
ctgaggaagagtgactgcgc

SEQ ID NO: 23192 - DNA, 20 bp, Artificial Sequence
  sgRNA
atactgcccaggctcagaac

SEQ ID NO: 23193 - DNA, 20 bp, Artificial Sequence
  sgRNA
ggacactgcacgagccaatc

SEQ ID NO: 23194 - DNA, 20 bp, Artificial Sequence
  sgRNA
caaacctcctaggaagcttt

SEQ ID NO: 23195 - DNA, 20 bp, Artificial Sequence
  sgRNA
cgtaagtcagcttaagctgg

SEQ ID NO: 23196 - DNA, 20 bp, Artificial Sequence
  sgRNA
ttcgcgagacgtgtggtggg

SEQ ID NO: 23197 - DNA, 20 bp, Artificial Sequence
  sgRNA
aacagaatgtgcatataagt

SEQ ID NO: 23198 - DNA, 20 bp, Artificial Sequence
  sgRNA
tcggttgcactgcagagctc

SEQ ID NO: 23199 - DNA, 20 bp, Artificial Sequence
  sgRNA
gtgcctgggagaaagtgttg

SEQ ID NO: 23200 - DNA, 20 bp, Artificial Sequence
  sgRNA
cattaaacacagcatcatta

SEQ ID NO: 23201 - DNA, 20 bp, Artificial Sequence
  sgRNA
aagacaagacgaggagcggt

SEQ ID NO: 23202 - DNA, 20 bp, Artificial Sequence
  sgRNA
ccttcctacaggcaggtact

SEQ ID NO: 23203 - DNA, 20 bp, Artificial Sequence
  sgRNA
tagaatagcagaaagcattc

SEQ ID NO: 23204 - DNA, 20 bp, Artificial Sequence
  sgRNA
tacccagagcctactagacc

SEQ ID NO: 23205 - DNA, 20 bp, Artificial Sequence
  sgRNA
gttaaggatgatgtcactcc

SEQ ID NO: 23206 - DNA, 20 bp, Artificial Sequence
  sgRNA
gcagtgttctgcatcccagt

SEQ ID NO: 23207 - DNA, 20 bp, Artificial Sequence
  sgRNA
aatgtgattggccttaccca

SEQ ID NO: 23208 - DNA, 20 bp, Artificial Sequence
  sgRNA
catcggtcgggtagttgcca

SEQ ID NO: 23209 - DNA, 20 bp, Artificial Sequence
  sgRNA
tccatccctgtagttggacg

SEQ ID NO: 23210 - DNA, 20 bp, Artificial Sequence
  sgRNA
tggaccgagtccgccttaat

SEQ ID NO: 23211 - DNA, 20 bp, Artificial Sequence
  sgRNA
gctccgcggtgctccaatcc

SEQ ID NO: 23212 - DNA, 20 bp, Artificial Sequence
  sgRNA
ggtcagcatgtattctccaa

SEQ ID NO: 23213 - DNA, 20 bp, Artificial Sequence
  sgRNA
tgctctgagaaccctgcgcg

SEQ ID NO: 23214 - DNA, 20 bp, Artificial Sequence
  sgRNA
ttggcaaatacagagtgtcc

SEQ ID NO: 23215 - DNA, 20 bp, Artificial Sequence
  sgRNA
ggcaataaagaaacacaagt

SEQ ID NO: 23216 - DNA, 20 bp, Artificial Sequence
  sgRNA
caccataacaattgggacta

SEQ ID NO: 23217 - DNA, 20 bp, Artificial Sequence
  sgRNA
gggtgttggtctagagcttc

SEQ ID NO: 23218 - DNA, 20 bp, Artificial Sequence
  sgRNA
cgtccgcacatttgtcttca

SEQ ID NO: 23219 - DNA, 20 bp, Artificial Sequence
  sgRNA
gcacggaccggcacgaacgg

SEQ ID NO: 23220 - DNA, 20 bp, Artificial Sequence
  sgRNA
cggactctaccctcgcgtgc

SEQ ID NO: 23221 - DNA, 20 bp, Artificial Sequence
  sgRNA
aggcctgtcatgggccaggg

SEQ ID NO: 23222 - DNA, 20 bp, Artificial Sequence
  sgRNA
attgaattattcttggagca

SEQ ID NO: 23223 - DNA, 20 bp, Artificial Sequence
  sgRNA
tggaggtgttggaggcgccg

SEQ ID NO: 23224 - DNA, 20 bp, Artificial Sequence
  sgRNA
tgagcaggcgcaaagcacgc

SEQ ID NO: 23225 - DNA, 20 bp, Artificial Sequence
  sgRNA
gatgctgcggagcagctgac

SEQ ID NO: 23226 - DNA, 20 bp, Artificial Sequence
  sgRNA
cagattgctcctggccctgt

SEQ ID NO: 23227 - DNA, 20 bp, Artificial Sequence
  sgRNA
ccggtattctctaaaggtta

SEQ ID NO: 23228 - DNA, 20 bp, Artificial Sequence
  sgRNA
ggcaaccgggcggccagaag

SEQ ID NO: 23229 - DNA, 20 bp, Artificial Sequence
  sgRNA
ttgcccagcctgactcacag

SEQ ID NO: 23230 - DNA, 20 bp, Artificial Sequence
  sgRNA
tcgcggatgtgaagtcaact

SEQ ID NO: 23231 - DNA, 20 bp, Artificial Sequence
  sgRNA
actgtggaccttctttgtag

SEQ ID NO: 23232 - DNA, 20 bp, Artificial Sequence
  sgRNA
tattcaccttaagcacatag

SEQ ID NO: 23233 - DNA, 20 bp, Artificial Sequence
  sgRNA
aggtccatgtttactcattg

SEQ ID NO: 23234 - DNA, 20 bp, Artificial Sequence
  sgRNA
cggaaggaaggacgccggcc

SEQ ID NO: 23235 - DNA, 20 bp, Artificial Sequence
  sgRNA
gagagttagaggagagtaag

SEQ ID NO: 23236 - DNA, 20 bp, Artificial Sequence
  sgRNA
agggacttcctggaatttcc

SEQ ID NO: 23237 - DNA, 20 bp, Artificial Sequence
  sgRNA
tagcattggaaatgtaaatg

SEQ ID NO: 23238 - DNA, 20 bp, Artificial Sequence
  sgRNA
gtccctaccgccgccatcag

SEQ ID NO: 23239 - DNA, 20 bp, Artificial Sequence
  sgRNA
tggatcgaggagagtggtac

SEQ ID NO: 23240 - DNA, 20 bp, Artificial Sequence
  sgRNA
cgatggttagtgagtccaag

SEQ ID NO: 23241 - DNA, 20 bp, Artificial Sequence
  sgRNA
tccctcccaagcaagcaatc

SEQ ID NO: 23242 - DNA, 20 bp, Artificial Sequence
  sgRNA
gcggcgtgagcgccgggctc

SEQ ID NO: 23243 - DNA, 20 bp, Artificial Sequence
  sgRNA
gaacttggagccagttgctg

SEQ ID NO: 23244 - DNA, 20 bp, Artificial Sequence
  sgRNA
acaagtcaagaatattagga

SEQ ID NO: 23245 - DNA, 20 bp, Artificial Sequence
  sgRNA
agggcctgcgcctttaatct

SEQ ID NO: 23246 - DNA, 20 bp, Artificial Sequence
  sgRNA
cgcatcaacagcttgttacc

SEQ ID NO: 23247 - DNA, 20 bp, Artificial Sequence
  sgRNA
tatatggtgggcagtcaaca

SEQ ID NO: 23248 - DNA, 20 bp, Artificial Sequence
  sgRNA
gtgcagagcagtgggcgagc

SEQ ID NO: 23249 - DNA, 20 bp, Artificial Sequence
  sgRNA
gatgtcagttatcaattaac

SEQ ID NO: 23250 - DNA, 20 bp, Artificial Sequence
  sgRNA
tgaaatgtgagtaaattgac

SEQ ID NO: 23251 - DNA, 20 bp, Artificial Sequence
  sgRNA
tgcgcaataaagctgactgt

SEQ ID NO: 23252 - DNA, 20 bp, Artificial Sequence
  sgRNA
aatgggaagcattgcagtta

SEQ ID NO: 23253 - DNA, 20 bp, Artificial Sequence
  sgRNA
tgtcatgtttctgaaatctg

SEQ ID NO: 23254 - DNA, 20 bp, Artificial Sequence
  sgRNA
cgagtttctgggcagatcag

SEQ ID NO: 23255 - DNA, 20 bp, Artificial Sequence
  sgRNA
ctgctctgcaaggtatgacc

SEQ ID NO: 23256 - DNA, 20 bp, Artificial Sequence
  sgRNA
tcctctcctactccacaccg

SEQ ID NO: 23257 - DNA, 20 bp, Artificial Sequence
  sgRNA
ttcacaggttgcagttaact

SEQ ID NO: 23258 - DNA, 20 bp, Artificial Sequence
  sgRNA
tcctcacctcgcagtagatg

SEQ ID NO: 23259 - DNA, 20 bp, Artificial Sequence
  sgRNA
cctcttctgctgtgaatgaa

SEQ ID NO: 23260 - DNA, 20 bp, Artificial Sequence
  sgRNA
gtactacacaggatacatgg

SEQ ID NO: 23261 - DNA, 20 bp, Artificial Sequence
  sgRNA
agcgtgcagaacctgccttc

SEQ ID NO: 23262 - DNA, 20 bp, Artificial Sequence
  sgRNA
gggctcggtgcgtaatggtg

SEQ ID NO: 23263 - DNA, 20 bp, Artificial Sequence
  sgRNA
attagcgttctagttaggat

SEQ ID NO: 23264 - DNA, 20 bp, Artificial Sequence
  sgRNA
agccactgttcaacggctcc

SEQ ID NO: 23265 - DNA, 20 bp, Artificial Sequence
  sgRNA
tcatctgcttatgactttaa

SEQ ID NO: 23266 - DNA, 20 bp, Artificial Sequence
  sgRNA
cacatacttagtctcaacta

SEQ ID NO: 23267 - DNA, 20 bp, Artificial Sequence
  sgRNA
gacattcattcatgtgatca

SEQ ID NO: 23268 - DNA, 20 bp, Artificial Sequence
  sgRNA
gacttgcatcagaggtttct

SEQ ID NO: 23269 - DNA, 20 bp, Artificial Sequence
  sgRNA
aacgaacgcggcagccttac

SEQ ID NO: 23270 - DNA, 20 bp, Artificial Sequence
  sgRNA
cgtgaactttgtcatttgac

SEQ ID NO: 23271 - DNA, 20 bp, Artificial Sequence
  sgRNA
gtcgtgcaggacgtgacaaa

SEQ ID NO: 23272 - DNA, 20 bp, Artificial Sequence
  sgRNA
cttccagcacgtacattaag

SEQ ID NO: 23273 - DNA, 20 bp, Artificial Sequence
  sgRNA
gggcgggacatgtctaagcg

SEQ ID NO: 23274 - DNA, 20 bp, Artificial Sequence
  sgRNA
tttgaatgagctgttatgat

SEQ ID NO: 23275 - DNA, 20 bp, Artificial Sequence
  sgRNA
tgggcctgttctgcactttg

SEQ ID NO: 23276 - DNA, 20 bp, Artificial Sequence
  sgRNA
acgccaagcgatgtgaagcc

SEQ ID NO: 23277 - DNA, 20 bp, Artificial Sequence
  sgRNA
tatgagctgtgggtgtgaag

SEQ ID NO: 23278 - DNA, 20 bp, Artificial Sequence
  sgRNA
ttcacctgtagcatttagcc

SEQ ID NO: 23279 - DNA, 20 bp, Artificial Sequence
  sgRNA
gcgggcgcgaagtcggaccc

SEQ ID NO: 23280 - DNA, 20 bp, Artificial Sequence
  sgRNA
tctcttccaaacaacttgat

SEQ ID NO: 23281 - DNA, 20 bp, Artificial Sequence
  sgRNA
cacttatgtcctttacttaa

SEQ ID NO: 23282 - DNA, 20 bp, Artificial Sequence
  sgRNA
aacacctgccagatattgct

SEQ ID NO: 23283 - DNA, 20 bp, Artificial Sequence
  sgRNA
gggatagggcaactgacatg

SEQ ID NO: 23284 - DNA, 20 bp, Artificial Sequence
  sgRNA
acactatcacttgaagtcgt

SEQ ID NO: 23285 - DNA, 20 bp, Artificial Sequence
  sgRNA
tcgcgaggcttgtcgctcag

SEQ ID NO: 23286 - DNA, 20 bp, Artificial Sequence
  sgRNA
gccagaagtgtctgtaccag

SEQ ID NO: 23287 - DNA, 20 bp, Artificial Sequence
  sgRNA
aggagacatagtacgcttac

SEQ ID NO: 23288 - DNA, 20 bp, Artificial Sequence
  sgRNA
agttgtcctttaatgaacgg

SEQ ID NO: 23289 - DNA, 20 bp, Artificial Sequence
  sgRNA
ctagtcagcagggtcatagt

SEQ ID NO: 23290 - DNA, 20 bp, Artificial Sequence
  sgRNA
caagggcggagctgaagaaa

SEQ ID NO: 23291 - DNA, 20 bp, Artificial Sequence
  sgRNA
agaagcacagaagatactag

SEQ ID NO: 23292 - DNA, 20 bp, Artificial Sequence
  sgRNA
gcttgtctaaataaagtgtg

SEQ ID NO: 23293 - DNA, 20 bp, Artificial Sequence
  sgRNA
gggcgccgcggtcctgtctg

SEQ ID NO: 23294 - DNA, 20 bp, Artificial Sequence
  sgRNA
gacgcaatggcacgctccac

SEQ ID NO: 23295 - DNA, 20 bp, Artificial Sequence
  sgRNA
ctgccttcgctgaggcgcgc

SEQ ID NO: 23296 - DNA, 20 bp, Artificial Sequence
  sgRNA
cctgctttaagttgtataat

SEQ ID NO: 23297 - DNA, 20 bp, Artificial Sequence
  sgRNA
tgaacagttcatactagaga

SEQ ID NO: 23298 - DNA, 20 bp, Artificial Sequence
  sgRNA
tcatggtttgcactggtcaa

SEQ ID NO: 23299 - DNA, 20 bp, Artificial Sequence
  sgRNA
caaccctgaactaaaggtgg

SEQ ID NO: 23300 - DNA, 20 bp, Artificial Sequence
  sgRNA
taggcgcaagccaatgaggc

SEQ ID NO: 23301 - DNA, 20 bp, Artificial Sequence
  sgRNA
agtctgctgaggccaatcgt

SEQ ID NO: 23302 - DNA, 20 bp, Artificial Sequence
  sgRNA
taatataatctgttcgacac

SEQ ID NO: 23303 - DNA, 20 bp, Artificial Sequence
  sgRNA
tggctatctggtattggtcg

SEQ ID NO: 23304 - DNA, 20 bp, Artificial Sequence
  sgRNA
aaggtttgtgctggtgccta

SEQ ID NO: 23305 - DNA, 20 bp, Artificial Sequence
  sgRNA
ggacctaagtgggagccgga

SEQ ID NO: 23306 - DNA, 20 bp, Artificial Sequence
  sgRNA
gcacactttacttatcctac

SEQ ID NO: 23307 - DNA, 20 bp, Artificial Sequence
  sgRNA
aggctcacccgcaggcgctc

SEQ ID NO: 23308 - DNA, 20 bp, Artificial Sequence
  sgRNA
ggtagaagacatatctgtct

SEQ ID NO: 23309 - DNA, 20 bp, Artificial Sequence
  sgRNA
ttcaaggaagttcatatggg

SEQ ID NO: 23310 - DNA, 20 bp, Artificial Sequence
  sgRNA
agctcgttgactgtgctgat

SEQ ID NO: 23311 - DNA, 20 bp, Artificial Sequence
  sgRNA
aactctaggaaattggcaga

SEQ ID NO: 23312 - DNA, 20 bp, Artificial Sequence
  sgRNA
tataaatcaaaggtaagcag

SEQ ID NO: 23313 - DNA, 20 bp, Artificial Sequence
  sgRNA
cgagcagttgactggtttcc

SEQ ID NO: 23314 - DNA, 20 bp, Artificial Sequence
  sgRNA
aaggaaagaagaagagagaa

SEQ ID NO: 23315 - DNA, 20 bp, Artificial Sequence
  sgRNA
ttggttatttggagagcctt

SEQ ID NO: 23316 - DNA, 20 bp, Artificial Sequence
  sgRNA
aaggaagggcacaaacctcg

SEQ ID NO: 23317 - DNA, 20 bp, Artificial Sequence
  sgRNA
tagggcttggtgggactgta

SEQ ID NO: 23318 - DNA, 20 bp, Artificial Sequence
  sgRNA
tgccattaccaactgtaaag

SEQ ID NO: 23319 - DNA, 20 bp, Artificial Sequence
  sgRNA
gctgtgccgcgggcaactcc

SEQ ID NO: 23320 - DNA, 20 bp, Artificial Sequence
  sgRNA
atttatttagcagggtctta

SEQ ID NO: 23321 - DNA, 20 bp, Artificial Sequence
  sgRNA
ccctccctgatacaggcgcg

SEQ ID NO: 23322 - DNA, 20 bp, Artificial Sequence
  sgRNA
ttgtagagattataacgctc

SEQ ID NO: 23323 - DNA, 20 bp, Artificial Sequence
  sgRNA
ccctcctcctggctgtgtgg

SEQ ID NO: 23324 - DNA, 20 bp, Artificial Sequence
  sgRNA
ggaagcgagtgtgccaacgc

SEQ ID NO: 23325 - DNA, 20 bp, Artificial Sequence
  sgRNA
acctagctctggtgctcttt

SEQ ID NO: 23326 - DNA, 20 bp, Artificial Sequence
  sgRNA
ttgcgtctagagcggctcct

SEQ ID NO: 23327 - DNA, 20 bp, Artificial Sequence
  sgRNA
ggtggtcgggctctagccta

SEQ ID NO: 23328 - DNA, 20 bp, Artificial Sequence
  sgRNA
tccctgggcgcctgagcaaa

SEQ ID NO: 23329 - DNA, 20 bp, Artificial Sequence
  sgRNA
gcaattggactttatgggct

SEQ ID NO: 23330 - DNA, 20 bp, Artificial Sequence
  sgRNA
gtctgacctgaggagtcgcc

SEQ ID NO: 23331 - DNA, 20 bp, Artificial Sequence
  sgRNA
tagttacaaacagcaccctt

SEQ ID NO: 23332 - DNA, 20 bp, Artificial Sequence
  sgRNA
accaagactcagtaagaatg

SEQ ID NO: 23333 - DNA, 20 bp, Artificial Sequence
  sgRNA
tttaactgacacccaacttt

SEQ ID NO: 23334 - DNA, 20 bp, Artificial Sequence
  sgRNA
catctgtttgctggagccgc

SEQ ID NO: 23335 - DNA, 20 bp, Artificial Sequence
  sgRNA
cagctgacagtttcagctac

SEQ ID NO: 23336 - DNA, 20 bp, Artificial Sequence
  sgRNA
tcagtctcttggcctgttca

SEQ ID NO: 23337 - DNA, 20 bp, Artificial Sequence
  sgRNA
ttgtttaatgcttgcctgtc

SEQ ID NO: 23338 - DNA, 20 bp, Artificial Sequence
  sgRNA
tgcggtcccacccggccgag

SEQ ID NO: 23339 - DNA, 20 bp, Artificial Sequence
  sgRNA
acaagatcctggcatagtgg

SEQ ID NO: 23340 - DNA, 20 bp, Artificial Sequence
  sgRNA
ctccacccagggcagctatt

SEQ ID NO: 23341 - DNA, 20 bp, Artificial Sequence
  sgRNA
gcgctccttcccacaacgag

SEQ ID NO: 23342 - DNA, 20 bp, Artificial Sequence
  sgRNA
cgcgctgtggcgtgattggg

SEQ ID NO: 23343 - DNA, 20 bp, Artificial Sequence
  sgRNA
tttatggatgaatcagctcc

SEQ ID NO: 23344 - DNA, 20 bp, Artificial Sequence
  sgRNA
gagaagcccgggaggtgctc

SEQ ID NO: 23345 - DNA, 20 bp, Artificial Sequence
  sgRNA
agatcacccgcctaccgtgg

SEQ ID NO: 23346 - DNA, 20 bp, Artificial Sequence
  sgRNA
cctctaactttagagagcgg

SEQ ID NO: 23347 - DNA, 20 bp, Artificial Sequence
  sgRNA
ccattatgaagacaaagtgt

SEQ ID NO: 23348 - DNA, 20 bp, Artificial Sequence
  sgRNA
atagtgtcctagcaactgga

SEQ ID NO: 23349 - DNA, 20 bp, Artificial Sequence
  sgRNA
ggttgtaaattaagtcatga

SEQ ID NO: 23350 - DNA, 20 bp, Artificial Sequence
  sgRNA
tcacaaagcaccttgctgcc

SEQ ID NO: 23351 - DNA, 20 bp, Artificial Sequence
  sgRNA
ctgatcacttgacaagaggc

SEQ ID NO: 23352 - DNA, 20 bp, Artificial Sequence
  sgRNA
ggtctgtagctaaggaatta

SEQ ID NO: 23353 - DNA, 20 bp, Artificial Sequence
  sgRNA
tggcaccgccgcttcggttg

SEQ ID NO: 23354 - DNA, 20 bp, Artificial Sequence
  sgRNA
gggcgcgtcacggctacgcc

SEQ ID NO: 23355 - DNA, 20 bp, Artificial Sequence
  sgRNA
ggataatccacactccatgc

SEQ ID NO: 23356 - DNA, 20 bp, Artificial Sequence
  sgRNA
aaagctattaactttgtctg

SEQ ID NO: 23357 - DNA, 20 bp, Artificial Sequence
  sgRNA
catgattccattagccagtt

SEQ ID NO: 23358 - DNA, 20 bp, Artificial Sequence
  sgRNA
caaggcgcctcctggtgatt

SEQ ID NO: 23359 - DNA, 20 bp, Artificial Sequence
  sgRNA
ttctgggccacctcccattc

SEQ ID NO: 23360 - DNA, 20 bp, Artificial Sequence
  sgRNA
gtgtgttcgccatggccacc

SEQ ID NO: 23361 - DNA, 20 bp, Artificial Sequence
  sgRNA
aggttatgaacctccagcta

SEQ ID NO: 23362 - DNA, 20 bp, Artificial Sequence
  sgRNA
tcctttataggagatctgta

SEQ ID NO: 23363 - DNA, 20 bp, Artificial Sequence
  sgRNA
gtttcaattcacttgatgtg

SEQ ID NO: 23364 - DNA, 20 bp, Artificial Sequence
  sgRNA
cttattgagttaggttgctg

SEQ ID NO: 23365 - DNA, 20 bp, Artificial Sequence
  sgRNA
gatacttgggctttggccta

SEQ ID NO: 23366 - DNA, 20 bp, Artificial Sequence
  sgRNA
gggccgctccaggcggtagg

SEQ ID NO: 23367 - DNA, 20 bp, Artificial Sequence
  sgRNA
tatattcccattctatcctt

SEQ ID NO: 23368 - DNA, 20 bp, Artificial Sequence
  sgRNA
ttctcaagcacctatcttga

SEQ ID NO: 23369 - DNA, 20 bp, Artificial Sequence
  sgRNA
gcgcttccgtcacagcggta

SEQ ID NO: 23370 - DNA, 20 bp, Artificial Sequence
  sgRNA
cgaaggctccgcgttcgatt

SEQ ID NO: 23371 - DNA, 20 bp, Artificial Sequence
  sgRNA
tttcatggtttgacaacacc

SEQ ID NO: 23372 - DNA, 20 bp, Artificial Sequence
  sgRNA
ggtaacgaatctgcgtctaa

SEQ ID NO: 23373 - DNA, 20 bp, Artificial Sequence
  sgRNA
gggcctttgccagtcagagc

SEQ ID NO: 23374 - DNA, 20 bp, Artificial Sequence
  sgRNA
gtcatccgggattaaaggtg

SEQ ID NO: 23375 - DNA, 20 bp, Artificial Sequence
  sgRNA
ccggagctgccaccggtctt

SEQ ID NO: 23376 - DNA, 20 bp, Artificial Sequence
  sgRNA
accagacaccatcacttcta

SEQ ID NO: 23377 - DNA, 20 bp, Artificial Sequence
  sgRNA
atccagcgaactacagccaa

SEQ ID NO: 23378 - DNA, 20 bp, Artificial Sequence
  sgRNA
ccttgggctgagaggccggg

SEQ ID NO: 23379 - DNA, 20 bp, Artificial Sequence
  sgRNA
acactattacctgaattcca

SEQ ID NO: 23380 - DNA, 20 bp, Artificial Sequence
  sgRNA
gcatttccagtgctgttgat

SEQ ID NO: 23381 - DNA, 20 bp, Artificial Sequence
  sgRNA
ggcaggcgacacgtcgcaag

SEQ ID NO: 23382 - DNA, 20 bp, Artificial Sequence
  sgRNA
ggagacgaagtgaggaacca

SEQ ID NO: 23383 - DNA, 20 bp, Artificial Sequence
  sgRNA
gatgtaacaaagccctctca

SEQ ID NO: 23384 - DNA, 20 bp, Artificial Sequence
  sgRNA
aataccaagctccgggcccg

SEQ ID NO: 23385 - DNA, 20 bp, Artificial Sequence
  sgRNA
gggaccttaattctagccaa

SEQ ID NO: 23386 - DNA, 20 bp, Artificial Sequence
  sgRNA
cttaacagggaacctgggaa

SEQ ID NO: 23387 - DNA, 20 bp, Artificial Sequence
  sgRNA
tggtgcttctcaaactactg

SEQ ID NO: 23388 - DNA, 20 bp, Artificial Sequence
  sgRNA
gaggactgtcaactgtcgcc

SEQ ID NO: 23389 - DNA, 20 bp, Artificial Sequence
  sgRNA
atgagttactggactcctct

SEQ ID NO: 23390 - DNA, 20 bp, Artificial Sequence
  sgRNA
tgggtggtacttgatgtgtt

SEQ ID NO: 23391 - DNA, 20 bp, Artificial Sequence
  sgRNA
gtaatctctctgagactgct

SEQ ID NO: 23392 - DNA, 20 bp, Artificial Sequence
  sgRNA
attcaatggcattagctgaa

SEQ ID NO: 23393 - DNA, 20 bp, Artificial Sequence
  sgRNA
ccgtgtgcactcgcgaccaa

SEQ ID NO: 23394 - DNA, 20 bp, Artificial Sequence
  sgRNA
gctcagtgacgcttaaagac

SEQ ID NO: 23395 - DNA, 20 bp, Artificial Sequence
  sgRNA
tgtggcagggataaagcaaa

SEQ ID NO: 23396 - DNA, 20 bp, Artificial Sequence
  sgRNA
gggttagcccagctgtattt

SEQ ID NO: 23397 - DNA, 20 bp, Artificial Sequence
  sgRNA
tggcatgtgaattcctctct

SEQ ID NO: 23398 - DNA, 20 bp, Artificial Sequence
  sgRNA
gggagatcacctgtagacaa

SEQ ID NO: 23399 - DNA, 20 bp, Artificial Sequence
  sgRNA
ccacaacatctatctcatag

SEQ ID NO: 23400 - DNA, 20 bp, Artificial Sequence
  sgRNA
cttcgtcgcttccgcgggcc

SEQ ID NO: 23401 - DNA, 20 bp, Artificial Sequence
  sgRNA
cacatctcacactgcactca

SEQ ID NO: 23402 - DNA, 20 bp, Artificial Sequence
  sgRNA
agggacgctcagtgggtctc

SEQ ID NO: 23403 - DNA, 20 bp, Artificial Sequence
  sgRNA
tttccataaataacaaggga

SEQ ID NO: 23404 - DNA, 20 bp, Artificial Sequence
  sgRNA
tgcagtcgagaggccgactt

SEQ ID NO: 23405 - DNA, 20 bp, Artificial Sequence
  sgRNA
tggaagactgttacattcag

SEQ ID NO: 23406 - DNA, 20 bp, Artificial Sequence
  sgRNA
ccgctgactaagttcgcgcg

SEQ ID NO: 23407 - DNA, 20 bp, Artificial Sequence
  sgRNA
atttcagcatctagcccaca

SEQ ID NO: 23408 - DNA, 20 bp, Artificial Sequence
  sgRNA
gtggcagtacctctttctgc

SEQ ID NO: 23409 - DNA, 20 bp, Artificial Sequence
  sgRNA
gagggtccgagacgaagacg

SEQ ID NO: 23410 - DNA, 20 bp, Artificial Sequence
  sgRNA
aagtgactccgaacaggaag

SEQ ID NO: 23411 - DNA, 20 bp, Artificial Sequence
  sgRNA
aatgatctcacaataggagg

SEQ ID NO: 23412 - DNA, 20 bp, Artificial Sequence
  sgRNA
gagagtgtattcatcttaag

SEQ ID NO: 23413 - DNA, 20 bp, Artificial Sequence
  sgRNA
aacaatgcaaagttccacag

SEQ ID NO: 23414 - DNA, 20 bp, Artificial Sequence
  sgRNA
tgagatgattaacttgctca

SEQ ID NO: 23415 - DNA, 20 bp, Artificial Sequence
  sgRNA
aaacccgggtgacgggtctg

SEQ ID NO: 23416 - DNA, 20 bp, Artificial Sequence
  sgRNA
gctgagtcgcggttgaagca

SEQ ID NO: 23417 - DNA, 20 bp, Artificial Sequence
  sgRNA
ttgatttatatgctcacgtg

SEQ ID NO: 23418 - DNA, 20 bp, Artificial Sequence
  sgRNA
tgcaaatgattcagagcact

SEQ ID NO: 23419 - DNA, 20 bp, Artificial Sequence
  sgRNA
acgcagctgctctgcaagtt

SEQ ID NO: 23420 - DNA, 20 bp, Artificial Sequence
  sgRNA
ggctgaaggcgggctctaca

SEQ ID NO: 23421 - DNA, 20 bp, Artificial Sequence
  sgRNA
tcagttacgtgagccagccc

SEQ ID NO: 23422 - DNA, 20 bp, Artificial Sequence
  sgRNA
tcacaggtactaggagctca

SEQ ID NO: 23423 - DNA, 20 bp, Artificial Sequence
  sgRNA
gggagggtgacagttggtca

SEQ ID NO: 23424 - DNA, 20 bp, Artificial Sequence
  sgRNA
gaatcatcttagcagtgcag

SEQ ID NO: 23425 - DNA, 20 bp, Artificial Sequence
  sgRNA
tgatgaaacagagtggcctg

SEQ ID NO: 23426 - DNA, 20 bp, Artificial Sequence
  sgRNA
tacaggaaaggatttataag

SEQ ID NO: 23427 - DNA, 20 bp, Artificial Sequence
  sgRNA
agcgctcctcgatgtctccc

SEQ ID NO: 23428 - DNA, 20 bp, Artificial Sequence
  sgRNA
gggtcagccaaccagctcgg

SEQ ID NO: 23429 - DNA, 20 bp, Artificial Sequence
  sgRNA
gtctcaaagggatcaaccaa

SEQ ID NO: 23430 - DNA, 20 bp, Artificial Sequence
  sgRNA
taaagagctgtaccgaatat

SEQ ID NO: 23431 - DNA, 20 bp, Artificial Sequence
  sgRNA
gttggatttagcagcgccag

SEQ ID NO: 23432 - DNA, 20 bp, Artificial Sequence
  sgRNA
gaggatgctaataatcctta

SEQ ID NO: 23433 - DNA, 20 bp, Artificial Sequence
  sgRNA
gtggcacgcaagcgctttcg

SEQ ID NO: 23434 - DNA, 20 bp, Artificial Sequence
  sgRNA
aactcatgatgaacagacat

SEQ ID NO: 23435 - DNA, 20 bp, Artificial Sequence
  sgRNA
gagttgcacatttgtaaacc

SEQ ID NO: 23436 - DNA, 20 bp, Artificial Sequence
  sgRNA
gaggcaggcaaagttgactc

SEQ ID NO: 23437 - DNA, 20 bp, Artificial Sequence
  sgRNA
taggcggcgctcccaggcca

SEQ ID NO: 23438 - DNA, 20 bp, Artificial Sequence
  sgRNA
gggtgccggagagacggccg

SEQ ID NO: 23439 - DNA, 20 bp, Artificial Sequence
  sgRNA
aaacgctggcgcaggcgtcg

SEQ ID NO: 23440 - DNA, 20 bp, Artificial Sequence
  sgRNA
gaagccttgcctaccatagg

SEQ ID NO: 23441 - DNA, 20 bp, Artificial Sequence
  sgRNA
ttctagcagaccctgcagat

SEQ ID NO: 23442 - DNA, 20 bp, Artificial Sequence
  sgRNA
ggcgctctggtgcgaccaac

SEQ ID NO: 23443 - DNA, 20 bp, Artificial Sequence
  sgRNA
ggttagattctgtgtcttct

SEQ ID NO: 23444 - DNA, 20 bp, Artificial Sequence
  sgRNA
cgctgccgttctcgccatgc

SEQ ID NO: 23445 - DNA, 20 bp, Artificial Sequence
  sgRNA
tccactgtcaatgagagttt

SEQ ID NO: 23446 - DNA, 20 bp, Artificial Sequence
  sgRNA
tatcactcgacactgtattt

SEQ ID NO: 23447 - DNA, 20 bp, Artificial Sequence
  sgRNA
tatagtcctttgctaaactg

SEQ ID NO: 23448 - DNA, 20 bp, Artificial Sequence
  sgRNA
acacggtcaggtggactgtg

SEQ ID NO: 23449 - DNA, 20 bp, Artificial Sequence
  sgRNA
tcttgtaatggtcaactttg

SEQ ID NO: 23450 - DNA, 20 bp, Artificial Sequence
  sgRNA
ctaatgctgagacaaaggtg

SEQ ID NO: 23451 - DNA, 20 bp, Artificial Sequence
  sgRNA
cgcttgtgacgcaccgcgcg

SEQ ID NO: 23452 - DNA, 20 bp, Artificial Sequence
  sgRNA
ttggtcctgctcagagttgg

SEQ ID NO: 23453 - DNA, 20 bp, Artificial Sequence
  sgRNA
tacttcaagggttctgggtt

SEQ ID NO: 23454 - DNA, 20 bp, Artificial Sequence
  sgRNA
gcaggatgggaggaacagag

SEQ ID NO: 23455 - DNA, 20 bp, Artificial Sequence
  sgRNA
gagggaggatctgttcagac

SEQ ID NO: 23456 - DNA, 20 bp, Artificial Sequence
  sgRNA
ctggttctgctgagagaatt

SEQ ID NO: 23457 - DNA, 20 bp, Artificial Sequence
  sgRNA
cagatctacctcagatctta

SEQ ID NO: 23458 - DNA, 20 bp, Artificial Sequence
  sgRNA
gctgggtcccactgcccatc

SEQ ID NO: 23459 - DNA, 20 bp, Artificial Sequence
  sgRNA
tagggacgccggcgaccaga

SEQ ID NO: 23460 - DNA, 20 bp, Artificial Sequence
  sgRNA
caggagcagctcagcacctg

SEQ ID NO: 23461 - DNA, 20 bp, Artificial Sequence
  sgRNA
cagggtcagtttatcggaga

SEQ ID NO: 23462 - DNA, 20 bp, Artificial Sequence
  sgRNA
acagaatgaagaaacactgc

SEQ ID NO: 23463 - DNA, 20 bp, Artificial Sequence
  sgRNA
tgggtcaacagtctactatt

SEQ ID NO: 23464 - DNA, 20 bp, Artificial Sequence
  sgRNA
cgtcctggcgcggagggcac

SEQ ID NO: 23465 - DNA, 20 bp, Artificial Sequence
  sgRNA
gattggctagcccgggctgg

SEQ ID NO: 23466 - DNA, 20 bp, Artificial Sequence
  sgRNA
gctggccttcgatgacattt

SEQ ID NO: 23467 - DNA, 20 bp, Artificial Sequence
  sgRNA
ttgagatgtagtaccgatag

SEQ ID NO: 23468 - DNA, 20 bp, Artificial Sequence
  sgRNA
ggcgcgtgcgcgtagcagag

SEQ ID NO: 23469 - DNA, 20 bp, Artificial Sequence
  sgRNA
caatggcgccatctcttggc

SEQ ID NO: 23470 - DNA, 20 bp, Artificial Sequence
  sgRNA
tggccaagggccttgtgtga

SEQ ID NO: 23471 - DNA, 20 bp, Artificial Sequence
  sgRNA
aaggatgcgggcgcagcgag

SEQ ID NO: 23472 - DNA, 20 bp, Artificial Sequence
  sgRNA
caatcggctcgcagaaccag

SEQ ID NO: 23473 - DNA, 20 bp, Artificial Sequence
  sgRNA
tcgccaggcccgggcgcggg

SEQ ID NO: 23474 - DNA, 20 bp, Artificial Sequence
  sgRNA
ttaactcaccctggcaactg

SEQ ID NO: 23475 - DNA, 20 bp, Artificial Sequence
  sgRNA
aaaggagataaggaagagag

SEQ ID NO: 23476 - DNA, 20 bp, Artificial Sequence
  sgRNA
tgtttcttgcaaatcttcat

SEQ ID NO: 23477 - DNA, 20 bp, Artificial Sequence
  sgRNA
atggtgctgcgccggttgcc

SEQ ID NO: 23478 - DNA, 20 bp, Artificial Sequence
  sgRNA
tccgcacgcgcgcctttaaa

SEQ ID NO: 23479 - DNA, 20 bp, Artificial Sequence
  sgRNA
tcggccaagctcctcccagt

SEQ ID NO: 23480 - DNA, 20 bp, Artificial Sequence
  sgRNA
tgttagcaaacagattaatg

SEQ ID NO: 23481 - DNA, 20 bp, Artificial Sequence
  sgRNA
tcagattcttgcgatctcca

SEQ ID NO: 23482 - DNA, 20 bp, Artificial Sequence
  sgRNA
gcttgcttctgcaccacagt

SEQ ID NO: 23483 - DNA, 20 bp, Artificial Sequence
  sgRNA
gaaactgagctgccctttcc

SEQ ID NO: 23484 - DNA, 20 bp, Artificial Sequence
  sgRNA
gtgattgaaccttctaactt

SEQ ID NO: 23485 - DNA, 20 bp, Artificial Sequence
  sgRNA
cgtgcgtgggccacgccttc

SEQ ID NO: 23486 - DNA, 20 bp, Artificial Sequence
  sgRNA
gaaccgaaaggcacctgcct

SEQ ID NO: 23487 - DNA, 20 bp, Artificial Sequence
  sgRNA
tcgcggcagtcctgggcctc

SEQ ID NO: 23488 - DNA, 20 bp, Artificial Sequence
  sgRNA
atctgtctgttagttgacga

SEQ ID NO: 23489 - DNA, 20 bp, Artificial Sequence
  sgRNA
ctgacgaacagtctggaccc

SEQ ID NO: 23490 - DNA, 20 bp, Artificial Sequence
  sgRNA
acggaccgggctgacaactg

SEQ ID NO: 23491 - DNA, 20 bp, Artificial Sequence
  sgRNA
attgacaatcccacagacca

SEQ ID NO: 23492 - DNA, 20 bp, Artificial Sequence
  sgRNA
tggttacagcatcgtcttta

SEQ ID NO: 23493 - DNA, 20 bp, Artificial Sequence
  sgRNA
gctcgggcggccactgggcg

SEQ ID NO: 23494 - DNA, 20 bp, Artificial Sequence
  sgRNA
ggcaggtttaaacatctcct

SEQ ID NO: 23495 - DNA, 20 bp, Artificial Sequence
  sgRNA
cgactagggaggagctaccg

SEQ ID NO: 23496 - DNA, 20 bp, Artificial Sequence
  sgRNA
ggactagtgttcttgagctc

SEQ ID NO: 23497 - DNA, 20 bp, Artificial Sequence
  sgRNA
atgcccaggctcgctcaagg

SEQ ID NO: 23498 - DNA, 20 bp, Artificial Sequence
  sgRNA
cagaatggaagtctaggttt

SEQ ID NO: 23499 - DNA, 20 bp, Artificial Sequence
  sgRNA
aaatttactggcttgttgac

SEQ ID NO: 23500 - DNA, 20 bp, Artificial Sequence
  sgRNA
tgagtagcaaatcctattat

SEQ ID NO: 23501 - DNA, 20 bp, Artificial Sequence
  sgRNA
cgggtacttgttcaggtcaa

SEQ ID NO: 23502 - DNA, 20 bp, Artificial Sequence
  sgRNA
tgtcagcatgagggatcatt

SEQ ID NO: 23503 - DNA, 20 bp, Artificial Sequence
  sgRNA
gcagtctacctgtgggaagc

SEQ ID NO: 23504 - DNA, 20 bp, Artificial Sequence
  sgRNA
gggacggccaggtgtatccg

SEQ ID NO: 23505 - DNA, 20 bp, Artificial Sequence
  sgRNA
ttctcggccggagaaggcta

SEQ ID NO: 23506 - DNA, 20 bp, Artificial Sequence
  sgRNA
gtagattatgaacaatgaac

SEQ ID NO: 23507 - DNA, 20 bp, Artificial Sequence
  sgRNA
gtgtgagcagatggagtagg

SEQ ID NO: 23508 - DNA, 20 bp, Artificial Sequence
  sgRNA
agaggaggaagtcaatacac

SEQ ID NO: 23509 - DNA, 20 bp, Artificial Sequence
  sgRNA
tgacgatgagcgcccgactg

SEQ ID NO: 23510 - DNA, 20 bp, Artificial Sequence
  sgRNA
ccagaatctgataaccatca

SEQ ID NO: 23511 - DNA, 20 bp, Artificial Sequence
  sgRNA
tcacgcggctccttggtaac

SEQ ID NO: 23512 - DNA, 20 bp, Artificial Sequence
  sgRNA
attgcaatagactcaatcaa

SEQ ID NO: 23513 - DNA, 20 bp, Artificial Sequence
  sgRNA
gcgaggcatttggctttgaa

SEQ ID NO: 23514 - DNA, 20 bp, Artificial Sequence
  sgRNA
agacagagaggtaagcgccc

SEQ ID NO: 23515 - DNA, 20 bp, Artificial Sequence
  sgRNA
tccaataacgcagcggagaa

SEQ ID NO: 23516 - DNA, 20 bp, Artificial Sequence
  sgRNA
tgctctagggccgctggagg

SEQ ID NO: 23517 - DNA, 20 bp, Artificial Sequence
  sgRNA
aagctaagaaacagaataga

SEQ ID NO: 23518 - DNA, 20 bp, Artificial Sequence
  sgRNA
gcgcgtcgagctcgccttct

SEQ ID NO: 23519 - DNA, 20 bp, Artificial Sequence
  sgRNA
acgcgtctagtcgccgagcc

SEQ ID NO: 23520 - DNA, 20 bp, Artificial Sequence
  sgRNA
gctcacggaagaagagcagc

SEQ ID NO: 23521 - DNA, 20 bp, Artificial Sequence
  sgRNA
ccaaggctgctagggcagct

SEQ ID NO: 23522 - DNA, 20 bp, Artificial Sequence
  sgRNA
gaaattcctctgaggcagaa

SEQ ID NO: 23523 - DNA, 20 bp, Artificial Sequence
  sgRNA
cagctgggtacacctactgc

SEQ ID NO: 23524 - DNA, 20 bp, Artificial Sequence
  sgRNA
aaacagtgacagttcgatgg

SEQ ID NO: 23525 - DNA, 20 bp, Artificial Sequence
  sgRNA
cttctgagtgatcttgattc

SEQ ID NO: 23526 - DNA, 20 bp, Artificial Sequence
  sgRNA
ccctccaacccaatctgccc

SEQ ID NO: 23527 - DNA, 20 bp, Artificial Sequence
  sgRNA
aacagcaagtgcaggtctaa

SEQ ID NO: 23528 - DNA, 20 bp, Artificial Sequence
  sgRNA
agactgagttagttgctgac

SEQ ID NO: 23529 - DNA, 20 bp, Artificial Sequence
  sgRNA
acgtccgcgctcgaccttaa

SEQ ID NO: 23530 - DNA, 20 bp, Artificial Sequence
  sgRNA
ctcccattctcagtcccagc

SEQ ID NO: 23531 - DNA, 20 bp, Artificial Sequence
  sgRNA
ttattaggctaatcagatct

SEQ ID NO: 23532 - DNA, 20 bp, Artificial Sequence
  sgRNA
gtcaggtttgttaagtctag

SEQ ID NO: 23533 - DNA, 20 bp, Artificial Sequence
  sgRNA
agcactagtctggtctggcc

SEQ ID NO: 23534 - DNA, 20 bp, Artificial Sequence
  sgRNA
aaggcttgtgcacagtactg

SEQ ID NO: 23535 - DNA, 20 bp, Artificial Sequence
  sgRNA
ctaacttaaatgttcacaca

SEQ ID NO: 23536 - DNA, 20 bp, Artificial Sequence
  sgRNA
ccaggagctgcctgtctaaa

SEQ ID NO: 23537 - DNA, 20 bp, Artificial Sequence
  sgRNA
tggtaccagcactcgagccc

SEQ ID NO: 23538 - DNA, 20 bp, Artificial Sequence
  sgRNA
cgaagaagcgtgagcaacag

SEQ ID NO: 23539 - DNA, 20 bp, Artificial Sequence
  sgRNA
gatggagctactttctgtgc

SEQ ID NO: 23540 - DNA, 20 bp, Artificial Sequence
  sgRNA
ggtgttactattgtgtaagt

SEQ ID NO: 23541 - DNA, 20 bp, Artificial Sequence
  sgRNA
tatgggttgtcaacagtgac

SEQ ID NO: 23542 - DNA, 20 bp, Artificial Sequence
  sgRNA
ggaggagcagacaaggccaa

SEQ ID NO: 23543 - DNA, 20 bp, Artificial Sequence
  sgRNA
agtataacccttcctacctc

SEQ ID NO: 23544 - DNA, 20 bp, Artificial Sequence
  sgRNA
acactacacttagcttccgg

SEQ ID NO: 23545 - DNA, 20 bp, Artificial Sequence
  sgRNA
gtggaaggtggcctgctgtg

SEQ ID NO: 23546 - DNA, 20 bp, Artificial Sequence
  sgRNA
ggccagctcgccggagcgct

SEQ ID NO: 23547 - DNA, 20 bp, Artificial Sequence
  sgRNA
aaggcgggtgaccaatcgcg

SEQ ID NO: 23548 - DNA, 20 bp, Artificial Sequence
  sgRNA
gcaggcgctcggaaggcagc

SEQ ID NO: 23549 - DNA, 20 bp, Artificial Sequence
  sgRNA
gctgaaactataaatacatc

SEQ ID NO: 23550 - DNA, 20 bp, Artificial Sequence
  sgRNA
cggagcgggccaggctaggc

SEQ ID NO: 23551 - DNA, 20 bp, Artificial Sequence
  sgRNA
atgttagttacaatagcttc

SEQ ID NO: 23552 - DNA, 20 bp, Artificial Sequence
  sgRNA
gctgggcgtggaggcgcgag

SEQ ID NO: 23553 - DNA, 20 bp, Artificial Sequence
  sgRNA
ggcggaggcggagtgggcgg

SEQ ID NO: 23554 - DNA, 20 bp, Artificial Sequence
  sgRNA
aacgtcttgtatatttgaga

SEQ ID NO: 23555 - DNA, 20 bp, Artificial Sequence
  sgRNA
accaggtctcatagattcac

SEQ ID NO: 23556 - DNA, 20 bp, Artificial Sequence
  sgRNA
gtgaactaacttctagaaca

SEQ ID NO: 23557 - DNA, 20 bp, Artificial Sequence
  sgRNA
tactaagtggacacgagagt

SEQ ID NO: 23558 - DNA, 20 bp, Artificial Sequence
  sgRNA
catatgcacacgaagtgtgg

SEQ ID NO: 23559 - DNA, 20 bp, Artificial Sequence
  sgRNA
cttacgggtttgtgtcgttc

SEQ ID NO: 23560 - DNA, 20 bp, Artificial Sequence
  sgRNA
attggccgaaaggcaacccg

SEQ ID NO: 23561 - DNA, 20 bp, Artificial Sequence
  sgRNA
agattctgacgtcacattga

SEQ ID NO: 23562 - DNA, 20 bp, Artificial Sequence
  sgRNA
cgtcgggccggaagcaaagc

SEQ ID NO: 23563 - DNA, 20 bp, Artificial Sequence
  sgRNA
ctgctccgtgatcgcgtttc

SEQ ID NO: 23564 - DNA, 20 bp, Artificial Sequence
  sgRNA
gctacaatataaacgaagac

SEQ ID NO: 23565 - DNA, 20 bp, Artificial Sequence
  sgRNA
gtttccagaacaatccaacc

SEQ ID NO: 23566 - DNA, 20 bp, Artificial Sequence
  sgRNA
gcgcccgcccgggaagaagc

SEQ ID NO: 23567 - DNA, 20 bp, Artificial Sequence
  sgRNA
atcaggaagcatccgcatcc

SEQ ID NO: 23568 - DNA, 20 bp, Artificial Sequence
  sgRNA
tatcccgtgcagtctgcctc

SEQ ID NO: 23569 - DNA, 20 bp, Artificial Sequence
  sgRNA
tggcctgctgtcccggacct

SEQ ID NO: 23570 - DNA, 20 bp, Artificial Sequence
  sgRNA
gactcatcgtcttgtctagc

SEQ ID NO: 23571 - DNA, 20 bp, Artificial Sequence
  sgRNA
ggactccagtcatgtattcc

SEQ ID NO: 23572 - DNA, 20 bp, Artificial Sequence
  sgRNA
acccaagatgcactcacaga

SEQ ID NO: 23573 - DNA, 20 bp, Artificial Sequence
  sgRNA
gagcacagcgcagttacttc

SEQ ID NO: 23574 - DNA, 20 bp, Artificial Sequence
  sgRNA
cgcacgcgcacacacgttgg

SEQ ID NO: 23575 - DNA, 20 bp, Artificial Sequence
  sgRNA
ataggctataatgtacattc

SEQ ID NO: 23576 - DNA, 20 bp, Artificial Sequence
  sgRNA
ggtgattggtgaactgcgga

SEQ ID NO: 23577 - DNA, 20 bp, Artificial Sequence
  sgRNA
tgttatgcgatagcagggtg

SEQ ID NO: 23578 - DNA, 20 bp, Artificial Sequence
  sgRNA
gaactggtagctaactctgc

SEQ ID NO: 23579 - DNA, 20 bp, Artificial Sequence
  sgRNA
ttgtgctttctgagggaggc

SEQ ID NO: 23580 - DNA, 20 bp, Artificial Sequence
  sgRNA
tgggattagtgtggagctgc

SEQ ID NO: 23581 - DNA, 20 bp, Artificial Sequence
  sgRNA
cttgtcactttcagcttgca

SEQ ID NO: 23582 - DNA, 20 bp, Artificial Sequence
  sgRNA
tcgcacttagtcatcttcag

SEQ ID NO: 23583 - DNA, 20 bp, Artificial Sequence
  sgRNA
ggcagcacaacctctccgag

SEQ ID NO: 23584 - DNA, 20 bp, Artificial Sequence
  sgRNA
gtgtaccctccaaattgccc

SEQ ID NO: 23585 - DNA, 20 bp, Artificial Sequence
  sgRNA
gatacgccattctcctttcc

SEQ ID NO: 23586 - DNA, 20 bp, Artificial Sequence
  sgRNA
ctatcagaagcctgctttac

SEQ ID NO: 23587 - DNA, 20 bp, Artificial Sequence
  sgRNA
gcgttgtcaagctacaccgt

SEQ ID NO: 23588 - DNA, 20 bp, Artificial Sequence
  sgRNA
atgtgggacccgctggccgg

SEQ ID NO: 23589 - DNA, 20 bp, Artificial Sequence
  sgRNA
agacaactgaatgctattta

SEQ ID NO: 23590 - DNA, 20 bp, Artificial Sequence
  sgRNA
tgagtctccaatatttctag

SEQ ID NO: 23591 - DNA, 20 bp, Artificial Sequence
  sgRNA
gacttcattcgctggtcact

SEQ ID NO: 23592 - DNA, 20 bp, Artificial Sequence
  sgRNA
ttaagatgtttccaaagcca

SEQ ID NO: 23593 - DNA, 20 bp, Artificial Sequence
  sgRNA
gttctcttaagggagcagca

SEQ ID NO: 23594 - DNA, 20 bp, Artificial Sequence
  sgRNA
cattgatggcagtgataggc

SEQ ID NO: 23595 - DNA, 20 bp, Artificial Sequence
  sgRNA
tacttgaatggacatttagt

SEQ ID NO: 23596 - DNA, 20 bp, Artificial Sequence
  sgRNA
aagaggaagctggctcttgt

SEQ ID NO: 23597 - DNA, 20 bp, Artificial Sequence
  sgRNA
atcatagatgctcgtgagga

SEQ ID NO: 23598 - DNA, 20 bp, Artificial Sequence
  sgRNA
aactcaaggctggcgcggcc

SEQ ID NO: 23599 - DNA, 20 bp, Artificial Sequence
  sgRNA
caacggctgtttccggtgag

SEQ ID NO: 23600 - DNA, 20 bp, Artificial Sequence
  sgRNA
aagcatacaaattgctgtgg

SEQ ID NO: 23601 - DNA, 20 bp, Artificial Sequence
  sgRNA
cctaagaggctttatagcag

SEQ ID NO: 23602 - DNA, 20 bp, Artificial Sequence
  sgRNA
cttgcgtgatctaagtaagc

SEQ ID NO: 23603 - DNA, 20 bp, Artificial Sequence
  sgRNA
cgacgagttgtgtggtcaca

SEQ ID NO: 23604 - DNA, 20 bp, Artificial Sequence
  sgRNA
ccggtagcctagtcgctttc

SEQ ID NO: 23605 - DNA, 20 bp, Artificial Sequence
  sgRNA
ggaaggataggttgccaaag

SEQ ID NO: 23606 - DNA, 20 bp, Artificial Sequence
  sgRNA
tgtgtcccagaaagggtggc

SEQ ID NO: 23607 - DNA, 20 bp, Artificial Sequence
  sgRNA
cactttcctctaatgattta

SEQ ID NO: 23608 - DNA, 20 bp, Artificial Sequence
  sgRNA
acgtgctatcagcctgccca

SEQ ID NO: 23609 - DNA, 20 bp, Artificial Sequence
  sgRNA
tgggcgacgcgagtgggttg

SEQ ID NO: 23610 - DNA, 20 bp, Artificial Sequence
  sgRNA
ctggatgtgctctttacaaa

SEQ ID NO: 23611 - DNA, 20 bp, Artificial Sequence
  sgRNA
aaagtaaatttatggccaga

SEQ ID NO: 23612 - DNA, 20 bp, Artificial Sequence
  sgRNA
taggcgcctcccactgctcg

SEQ ID NO: 23613 - DNA, 20 bp, Artificial Sequence
  sgRNA
gctctctatgaggcacttga

SEQ ID NO: 23614 - DNA, 20 bp, Artificial Sequence
  sgRNA
ctagactttgctacaatact

SEQ ID NO: 23615 - DNA, 20 bp, Artificial Sequence
  sgRNA
cattataaagggcgggctcc

SEQ ID NO: 23616 - DNA, 20 bp, Artificial Sequence
  sgRNA
ttcaccctggcgcaagagcc

SEQ ID NO: 23617 - DNA, 20 bp, Artificial Sequence
  sgRNA
acattctatggaagaccctt

SEQ ID NO: 23618 - DNA, 20 bp, Artificial Sequence
  sgRNA
gggcagcccatgcgatttct

SEQ ID NO: 23619 - DNA, 20 bp, Artificial Sequence
  sgRNA
atgcagccaccacaggatac

SEQ ID NO: 23620 - DNA, 20 bp, Artificial Sequence
  sgRNA
ccaatagagagcgtatgatt

SEQ ID NO: 23621 - DNA, 20 bp, Artificial Sequence
  sgRNA
ccgtggctctctgtggtccc

SEQ ID NO: 23622 - DNA, 20 bp, Artificial Sequence
  sgRNA
agtgaatgcttatttaagtc

SEQ ID NO: 23623 - DNA, 20 bp, Artificial Sequence
  sgRNA
actactcaggaaatttattc

SEQ ID NO: 23624 - DNA, 20 bp, Artificial Sequence
  sgRNA
cccaagattaacacttcagt

SEQ ID NO: 23625 - DNA, 20 bp, Artificial Sequence
  sgRNA
tatttattggtcacttcact

SEQ ID NO: 23626 - DNA, 20 bp, Artificial Sequence
  sgRNA
gcctgcgaaagctgagaacg

SEQ ID NO: 23627 - DNA, 20 bp, Artificial Sequence
  sgRNA
tatatgatagccctgaaaga

SEQ ID NO: 23628 - DNA, 20 bp, Artificial Sequence
  sgRNA
gacaaccagtgcgcgctaac

SEQ ID NO: 23629 - DNA, 20 bp, Artificial Sequence
  sgRNA
cccgccctcttaagtgggcg

SEQ ID NO: 23630 - DNA, 20 bp, Artificial Sequence
  sgRNA
agcagttgggactgctggcc

SEQ ID NO: 23631 - DNA, 20 bp, Artificial Sequence
  sgRNA
ttctcacagtgcacacaatg

SEQ ID NO: 23632 - DNA, 20 bp, Artificial Sequence
  sgRNA
gtgtagctagggagtgaatt

SEQ ID NO: 23633 - DNA, 20 bp, Artificial Sequence
  sgRNA
acgggaaactggaaccgcgc

SEQ ID NO: 23634 - DNA, 20 bp, Artificial Sequence
  sgRNA
caacaagcacacaagatgtc

SEQ ID NO: 23635 - DNA, 20 bp, Artificial Sequence
  sgRNA
gggttctgcattggaatgct

SEQ ID NO: 23636 - DNA, 20 bp, Artificial Sequence
  sgRNA
atttgcttcaatccagttta

SEQ ID NO: 23637 - DNA, 20 bp, Artificial Sequence
  sgRNA
agcggaaacgcttcgggccc

SEQ ID NO: 23638 - DNA, 20 bp, Artificial Sequence
  sgRNA
ggcggccgagcgtgtctctg

SEQ ID NO: 23639 - DNA, 20 bp, Artificial Sequence
  sgRNA
aatttaatttcctcagggcc

SEQ ID NO: 23640 - DNA, 20 bp, Artificial Sequence
  sgRNA
ggaggttcagtgtgttaagg

SEQ ID NO: 23641 - DNA, 20 bp, Artificial Sequence
  sgRNA
ttaacaatttctcatttggg

SEQ ID NO: 23642 - DNA, 20 bp, Artificial Sequence
  sgRNA
gcgtctcagccgcgcagact

SEQ ID NO: 23643 - DNA, 20 bp, Artificial Sequence
  sgRNA
cgacgagatagcttagccaa

SEQ ID NO: 23644 - DNA, 20 bp, Artificial Sequence
  sgRNA
gacaaactaccaatcccaag

SEQ ID NO: 23645 - DNA, 20 bp, Artificial Sequence
  sgRNA
gttcctacttctttctaagc

SEQ ID NO: 23646 - DNA, 20 bp, Artificial Sequence
  sgRNA
gtagatgggagcggagggcg

SEQ ID NO: 23647 - DNA, 20 bp, Artificial Sequence
  sgRNA
tgcatcgttccaggatgcct

SEQ ID NO: 23648 - DNA, 20 bp, Artificial Sequence
  sgRNA
tcatggtaacccaatctcac

SEQ ID NO: 23649 - DNA, 20 bp, Artificial Sequence
  sgRNA
agccgcgcttggtagccgtt

SEQ ID NO: 23650 - DNA, 20 bp, Artificial Sequence
  sgRNA
tgtgaaagaggactatgatc

SEQ ID NO: 23651 - DNA, 20 bp, Artificial Sequence
  sgRNA
gcgggccctgttcaggaggc

SEQ ID NO: 23652 - DNA, 20 bp, Artificial Sequence
  sgRNA
cattgtagtaacaacttgtt

SEQ ID NO: 23653 - DNA, 20 bp, Artificial Sequence
  sgRNA
gacgaggagactagaataga

SEQ ID NO: 23654 - DNA, 20 bp, Artificial Sequence
  sgRNA
tgcccagaaacagcttaagt

SEQ ID NO: 23655 - DNA, 20 bp, Artificial Sequence
  sgRNA
taatatggccgacttgtatg

SEQ ID NO: 23656 - DNA, 20 bp, Artificial Sequence
  sgRNA
gaagtagatgtcaatgtctt

SEQ ID NO: 23657 - DNA, 20 bp, Artificial Sequence
  sgRNA
ggatggaatctttactcaaa

SEQ ID NO: 23658 - DNA, 20 bp, Artificial Sequence
  sgRNA
gcgcagataacactctctgt

SEQ ID NO: 23659 - DNA, 20 bp, Artificial Sequence
  sgRNA
agaaaggctgacaggaggcg

SEQ ID NO: 23660 - DNA, 20 bp, Artificial Sequence
  sgRNA
aggatggtgcagaccctccc

SEQ ID NO: 23661 - DNA, 20 bp, Artificial Sequence
  sgRNA
ataaaggccggacgctgcac

SEQ ID NO: 23662 - DNA, 20 bp, Artificial Sequence
  sgRNA
tagttcatgcattgttctcc

SEQ ID NO: 23663 - DNA, 20 bp, Artificial Sequence
  sgRNA
tgaccagtatctggtaccct

SEQ ID NO: 23664 - DNA, 20 bp, Artificial Sequence
  sgRNA
ttaaacaaccacgccctccg

SEQ ID NO: 23665 - DNA, 20 bp, Artificial Sequence
  sgRNA
cagaaagaccctcagtcgac

SEQ ID NO: 23666 - DNA, 20 bp, Artificial Sequence
  sgRNA
tgatgtacagaaattctctg

SEQ ID NO: 23667 - DNA, 20 bp, Artificial Sequence
  sgRNA
gttggtcttctccgccctcc

SEQ ID NO: 23668 - DNA, 20 bp, Artificial Sequence
  sgRNA
gtaattgtagcatgttcttt

SEQ ID NO: 23669 - DNA, 20 bp, Artificial Sequence
  sgRNA
gttcagttatagagtacagt

SEQ ID NO: 23670 - DNA, 20 bp, Artificial Sequence
  sgRNA
ttggtctgggaaggatttgg

SEQ ID NO: 23671 - DNA, 20 bp, Artificial Sequence
  sgRNA
ggctccaaattactggtccc

SEQ ID NO: 23672 - DNA, 20 bp, Artificial Sequence
  sgRNA
tggcgttggcgacacagccc

SEQ ID NO: 23673 - DNA, 20 bp, Artificial Sequence
  sgRNA
ataccctctgtcaacgtccc

SEQ ID NO: 23674 - DNA, 20 bp, Artificial Sequence
  sgRNA
aagttgccgatgagctgccg

SEQ ID NO: 23675 - DNA, 20 bp, Artificial Sequence
  sgRNA
agaaaggttaaagtgggctg

SEQ ID NO: 23676 - DNA, 20 bp, Artificial Sequence
  sgRNA
gagttcttgctaactgggtt

SEQ ID NO: 23677 - DNA, 20 bp, Artificial Sequence
  sgRNA
ttcattcactcctttagctc

SEQ ID NO: 23678 - DNA, 20 bp, Artificial Sequence
  sgRNA
aaggcttgtgaaattgtacc

SEQ ID NO: 23679 - DNA, 20 bp, Artificial Sequence
  sgRNA
tgtgttagacatcagataat

SEQ ID NO: 23680 - DNA, 20 bp, Artificial Sequence
  sgRNA
cagctttgcacttccgcttc

SEQ ID NO: 23681 - DNA, 20 bp, Artificial Sequence
  sgRNA
cgcgagcgcagtccgttgcc

SEQ ID NO: 23682 - DNA, 20 bp, Artificial Sequence
  sgRNA
tttcgtcatggcgctgaagg

SEQ ID NO: 23683 - DNA, 20 bp, Artificial Sequence
  sgRNA
ccttccttgtgcttagcgat

SEQ ID NO: 23684 - DNA, 20 bp, Artificial Sequence
  sgRNA
gggaacaaagtccgaggacc

SEQ ID NO: 23685 - DNA, 20 bp, Artificial Sequence
  sgRNA
aggattggctgcgtgaggcg

SEQ ID NO: 23686 - DNA, 20 bp, Artificial Sequence
  sgRNA
gggtgcgcagtagggtcggt

SEQ ID NO: 23687 - DNA, 20 bp, Artificial Sequence
  sgRNA
tagtgctgaatgtctagccc

SEQ ID NO: 23688 - DNA, 20 bp, Artificial Sequence
  sgRNA
gcgcgggcccacgtggatcg

SEQ ID NO: 23689 - DNA, 20 bp, Artificial Sequence
  sgRNA
aataacccacagccagccaa

SEQ ID NO: 23690 - DNA, 20 bp, Artificial Sequence
  sgRNA
ggatagtccatcctcagcta

SEQ ID NO: 23691 - DNA, 20 bp, Artificial Sequence
  sgRNA
gtatgtggtgtatcccgtca

SEQ ID NO: 23692 - DNA, 20 bp, Artificial Sequence
  sgRNA
tctgcttccgcgagctgatt

SEQ ID NO: 23693 - DNA, 20 bp, Artificial Sequence
  sgRNA
tcacattgattctggtactt

SEQ ID NO: 23694 - DNA, 20 bp, Artificial Sequence
  sgRNA
aggacaaggcaaacaagact

SEQ ID NO: 23695 - DNA, 20 bp, Artificial Sequence
  sgRNA
caataaacatgttggcctaa

SEQ ID NO: 23696 - DNA, 20 bp, Artificial Sequence
  sgRNA
gatgcaggagtctcagaatc

SEQ ID NO: 23697 - DNA, 20 bp, Artificial Sequence
  sgRNA
gcgcatttattagaagagcg

SEQ ID NO: 23698 - DNA, 20 bp, Artificial Sequence
  sgRNA
gagatgcactctgccgggag

SEQ ID NO: 23699 - DNA, 20 bp, Artificial Sequence
  sgRNA
ttgccaataattaacagagc

SEQ ID NO: 23700 - DNA, 20 bp, Artificial Sequence
  sgRNA
acagattagactgataaagc

SEQ ID NO: 23701 - DNA, 20 bp, Artificial Sequence
  sgRNA
agcggctgcgcatgcgtcgt

SEQ ID NO: 23702 - DNA, 20 bp, Artificial Sequence
  sgRNA
ttcccgggaccttctagata

SEQ ID NO: 23703 - DNA, 20 bp, Artificial Sequence
  sgRNA
gcttccggtgctcactcttc

SEQ ID NO: 23704 - DNA, 20 bp, Artificial Sequence
  sgRNA
acattgtgatttcatacagt

SEQ ID NO: 23705 - DNA, 20 bp, Artificial Sequence
  sgRNA
cgtggcgcggccagggcgct

SEQ ID NO: 23706 - DNA, 20 bp, Artificial Sequence
  sgRNA
atgctgcaagcaattaattg

SEQ ID NO: 23707 - DNA, 20 bp, Artificial Sequence
  sgRNA
taaagcagagttcatctctt

SEQ ID NO: 23708 - DNA, 20 bp, Artificial Sequence
  sgRNA
tgaagagtaatctgacaatc

SEQ ID NO: 23709 - DNA, 20 bp, Artificial Sequence
  sgRNA
gtgtctcaggcagttgggtg

SEQ ID NO: 23710 - DNA, 20 bp, Artificial Sequence
  sgRNA
agatcgtgagaggatgtttc

SEQ ID NO: 23711 - DNA, 20 bp, Artificial Sequence
  sgRNA
ttaggatgtgagcacagtaa

SEQ ID NO: 23712 - DNA, 20 bp, Artificial Sequence
  sgRNA
tgatggagggaactgggtct

SEQ ID NO: 23713 - DNA, 20 bp, Artificial Sequence
  sgRNA
atcggcctcacctgcgtggg

SEQ ID NO: 23714 - DNA, 20 bp, Artificial Sequence
  sgRNA
catagtcgtcttaagcctgc

SEQ ID NO: 23715 - DNA, 20 bp, Artificial Sequence
  sgRNA
gtgtaagacgctcacagtca

SEQ ID NO: 23716 - DNA, 20 bp, Artificial Sequence
  sgRNA
acaggcgcattgacgtcctc

SEQ ID NO: 23717 - DNA, 20 bp, Artificial Sequence
  sgRNA
gataacacgcttagcttagc

SEQ ID NO: 23718 - DNA, 20 bp, Artificial Sequence
  sgRNA
acggcgcacgctcgcggaag

SEQ ID NO: 23719 - DNA, 20 bp, Artificial Sequence
  sgRNA
aactttaaggagtctccctg

SEQ ID NO: 23720 - DNA, 20 bp, Artificial Sequence
  sgRNA
atatgagctagagctgtgtt

SEQ ID NO: 23721 - DNA, 20 bp, Artificial Sequence
  sgRNA
gcattgtgtgctcagggatc

SEQ ID NO: 23722 - DNA, 20 bp, Artificial Sequence
  sgRNA
tctcattgctatgacctcat

SEQ ID NO: 23723 - DNA, 20 bp, Artificial Sequence
  sgRNA
tcccagctgggtcaggttgg

SEQ ID NO: 23724 - DNA, 20 bp, Artificial Sequence
  sgRNA
gttgttcactgtggccgctc

SEQ ID NO: 23725 - DNA, 20 bp, Artificial Sequence
  sgRNA
ccagtgtgctactcagacgc

SEQ ID NO: 23726 - DNA, 20 bp, Artificial Sequence
  sgRNA
gaggcggccggttctcatct

SEQ ID NO: 23727 - DNA, 20 bp, Artificial Sequence
  sgRNA
gacaatataacagagacccg

SEQ ID NO: 23728 - DNA, 20 bp, Artificial Sequence
  sgRNA
tcagcatcagcggtgagtag

SEQ ID NO: 23729 - DNA, 20 bp, Artificial Sequence
  sgRNA
gatggcgtttcccactgttc

SEQ ID NO: 23730 - DNA, 20 bp, Artificial Sequence
  sgRNA
tttcaatcaggtccgctccc

SEQ ID NO: 23731 - DNA, 20 bp, Artificial Sequence
  sgRNA
tcttggcagctggcttaaga

SEQ ID NO: 23732 - DNA, 20 bp, Artificial Sequence
  sgRNA
attcgggaggctagagactc

SEQ ID NO: 23733 - DNA, 20 bp, Artificial Sequence
  sgRNA
gcaaatgtccttataaggcg

SEQ ID NO: 23734 - DNA, 20 bp, Artificial Sequence
  sgRNA
gaaccagaaacctcagtgtg

SEQ ID NO: 23735 - DNA, 20 bp, Artificial Sequence
  sgRNA
agcaatcagaggagtaggcg

SEQ ID NO: 23736 - DNA, 20 bp, Artificial Sequence
  sgRNA
tcttcatcacagccttgatc

SEQ ID NO: 23737 - DNA, 20 bp, Artificial Sequence
  sgRNA
tactacattctttgagagtt

SEQ ID NO: 23738 - DNA, 20 bp, Artificial Sequence
  sgRNA
cagcggcgccgctgattgat

SEQ ID NO: 23739 - DNA, 20 bp, Artificial Sequence
  sgRNA
cgctaccaatccgcgcaggg

SEQ ID NO: 23740 - DNA, 20 bp, Artificial Sequence
  sgRNA
ggtgagagcaggtatcctgt

SEQ ID NO: 23741 - DNA, 20 bp, Artificial Sequence
  sgRNA
gctccggaaggagacaattc

SEQ ID NO: 23742 - DNA, 20 bp, Artificial Sequence
  sgRNA
gggccacgtgatgcccatcc

SEQ ID NO: 23743 - DNA, 20 bp, Artificial Sequence
  sgRNA
ggcatatgcgccggaaggca

SEQ ID NO: 23744 - DNA, 20 bp, Artificial Sequence
  sgRNA
acactacagaactcatggcc

SEQ ID NO: 23745 - DNA, 20 bp, Artificial Sequence
  sgRNA
cctgcttcccatgctatctg

SEQ ID NO: 23746 - DNA, 20 bp, Artificial Sequence
  sgRNA
caaagagtcttcctctcttt

SEQ ID NO: 23747 - DNA, 20 bp, Artificial Sequence
  sgRNA
aaccaccagttcagttcaga

SEQ ID NO: 23748 - DNA, 20 bp, Artificial Sequence
  sgRNA
atagcttcagtgtcacatga

SEQ ID NO: 23749 - DNA, 20 bp, Artificial Sequence
  sgRNA
gatgttcacactataccaac

SEQ ID NO: 23750 - DNA, 20 bp, Artificial Sequence
  sgRNA
ggagctgcagattggactaa

SEQ ID NO: 23751 - DNA, 20 bp, Artificial Sequence
  sgRNA
ttcctagtagggtcatggcc

SEQ ID NO: 23752 - DNA, 20 bp, Artificial Sequence
  sgRNA
catagtgccctttccttctt

SEQ ID NO: 23753 - DNA, 20 bp, Artificial Sequence
  sgRNA
cgcgttccggcaccggccag

SEQ ID NO: 23754 - DNA, 20 bp, Artificial Sequence
  sgRNA
ttatgccgctcagaataact

SEQ ID NO: 23755 - DNA, 20 bp, Artificial Sequence
  sgRNA
ggatggtaacacaaagtaga

SEQ ID NO: 23756 - DNA, 20 bp, Artificial Sequence
  sgRNA
atggtgtttagggaataagt

SEQ ID NO: 23757 - DNA, 20 bp, Artificial Sequence
  sgRNA
aaactgctctgtactaaatt

SEQ ID NO: 23758 - DNA, 20 bp, Artificial Sequence
  sgRNA
tgaaaccatttactgcttgc

SEQ ID NO: 23759 - DNA, 20 bp, Artificial Sequence
  sgRNA
tggttcccgtcacaggttgg

SEQ ID NO: 23760 - DNA, 20 bp, Artificial Sequence
  sgRNA
gcggagcttgcggagtaaga

SEQ ID NO: 23761 - DNA, 20 bp, Artificial Sequence
  sgRNA
atgagtggcagacccaaggg

SEQ ID NO: 23762 - DNA, 20 bp, Artificial Sequence
  sgRNA
tgccacgtaactttagtact

SEQ ID NO: 23763 - DNA, 20 bp, Artificial Sequence
  sgRNA
gacagcaatgagcttacatc

SEQ ID NO: 23764 - DNA, 20 bp, Artificial Sequence
  sgRNA
gcctcctagctcagcagaat

SEQ ID NO: 23765 - DNA, 20 bp, Artificial Sequence
  sgRNA
aagaacgggagacgcgaagt

SEQ ID NO: 23766 - DNA, 20 bp, Artificial Sequence
  sgRNA
gttgggctttccggagtccc

SEQ ID NO: 23767 - DNA, 20 bp, Artificial Sequence
  sgRNA
agtaagggaattcgttataa

SEQ ID NO: 23768 - DNA, 20 bp, Artificial Sequence
  sgRNA
agattgacaagctaccctcg

SEQ ID NO: 23769 - DNA, 20 bp, Artificial Sequence
  sgRNA
tttctgcctctgctgatgac

SEQ ID NO: 23770 - DNA, 20 bp, Artificial Sequence
  sgRNA
ctgtgactttggagaaatat

SEQ ID NO: 23771 - DNA, 20 bp, Artificial Sequence
  sgRNA
cgacggattacggcctctgt

SEQ ID NO: 23772 - DNA, 20 bp, Artificial Sequence
  sgRNA
gggccagggttcagcattac

SEQ ID NO: 23773 - DNA, 20 bp, Artificial Sequence
  sgRNA
tggaaagagttgggcagaag

SEQ ID NO: 23774 - DNA, 20 bp, Artificial Sequence
  sgRNA
acgcggaagggtcagagcac

SEQ ID NO: 23775 - DNA, 20 bp, Artificial Sequence
  sgRNA
ctgtacaagccggctggcac

SEQ ID NO: 23776 - DNA, 20 bp, Artificial Sequence
  sgRNA
cctatagatgttcaacaatt

SEQ ID NO: 23777 - DNA, 41 bp, Artificial Sequence
  primer
aatggactatcatatgcttaccgtaacttgaaagtatttcg

SEQ ID NO: 23778 - DNA, 45 bp, Artificial Sequence
  primer
ctttagtttgtatgtctgttgctattatgtctactattctttccc

SEQ ID NO: 23779 - DNA, 20 bp, Artificial Sequence
  sgRNA
gcttcagtttgtctgtggga

SEQ ID NO: 23780 - DNA, 20 bp, Artificial Sequence
  sgRNA
attcactgagcatctattag

SEQ ID NO: 23781 - DNA, 20 bp, Artificial Sequence
  sgRNA
atcaggaagcatccgcatcc

SEQ ID NO: 23782 - DNA, 20 bp, Artificial Sequence
  sgRNA
gagagttctgaatcagggtg

SEQ ID NO: 23783 - DNA, 20 bp, Artificial Sequence
  sgRNA
tccaggcctgttctgagcac

SEQ ID NO: 23784 - DNA, 20 bp, Artificial Sequence
  sgRNA
ggacctttgagttgccctca

SEQ ID NO: 23785 - DNA, 20 bp, Artificial Sequence
  sgRNA
ccaagtccgcgttgctgctg

SEQ ID NO: 23786 - DNA, 20 bp, Artificial Sequence
  sgRNA
atctgcatgacccactcgat

SEQ ID NO: 23787 - DNA, 20 bp, Artificial Sequence
  sgRNA
gtttgagggtcatctagctg

SEQ ID NO: 23788 - DNA, 20 bp, Artificial Sequence
  sgRNA
gcaggcaggagtgggtgggt

SEQ ID NO: 23789 - DNA, 20 bp, Artificial Sequence
  sgRNA
ctttgtagattattcgagtt

SEQ ID NO: 23790 - DNA, 20 bp, Artificial Sequence
  sgRNA
gagttcggtttcagtcttga

SEQ ID NO: 23791 - DNA, 20 bp, Artificial Sequence
  sgRNA
aaagagaattggaaagcaag

SEQ ID NO: 23792 - DNA, 20 bp, Artificial Sequence
  sgRNA
tgtgtacatctctcttaaat

SEQ ID NO: 23793 - DNA, 20 bp, Artificial Sequence
  sgRNA
caggctctcagagaacctgt

SEQ ID NO: 23794 - DNA, 20 bp, Artificial Sequence
  sgRNA
gaaattcctctgaggcagaa

SEQ ID NO: 23795 - DNA, 20 bp, Artificial Sequence
  sgRNA
cctgtgctatttataaggga

SEQ ID NO: 23796 - DNA, 20 bp, Artificial Sequence
  sgRNA
gtgagaatgatcttccttca

SEQ ID NO: 23797 - DNA, 20 bp, Artificial Sequence
  sgRNA
agagtttcctttcgactcct

SEQ ID NO: 23798 - DNA, 20 bp, Artificial Sequence
  sgRNA
ttaagatggtgacagatagg

SEQ ID NO: 23799 - DNA, 20 bp, Artificial Sequence
  sgRNA
atacctgatcgaaggctcct

SEQ ID NO: 23800 - DNA, 20 bp, Artificial Sequence
  sgRNA
aaaccctactctcagatccc

SEQ ID NO: 23801 - DNA, 20 bp, Artificial Sequence
  sgRNA
tagttcttctaggtcagctg

SEQ ID NO: 23802 - DNA, 20 bp, Artificial Sequence
  sgRNA
taaccacaaattgatcgtcc

SEQ ID NO: 23803 - DNA, 20 bp, Artificial Sequence
  sgRNA
actttggagatgactcagca

SEQ ID NO: 23804 - DNA, 20 bp, Artificial Sequence
  sgRNA
tttattgtgacccatgaact

SEQ ID NO: 23805 - DNA, 20 bp, Artificial Sequence
  sgRNA
gcaatgccctcggtttacag

SEQ ID NO: 23806 - DNA, 20 bp, Artificial Sequence
  sgRNA
tttcaaagagtctacctgtg

SEQ ID NO: 23807 - DNA, 20 bp, Artificial Sequence
  sgRNA
gcaatttatactgttaatgc

SEQ ID NO: 23808 - DNA, 20 bp, Artificial Sequence
  sgRNA
tccattcagtcagtgtatgg

SEQ ID NO: 23809 - DNA, 20 bp, Artificial Sequence
  sgRNA
cacactcatcaagagcccgg

SEQ ID NO: 23810 - DNA, 20 bp, Artificial Sequence
  sgRNA
gtgggcaagaagcgaaggaa

SEQ ID NO: 23811 - DNA, 20 bp, Artificial Sequence
  sgRNA
agaggacacacgtgtgctac

SEQ ID NO: 23812 - DNA, 20 bp, Artificial Sequence
  sgRNA
aggcagagtcatacttccaa

SEQ ID NO: 23813 - DNA, 20 bp, Artificial Sequence
  sgRNA
ctaccctggctccctataaa

SEQ ID NO: 23814 - DNA, 20 bp, Artificial Sequence
  sgRNA
ttatgacagcaacaagtgtt

SEQ ID NO: 23815 - DNA, 20 bp, Artificial Sequence
  sgRNA
tggtgtcttctgaccaagaa

SEQ ID NO: 23816 - DNA, 20 bp, Artificial Sequence
  sgRNA
tcgtcgcaacccacacttcc

SEQ ID NO: 23817 - DNA, 20 bp, Artificial Sequence
  sgRNA
ttaactaatcctgagtaagg

SEQ ID NO: 23818 - DNA, 20 bp, Artificial Sequence
  sgRNA
aagtcactcaattcataact

SEQ ID NO: 23819 - DNA, 20 bp, Artificial Sequence
  sgRNA
caactccctgttagcccgga

SEQ ID NO: 23820 - DNA, 20 bp, Artificial Sequence
  sgRNA
agtgcttagcagtgttccaa

SEQ ID NO: 23821 - DNA, 20 bp, Artificial Sequence
  sgRNA
gcaccaggccaaacatacaa

SEQ ID NO: 23822 - DNA, 20 bp, Artificial Sequence
  sgRNA
cactacaagggaagttcaga

SEQ ID NO: 23823 - DNA, 20 bp, Artificial Sequence
  sgRNA
cgccacctagtggtaacaag

SEQ ID NO: 23824 - DNA, 20 bp, Artificial Sequence
  sgRNA
gggccctgaaaggatagcga

SEQ ID NO: 23825 - DNA, 20 bp, Artificial Sequence
  sgRNA
ttctacatacacttcgaagc

SEQ ID NO: 23826 - DNA, 20 bp, Artificial Sequence
  sgRNA
tgtgactcaggtgggatgga

SEQ ID NO: 23827 - DNA, 20 bp, Artificial Sequence
  sgRNA
gaggaggtacgtgaggaaag

SEQ ID NO: 23828 - DNA, 20 bp, Artificial Sequence
  sgRNA
cagtgagagtgatcgaccgg

SEQ ID NO: 23829 - DNA, 20 bp, Artificial Sequence
  sgRNA
gagacttgggcatgagttac

SEQ ID NO: 23830 - DNA, 20 bp, Artificial Sequence
  sgRNA
aacccaatcggctgctgagc

SEQ ID NO: 23831 - DNA, 20 bp, Artificial Sequence
  sgRNA
ccgcctgtgcccaattagcc

SEQ ID NO: 23832 - DNA, 20 bp, Artificial Sequence
  sgRNA
ccctccctcccttccctccc

SEQ ID NO: 23833 - DNA, 20 bp, Artificial Sequence
  sgRNA
acagggcctggacagggaag

SEQ ID NO: 23834 - DNA, 20 bp, Artificial Sequence
  sgRNA
agaaagttccgggagtcgag

SEQ ID NO: 23835 - DNA, 20 bp, Artificial Sequence
  sgRNA
cagagggctgtcagagggag

SEQ ID NO: 23836 - DNA, 20 bp, Artificial Sequence
  sgRNA
aacttggtttctgttgtagg

SEQ ID NO: 23837 - DNA, 20 bp, Artificial Sequence
  sgRNA
attccctagccgggcagggc

SEQ ID NO: 23838 - DNA, 20 bp, Artificial Sequence
  sgRNA
aattgtagcgagatagacga

SEQ ID NO: 23839 - DNA, 20 bp, Artificial Sequence
  sgRNA
gtggttggtgtacactcacg

SEQ ID NO: 23840 - DNA, 20 bp, Artificial Sequence
  sgRNA
cgttctgtggctgagcctaa

SEQ ID NO: 23841 - DNA, 20 bp, Artificial Sequence
  sgRNA
tgcaggcaacttgcagactg

SEQ ID NO: 23842 - DNA, 20 bp, Artificial Sequence
  sgRNA
ttcacgcaagcaagttaagg

SEQ ID NO: 23843 - DNA, 20 bp, Artificial Sequence
  sgRNA
cgtgccgttctaccagcatt

SEQ ID NO: 23844 - DNA, 20 bp, Artificial Sequence
  sgRNA
acgacctccggatctgagtc

SEQ ID NO: 23845 - DNA, 20 bp, Artificial Sequence
  sgRNA
ccgtgatatttcaaacagcc

SEQ ID NO: 23846 - DNA, 20 bp, Artificial Sequence
  sgRNA
agcatcaacagctaggagac

SEQ ID NO: 23847 - DNA, 20 bp, Artificial Sequence
  sgRNA
gcggagtctaggctgataaa

SEQ ID NO: 23848 - DNA, 20 bp, Artificial Sequence
  sgRNA
ggtctgggaacgcgggagtg

SEQ ID NO: 23849 - DNA, 20 bp, Artificial Sequence
  sgRNA
tatttattggtcacttcact

SEQ ID NO: 23850 - DNA, 20 bp, Artificial Sequence
  sgRNA
ctccagccctctcatagttg

SEQ ID NO: 23851 - DNA, 20 bp, Artificial Sequence
  sgRNA
aggatttaacatggactgaa

SEQ ID NO: 23852 - DNA, 20 bp, Artificial Sequence
  sgRNA
ctgtgatcgaacagacgaga

SEQ ID NO: 23853 - DNA, 20 bp, Artificial Sequence
  sgRNA
gcagtgtggcagccgccgat

SEQ ID NO: 23854 - DNA, 20 bp, Artificial Sequence
  sgRNA
aacagctggtaactgccgat

SEQ ID NO: 23855 - DNA, 20 bp, Artificial Sequence
  sgRNA
ctgcgtcacgcagcgtcggg

SEQ ID NO: 23856 - DNA, 20 bp, Artificial Sequence
  sgRNA
ggtcgcactatgggccaatg

SEQ ID NO: 23857 - DNA, 20 bp, Artificial Sequence
  sgRNA
gtaggtctaaaccagtcaaa

SEQ ID NO: 23858 - DNA, 20 bp, Artificial Sequence
  sgRNA
gggtcgaccacgcgttgtgg

SEQ ID NO: 23859 - DNA, 20 bp, Artificial Sequence
  sgRNA
tgatagggaatgcattctcc

SEQ ID NO: 23860 - DNA, 20 bp, Artificial Sequence
  sgRNA
actttgagttcccgaagccc

SEQ ID NO: 23861 - DNA, 20 bp, Artificial Sequence
  sgRNA
caagcctaagggatctagcc

SEQ ID NO: 23862 - DNA, 20 bp, Artificial Sequence
  sgRNA
agctggccgtgcagagagga

SEQ ID NO: 23863 - DNA, 20 bp, Artificial Sequence
  sgRNA
tcatctgggagatgagcctc

SEQ ID NO: 23864 - DNA, 20 bp, Artificial Sequence
  sgRNA
ttcggttggcattcggctaa

SEQ ID NO: 23865 - DNA, 20 bp, Artificial Sequence
  sgRNA
gggtctgagatgctttgaaa

SEQ ID NO: 23866 - DNA, 20 bp, Artificial Sequence
  sgRNA
ggcgcctgtcaatttgcggg

SEQ ID NO: 23867 - DNA, 20 bp, Artificial Sequence
  sgRNA
ttgctagtagcggccttgga

SEQ ID NO: 23868 - DNA, 20 bp, Artificial Sequence
  sgRNA
ctagtctgttcttgccttgt

SEQ ID NO: 23869 - DNA, 20 bp, Artificial Sequence
  sgRNA
gggagggtggccgccggaaa

SEQ ID NO: 23870 - DNA, 20 bp, Artificial Sequence
  sgRNA
gaatctggcagctctttaag

SEQ ID NO: 23871 - DNA, 20 bp, Artificial Sequence
  sgRNA
ggacgctaagaagggtttgg

SEQ ID NO: 23872 - DNA, 20 bp, Artificial Sequence
  sgRNA
ctgtcaccaccctccgttcc

SEQ ID NO: 23873 - DNA, 20 bp, Artificial Sequence
  sgRNA
cttcacgtcctttccctgaa

SEQ ID NO: 23874 - DNA, 20 bp, Artificial Sequence
  sgRNA
tgggaaggcgcttcgagcga

SEQ ID NO: 23875 - DNA, 20 bp, Artificial Sequence
  sgRNA
ttcttagatcttgcgcaaag

SEQ ID NO: 23876 - DNA, 20 bp, Artificial Sequence
  sgRNA
ccacgaagaatagccctagg

SEQ ID NO: 23877 - DNA, 20 bp, Artificial Sequence
  sgRNA
agcggccggtggcccatccc

SEQ ID NO: 23878 - DNA, 20 bp, Artificial Sequence
  sgRNA
gctgtcgggaagacgactgt

SEQ ID NO: 23879 - DNA, 20 bp, Artificial Sequence
  sgRNA
gcacacgcccagttccggtg

SEQ ID NO: 23880 - DNA, 20 bp, Artificial Sequence
  sgRNA
tcgcagactcttggatgact

SEQ ID NO: 23881 - DNA, 20 bp, Artificial Sequence
  sgRNA
aatctttacaggcatatctc

SEQ ID NO: 23882 - DNA, 20 bp, Artificial Sequence
  sgRNA
tcacacggcccagttgttgt

SEQ ID NO: 23883 - DNA, 20 bp, Artificial Sequence
  sgRNA
gtacatctaattcctcattg

SEQ ID NO: 23884 - DNA, 20 bp, Artificial Sequence
  sgRNA
ttcaaactattctccattcc

SEQ ID NO: 23885 - DNA, 20 bp, Artificial Sequence
  sgRNA
gactttctgcttattattca

SEQ ID NO: 23886 - DNA, 20 bp, Artificial Sequence
  sgRNA
cccacctcactcacacactc

SEQ ID NO: 23887 - DNA, 20 bp, Artificial Sequence
  sgRNA
gggaccctcggctgctcccc

SEQ ID NO: 23888 - DNA, 20 bp, Artificial Sequence
  sgRNA
gagaactcgcccctcccatc

SEQ ID NO: 23889 - DNA, 20 bp, Artificial Sequence
  sgRNA
tcccccttctacaggaaacc

SEQ ID NO: 23890 - DNA, 20 bp, Artificial Sequence
  sgRNA
gtggactggaatggtgcagg

SEQ ID NO: 23891 - DNA, 20 bp, Artificial Sequence
  sgRNA
acccacagggcccctttatt

SEQ ID NO: 23892 - DNA, 20 bp, Artificial Sequence
  sgRNA
aaacacagatggactttggg

SEQ ID NO: 23893 - DNA, 20 bp, Artificial Sequence
  sgRNA
aaaaatgtcagtcagcgccc

SEQ ID NO: 23894 - DNA, 20 bp, Artificial Sequence
  sgRNA
tttatgttctgagtttgtgt

SEQ ID NO: 23895 - DNA, 20 bp, Artificial Sequence
  sgRNA
aaagcacaagggaagttcag

SEQ ID NO: 23896 - DNA, 20 bp, Artificial Sequence
  sgRNA
ttttctaacacagtgacaga

SEQ ID NO: 23897 - DNA, 20 bp, Artificial Sequence
  sgRNA
cttaagtgctgactctcatt

SEQ ID NO: 23898 - DNA, 20 bp, Artificial Sequence
  sgRNA
accagatcaaatacaacaaa

SEQ ID NO: 23899 - DNA, 20 bp, Artificial Sequence
  sgRNA
agcaatatggtaattagtag

SEQ ID NO: 23900 - DNA, 20 bp, Artificial Sequence
  sgRNA
tttttttcctctgggctaac

SEQ ID NO: 23901 - DNA, 20 bp, Artificial Sequence
  sgRNA
acagtcactcaaatcagaac

SEQ ID NO: 23902 - DNA, 20 bp, Artificial Sequence
  sgRNA
tttaacgctgcaacttttgc

SEQ ID NO: 23903 - DNA, 20 bp, Artificial Sequence
  sgRNA
agagtttcctttagactcct

SEQ ID NO: 23904 - DNA, 20 bp, Artificial Sequence
  sgRNA
taaataccagcagccagagg

SEQ ID NO: 23905 - DNA, 20 bp, Artificial Sequence
  sgRNA
atcctcaggagacttcaatt

SEQ ID NO: 23906 - DNA, 20 bp, Artificial Sequence
  sgRNA
aactaaggttttgtggcatt

SEQ ID NO: 23907 - DNA, 20 bp, Artificial Sequence
  sgRNA
aagatgagatggtgacagat

SEQ ID NO: 23908 - DNA, 20 bp, Artificial Sequence
  sgRNA
cggagcgcggggcggggccg

SEQ ID NO: 23909 - DNA, 20 bp, Artificial Sequence
  sgRNA
gctgtgtggcagccgctgat

SEQ ID NO: 23910 - DNA, 20 bp, Artificial Sequence
  sgRNA
caggggctagggccgggtcc

SEQ ID NO: 23911 - DNA, 20 bp, Artificial Sequence
  sgRNA
cccaggtttcggctcacccc

SEQ ID NO: 23912 - DNA, 20 bp, Artificial Sequence
  sgRNA
ggctgcgcgtcgccttcgtc

SEQ ID NO: 23913 - DNA, 20 bp, Artificial Sequence
  sgRNA
ggcgagtgtctgggcgagcg

SEQ ID NO: 23914 - DNA, 20 bp, Artificial Sequence
  sgRNA
ggctgggcccggtcctgggc

SEQ ID NO: 23915 - DNA, 20 bp, Artificial Sequence
  sgRNA
accaactcgttaccgccgag

SEQ ID NO: 23916 - DNA, 20 bp, Artificial Sequence
  sgRNA
aagaaaaggaaactgaaaac

SEQ ID NO: 23917 - DNA, 20 bp, Artificial Sequence
  sgRNA
agacaggtgacggtccctgc

SEQ ID NO: 23918 - DNA, 20 bp, Artificial Sequence
  sgRNA
gtgcccagccaatcaggaca

SEQ ID NO: 23919 - DNA, 20 bp, Artificial Sequence
  sgRNA
gaaagtccctctctctaacc

SEQ ID NO: 23920 - DNA, 20 bp, Artificial Sequence
  sgRNA
caagccagcgacgcagtgcc

SEQ ID NO: 23921 - DNA, 20 bp, Artificial Sequence
  sgRNA
gagtctcgtgatgtttaaga

SEQ ID NO: 23922 - DNA, 20 bp, Artificial Sequence
  sgRNA
tgagtttgctgtctgtacat

SEQ ID NO: 23923 - DNA, 20 bp, Artificial Sequence
  sgRNA
caggggcaagggctggtgcc

SEQ ID NO: 23924 - DNA, 20 bp, Artificial Sequence
  sgRNA
ccactattccagactccaaa

SEQ ID NO: 23925 - DNA, 20 bp, Artificial Sequence
  sgRNA
ggagttggggggactgtgtc

SEQ ID NO: 23926 - DNA, 20 bp, Artificial Sequence
  sgRNA
ttctcagatgtgtctccggc

SEQ ID NO: 23927 - DNA, 20 bp, Artificial Sequence
  sgRNA
gaagaacaaggtctagcgga

SEQ ID NO: 23928 - DNA, 20 bp, Artificial Sequence
  sgRNA
gacacaaggagctgcagtcg

SEQ ID NO: 23929 - DNA, 20 bp, Artificial Sequence
  sgRNA
tctagatgagagagcagtga

SEQ ID NO: 23930 - DNA, 20 bp, Artificial Sequence
  sgRNA
gagacagagactcgaatttc

SEQ ID NO: 23931 - DNA, 20 bp, Artificial Sequence
  sgRNA
aagaaaactgaaatagcctc

SEQ ID NO: 23932 - DNA, 20 bp, Artificial Sequence
  sgRNA
attttggaaactccccttag

SEQ ID NO: 23933 - DNA, 20 bp, Artificial Sequence
  sgRNA
gccctttatagggccagttg

SEQ ID NO: 23934 - DNA, 20 bp, Artificial Sequence
  sgRNA
ttatgataccggccaatgct

SEQ ID NO: 23935 - DNA, 20 bp, Artificial Sequence
  sgRNA
tggccgcgggcggaggggcg

SEQ ID NO: 23936 - DNA, 20 bp, Artificial Sequence
  sgRNA
gggcgtggccgcgggcggag

SEQ ID NO: 23937 - DNA, 20 bp, Artificial Sequence
  sgRNA
gaaaggctctgggctgggaa

SEQ ID NO: 23938 - DNA, 20 bp, Artificial Sequence
  sgRNA
cgcagagtcacggggacgag

SEQ ID NO: 23939 - DNA, 20 bp, Artificial Sequence
  sgRNA
aaagcggagagagatccgag

SEQ ID NO: 23940 - DNA, 20 bp, Artificial Sequence
  sgRNA
agctgcttggctacaaaagg

SEQ ID NO: 23941 - DNA, 20 bp, Artificial Sequence
  sgRNA
ttggaaggccggaaacggaa

SEQ ID NO: 23942 - DNA, 20 bp, Artificial Sequence
  sgRNA
ggcggggaggggttgggggc

SEQ ID NO: 23943 - DNA, 20 bp, Artificial Sequence
  sgRNA
atgtctcctgcctgaaggtc

SEQ ID NO: 23944 - DNA, 20 bp, Artificial Sequence
  sgRNA
caggatgcaggcagtggccc

SEQ ID NO: 23945 - DNA, 20 bp, Artificial Sequence
  sgRNA
caactgcctccacccacttt

SEQ ID NO: 23946 - DNA, 20 bp, Artificial Sequence
  sgRNA
atgtccggccggtcgagggg

SEQ ID NO: 23947 - DNA, 20 bp, Artificial Sequence
  sgRNA
tcagactggcagcggttgga

SEQ ID NO: 23948 - DNA, 20 bp, Artificial Sequence
  sgRNA
ggcaactctgaggctcaccc

SEQ ID NO: 23949 - DNA, 20 bp, Artificial Sequence
  sgRNA
gggacttgagcaattggcga

SEQ ID NO: 23950 - DNA, 20 bp, Artificial Sequence
  sgRNA
caggggcgggcccaagggct

SEQ ID NO: 23951 - DNA, 20 bp, Artificial Sequence
  sgRNA
gtcaggttggtttgagaggc

SEQ ID NO: 23952 - DNA, 20 bp, Artificial Sequence
  sgRNA
cggaacgctgggttcccaga

SEQ ID NO: 23953 - DNA, 20 bp, Artificial Sequence
  sgRNA
gtggtgaggccaatagaaat

SEQ ID NO: 23954 - DNA, 20 bp, Artificial Sequence
  sgRNA
ggcatagaccaatgacaaag

SEQ ID NO: 23955 - DNA, 20 bp, Artificial Sequence
  sgRNA
caatggaaaaagacggccat

SEQ ID NO: 23956 - DNA, 20 bp, Artificial Sequence
  sgRNA
tgggtataaaagtgcaaggc

SEQ ID NO: 23957 - DNA, 20 bp, Artificial Sequence
  sgRNA
cttcgtcggttcactatgtt

SEQ ID NO: 23958 - DNA, 20 bp, Artificial Sequence
  sgRNA
gcggggagaggcaggggagg

SEQ ID NO: 23959 - DNA, 20 bp, Artificial Sequence
  sgRNA
ggggagaggcaggggaggcg

SEQ ID NO: 23960 - DNA, 20 bp, Artificial Sequence
  sgRNA
gagggagaagggaggtggga

SEQ ID NO: 23961 - DNA, 20 bp, Artificial Sequence
  sgRNA
gggagggaaggggatggatg

SEQ ID NO: 23962 - DNA, 20 bp, Artificial Sequence
  sgRNA
gcaggggaggctgggatggg

SEQ ID NO: 23963 - DNA, 20 bp, Artificial Sequence
  sgRNA
gaggccgggaggggctggga

SEQ ID NO: 23964 - DNA, 20 bp, Artificial Sequence
  sgRNA
aaggacagggaagcctggag

SEQ ID NO: 23965 - DNA, 20 bp, Artificial Sequence
  sgRNA
actgatagggagggacctgg

SEQ ID NO: 23966 - DNA, 20 bp, Artificial Sequence
  sgRNA
gcggggcgcggggcggggcg

SEQ ID NO: 23967 - DNA, 20 bp, Artificial Sequence
  sgRNA
gggaggaggcactttggctt

SEQ ID NO: 23968 - DNA, 20 bp, Artificial Sequence
  sgRNA
gggagggagcgcccccctcc

SEQ ID NO: 23969 - DNA, 20 bp, Artificial Sequence
  sgRNA
tgggtctccgcgcccagcgc

SEQ ID NO: 23970 - DNA, 20 bp, Artificial Sequence
  sgRNA
agtcccctgcggggtcgcgg

SEQ ID NO: 23971 - DNA, 20 bp, Artificial Sequence
  sgRNA
gccccgcaagaagggacgcg

SEQ ID NO: 23972 - DNA, 20 bp, Artificial Sequence
  sgRNA
ggaaagacgataccagcccc

SEQ ID NO: 23973 - DNA, 20 bp, Artificial Sequence
  sgRNA
acctggccaccactcgccgc

SEQ ID NO: 23974 - DNA, 20 bp, Artificial Sequence
  sgRNA
gggcggggcggggacggggc

SEQ ID NO: 23975 - DNA, 20 bp, Artificial Sequence
  sgRNA
ggggcgctgcgcggcggctc

SEQ ID NO: 23976 - DNA, 20 bp, Artificial Sequence
  sgRNA
cggcgcccaggtccgcgtcc

SEQ ID NO: 23977 - DNA, 20 bp, Artificial Sequence
  sgRNA
cgagaccgccccgggacagg

SEQ ID NO: 23978 - DNA, 20 bp, Artificial Sequence
  sgRNA
tcgccagaggagccaggccg

SEQ ID NO: 23979 - DNA, 20 bp, Artificial Sequence
  sgRNA
gtgtgcccgtcggccggagg

SEQ ID NO: 23980 - DNA, 20 bp, Artificial Sequence
  sgRNA
ggcaggtcggcctgtccgcc

SEQ ID NO: 23981 - DNA, 20 bp, Artificial Sequence
  sgRNA
ctgggcagagccgaactttc

SEQ ID NO: 23982 - DNA, 20 bp, Artificial Sequence
  sgRNA
ttctcctcccctaggccgcc

SEQ ID NO: 23983 - DNA, 20 bp, Artificial Sequence
  sgRNA
gcctccctcaccaccgtgca

SEQ ID NO: 23984 - DNA, 20 bp, Artificial Sequence
  sgRNA
gcttttgtagaggctgtggc

SEQ ID NO: 23985 - DNA, 20 bp, Artificial Sequence
  sgRNA
caaacaccctgtccaactcc

SEQ ID NO: 23986 - DNA, 20 bp, Artificial Sequence
  sgRNA
tagaagaagacggcagcaga

SEQ ID NO: 23987 - DNA, 20 bp, Artificial Sequence
  sgRNA
aatggtgcccgagaagagtg

SEQ ID NO: 23988 - DNA, 20 bp, Artificial Sequence
  sgRNA
catgaaacaccacgagcacc

SEQ ID NO: 23989 - DNA, 20 bp, Artificial Sequence
  sgRNA
ttaaagaaagttagctgggt

SEQ ID NO: 23990 - DNA, 20 bp, Artificial Sequence
  sgRNA
gagtttaaactgcaaggaaa

SEQ ID NO: 23991 - DNA, 20 bp, Artificial Sequence
  sgRNA
tcaaaatctgtagagaaaag

SEQ ID NO: 23992 - DNA, 20 bp, Artificial Sequence
  sgRNA
ttaaatttcttcctcaagtg

SEQ ID NO: 23993 - DNA, 20 bp, Artificial Sequence
  sgRNA
gctcatcttaacgtcatgtc

SEQ ID NO: 23994 - DNA, 20 bp, Artificial Sequence
  sgRNA
ctccctttgggggtttccca

SEQ ID NO: 23995 - DNA, 20 bp, Artificial Sequence
  sgRNA
agagaaacaacaccacagcc

SEQ ID NO: 23996 - DNA, 20 bp, Artificial Sequence
  sgRNA
ctttgtcatgtttgtggatg

SEQ ID NO: 23997 - DNA, 20 bp, Artificial Sequence
  sgRNA
ccaagcaagagcactgtccc

SEQ ID NO: 23998 - DNA, 20 bp, Artificial Sequence
  sgRNA
tccaaataacttctgccggc

SEQ ID NO: 23999 - DNA, 20 bp, Artificial Sequence
  sgRNA
tttgtagtcattctcatcag

SEQ ID NO: 24000 - DNA, 20 bp, Artificial Sequence
  sgRNA
gctttacactcatgctccga

SEQ ID NO: 24001 - DNA, 20 bp, Artificial Sequence
  sgRNA
cccggcgggccccgcgcgcc

SEQ ID NO: 24002 - DNA, 20 bp, Artificial Sequence
  sgRNA
gcgcggcgaagcgcggcggc

SEQ ID NO: 24003 - DNA, 20 bp, Artificial Sequence
  sgRNA
gccccttcccgacaggcccc

SEQ ID NO: 24004 - DNA, 20 bp, Artificial Sequence
  sgRNA
ccggcatgcagcggggctcc

SEQ ID NO: 24005 - DNA, 20 bp, Artificial Sequence
  sgRNA
gaggtctcggcgaagcggcg

SEQ ID NO: 24006 - DNA, 20 bp, Artificial Sequence
  sgRNA
ggtgtgcggctgcgcagact

SEQ ID NO: 24007 - DNA, 20 bp, Artificial Sequence
  sgRNA
taacgcgagagcgcgcgggg

SEQ ID NO: 24008 - DNA, 20 bp, Artificial Sequence
  sgRNA
gaaggcgacggccccgcccc

SEQ ID NO: 24009 - DNA, 20 bp, Artificial Sequence
  sgRNA
cccgtatccgactccacccc

SEQ ID NO: 24010 - DNA, 20 bp, Artificial Sequence
  sgRNA
ggtggactcactgcctctcc

SEQ ID NO: 24011 - DNA, 20 bp, Artificial Sequence
  sgRNA
cattttctgccccaaattcc

SEQ ID NO: 24012 - DNA, 20 bp, Artificial Sequence
  sgRNA
tgcacgggggttactctgga

SEQ ID NO: 24013 - DNA, 20 bp, Artificial Sequence
  sgRNA
gaggcgtaggcgtcaccagt

SEQ ID NO: 24014 - DNA, 20 bp, Artificial Sequence
  sgRNA
agatcgatccggagtcccga

SEQ ID NO: 24015 - DNA, 20 bp, Artificial Sequence
  sgRNA
tgttctctaaagaatttctc

SEQ ID NO: 24016 - DNA, 20 bp, Artificial Sequence
  sgRNA
gaccacaaacttgattgtgc

SEQ ID NO: 24017 - DNA, 20 bp, Artificial Sequence
  sgRNA
aaaccctagtctcagatcca

SEQ ID NO: 24018 - DNA, 20 bp, Artificial Sequence
  sgRNA
tttctctcctaaactctgat

SEQ ID NO: 24019 - DNA, 20 bp, Artificial Sequence
  sgRNA
tccctctgctcctctttttt

SEQ ID NO: 24020 - DNA, 20 bp, Artificial Sequence
  sgRNA
ctgcaacatgggacttcccc

SEQ ID NO: 24021 - DNA, 20 bp, Artificial Sequence
  sgRNA
ttattgtagcctccaagtta

SEQ ID NO: 24022 - DNA, 20 bp, Artificial Sequence
  sgRNA
gttgacttagcaaaacctgc

SEQ ID NO: 24023 - DNA, 20 bp, Artificial Sequence
  sgRNA
tcggtccccaacttgagcac

SEQ ID NO: 24024 - DNA, 20 bp, Artificial Sequence
  sgRNA
gggttaggggcatgcaggaa

SEQ ID NO: 24025 - DNA, 20 bp, Artificial Sequence
  sgRNA
tggacttgtcagcgcctgcc

SEQ ID NO: 24026 - DNA, 20 bp, Artificial Sequence
  sgRNA
tttcactgtttagcgttgcg

SEQ ID NO: 24027 - DNA, 20 bp, Artificial Sequence
  sgRNA
tttctctcacactaaaagaa

SEQ ID NO: 24028 - DNA, 20 bp, Artificial Sequence
  sgRNA
ctggaacaatgatgtgagct

SEQ ID NO: 24029 - DNA, 20 bp, Artificial Sequence
  sgRNA
ttccgttcctcattgactat

SEQ ID NO: 24030 - DNA, 20 bp, Artificial Sequence
  sgRNA
tagttccttgccatatccta

SEQ ID NO: 24031 - DNA, 20 bp, Artificial Sequence
  sgRNA
aaacagtcagcaaaacactg

SEQ ID NO: 24032 - DNA, 20 bp, Artificial Sequence
  sgRNA
tcggtccccaacttgagcac

SEQ ID NO: 24033 - DNA, 20 bp, Artificial Sequence
  sgRNA
gggttaggggcatgcaggaa

SEQ ID NO: 24034 - DNA, 20 bp, Artificial Sequence
  sgRNA
tggacttgtcagcgcctgcc

SEQ ID NO: 24035 - DNA, 20 bp, Artificial Sequence
  sgRNA
tttcactgtttagcgttgcg

SEQ ID NO: 24036 - DNA, 20 bp, Artificial Sequence
  sgRNA
gccgggagtgaggcaggaag

SEQ ID NO: 24037 - DNA, 20 bp, Artificial Sequence
  sgRNA
gctactcaggggccaggggc

SEQ ID NO: 24038 - DNA, 20 bp, Artificial Sequence
  sgRNA
gcgggacttggcgccggctg

SEQ ID NO: 24039 - DNA, 20 bp, Artificial Sequence
  sgRNA
tgttggttgggcgggaggtg

SEQ ID NO: 24040 - DNA, 20 bp, Artificial Sequence
  sgRNA
cgatgcccacgccggccaac

SEQ ID NO: 24041 - DNA, 20 bp, Artificial Sequence
  sgRNA
tcttcgtggagtgtgaagat

SEQ ID NO: 24042 - DNA, 20 bp, Artificial Sequence
  sgRNA
accgtcccatacgcccccta

SEQ ID NO: 24043 - DNA, 20 bp, Artificial Sequence
  sgRNA
atgtcggggcttgcgcggga

SEQ ID NO: 24044 - DNA, 20 bp, Artificial Sequence
  sgRNA
acttggctccctgccttccc

SEQ ID NO: 24045 - DNA, 20 bp, Artificial Sequence
  sgRNA
gtactgactgataacctccc

SEQ ID NO: 24046 - DNA, 20 bp, Artificial Sequence
  sgRNA
acacgcatacacaacatttt

SEQ ID NO: 24047 - DNA, 20 bp, Artificial Sequence
  sgRNA
tacagacttgtatgtttcca

SEQ ID NO: 24048 - DNA, 20 bp, Artificial Sequence
  sgRNA
taataggagacactctcctt

SEQ ID NO: 24049 - DNA, 20 bp, Artificial Sequence
  sgRNA
gacgggggcggggacggggg

SEQ ID NO: 24050 - DNA, 20 bp, Artificial Sequence
  sgRNA
ccgcccccgcgcgcccgggc

SEQ ID NO: 24051 - DNA, 20 bp, Artificial Sequence
  sgRNA
gcgcacgcggcgagggcggc

SEQ ID NO: 24052 - DNA, 20 bp, Artificial Sequence
  sgRNA
ccccgcgtgacgcccagcgc

SEQ ID NO: 24053 - DNA, 20 bp, Artificial Sequence
  sgRNA
cgacgcgaactcggggcgcc

SEQ ID NO: 24054 - DNA, 20 bp, Artificial Sequence
  sgRNA
gggtctcgcgcgccccctcc

SEQ ID NO: 24055 - DNA, 20 bp, Artificial Sequence
  sgRNA
cgctttcgcttccccagcca

SEQ ID NO: 24056 - DNA, 20 bp, Artificial Sequence
  sgRNA
aggcgagtgagactcattgc

SEQ ID NO: 24057 - DNA, 20 bp, Artificial Sequence
  sgRNA
ggctccagttccgctgtctg

SEQ ID NO: 24058 - DNA, 20 bp, Artificial Sequence
  sgRNA
ttcattctgggctgggccgc

SEQ ID NO: 24059 - DNA, 20 bp, Artificial Sequence
  sgRNA
tacagtgcgaaccagagttc

SEQ ID NO: 24060 - DNA, 20 bp, Artificial Sequence
  sgRNA
tctcgcgcgccccctcccgg

SEQ ID NO: 24061 - DNA, 20 bp, Artificial Sequence
  sgRNA
agtaaaatacagttgtctca

SEQ ID NO: 24062 - DNA, 20 bp, Artificial Sequence
  sgRNA
aggcgagtgagactcattgc

SEQ ID NO: 24063 - DNA, 20 bp, Artificial Sequence
  sgRNA
gctccagttccgctgtctgc

SEQ ID NO: 24064 - DNA, 20 bp, Artificial Sequence
  sgRNA
tacagtgcgaaccagagttc

SEQ ID NO: 24065 - DNA, 20 bp, Artificial Sequence
  sgRNA
cggcgccgccaggaggcgcc

SEQ ID NO: 24066 - DNA, 20 bp, Artificial Sequence
  sgRNA
ggaggcagggagaggcgaga

SEQ ID NO: 24067 - DNA, 20 bp, Artificial Sequence
  sgRNA
ttcccaccccagcctcaggg

SEQ ID NO: 24068 - DNA, 20 bp, Artificial Sequence
  sgRNA
aaagcagccccgcagcaccc

SEQ ID NO: 24069 - DNA, 20 bp, Artificial Sequence
  sgRNA
ggctgcctcgtcacttgtct

SEQ ID NO: 24070 - DNA, 20 bp, Artificial Sequence
  sgRNA
actggtgcaagtggaaaggc

SEQ ID NO: 24071 - DNA, 20 bp, Artificial Sequence
  sgRNA
gcgcggcgctaacgtgtgta

SEQ ID NO: 24072 - DNA, 20 bp, Artificial Sequence
  sgRNA
agcgcagcgcgacgtgcgcc

SEQ ID NO: 24073 - DNA, 20 bp, Artificial Sequence
  sgRNA
ctcttccaggaagcgtggcc

SEQ ID NO: 24074 - DNA, 20 bp, Artificial Sequence
  sgRNA
cgcccactcctccgtcctat

SEQ ID NO: 24075 - DNA, 20 bp, Artificial Sequence
  sgRNA
tagactcacactcctaagga

SEQ ID NO: 24076 - DNA, 20 bp, Artificial Sequence
  sgRNA
gcgcactgaggtttcgcgta

SEQ ID NO: 24077 - DNA, 20 bp, Artificial Sequence
  sgRNA
gcattgcggagctcgctagt

SEQ ID NO: 24078 - DNA, 20 bp, Artificial Sequence
  sgRNA
cgttatcccttttttccggc

SEQ ID NO: 24079 - DNA, 20 bp, Artificial Sequence
  sgRNA
tgaaagggagaagtgaaagt

SEQ ID NO: 24080 - DNA, 20 bp, Artificial Sequence
  sgRNA
atggtcctctctctattcag

SEQ ID NO: 24081 - DNA, 20 bp, Artificial Sequence
  sgRNA
gaagactttgctctgtgcat

SEQ ID NO: 24082 - DNA, 20 bp, Artificial Sequence
  sgRNA
tatttttcacctgcactcaa

SEQ ID NO: 24083 - DNA, 20 bp, Artificial Sequence
  sgRNA
caactagggaatttagaaaa

SEQ ID NO: 24084 - DNA, 20 bp, Artificial Sequence
  sgRNA
actgactcaggccccgcccc

SEQ ID NO: 24085 - DNA, 20 bp, Artificial Sequence
  sgRNA
atccaaaggaaggaggccgg

SEQ ID NO: 24086 - DNA, 20 bp, Artificial Sequence
  sgRNA
agacgacccaggcgtccctg

SEQ ID NO: 24087 - DNA, 20 bp, Artificial Sequence
  sgRNA
aggaccttgcctgcaagtcc

SEQ ID NO: 24088 - DNA, 20 bp, Artificial Sequence
  sgRNA
gtctctacttcccatacagc

SEQ ID NO: 24089 - DNA, 20 bp, Artificial Sequence
  sgRNA
gtagggattggactttctga

SEQ ID NO: 24090 - DNA, 20 bp, Artificial Sequence
  sgRNA
gtctgtagcagactgtctac

SEQ ID NO: 24091 - DNA, 20 bp, Artificial Sequence
  sgRNA
ttccaatccaaaatcctgca

SEQ ID NO: 24092 - DNA, 20 bp, Artificial Sequence
  sgRNA
acccgcagcaagcaccacca

SEQ ID NO: 24093 - DNA, 20 bp, Artificial Sequence
  sgRNA
taaacttgcccaaagccatg

SEQ ID NO: 24094 - DNA, 20 bp, Artificial Sequence
  sgRNA
gtggcactggaccaagctgg

SEQ ID NO: 24095 - DNA, 20 bp, Artificial Sequence
  sgRNA
tcttgaacacaaatgaatct

SEQ ID NO: 24096 - DNA, 20 bp, Artificial Sequence
  sgRNA
caaggtttctctcctatcat

SEQ ID NO: 24097 - DNA, 20 bp, Artificial Sequence
  sgRNA
tgtgctcttgaagaggggag

SEQ ID NO: 24098 - DNA, 20 bp, Artificial Sequence
  sgRNA
ctccttccttcgtttacaga

SEQ ID NO: 24099 - DNA, 20 bp, Artificial Sequence
  sgRNA
gtgcattctctagcagggta

SEQ ID NO: 24100 - DNA, 20 bp, Artificial Sequence
  sgRNA
aacttggtttctgttgtagg

SEQ ID NO: 24101 - DNA, 20 bp, Artificial Sequence
  sgRNA
ggggaggtcttctgagccac

SEQ ID NO: 24102 - DNA, 20 bp, Artificial Sequence
  sgRNA
agctgcaccttctttcagcg

SEQ ID NO: 24103 - DNA, 20 bp, Artificial Sequence
  sgRNA
cccagcaaggactcattatc

SEQ ID NO: 24104 - DNA, 20 bp, Artificial Sequence
  sgRNA
ttgaacaggaaggcgttttg

SEQ ID NO: 24105 - DNA, 7700 bp, Artificial Sequence
  vector
cctgcaggcagctgcgcgctcgctcgctcactgaggccgcccgggcgtcgggcgacctttggtcgcccggcctcagtgagcgagcgagcgcgcagagagggagtggccaactccatcactaggggttcctgcggcctctagaaaggatctgcgatcgctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacagctgaagcttcgaggggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctacgtctttgtttcgttttctgttctgcgccgttacagatccaagctgtgaccggcgcctacaccggtgccaccatgtacccatacgatgttccagattacgcttcgccgaagaaaaagcgcaaggtcgaagcgtccgacaagaagtactccattgggctcgctatcggcacaaacagcgtcggctgggccgtcattacggacgagtacaaggtgccgagcaaaaaattcaaagttctgggcaataccgatcgccacagcataaagaagaacctcattggcgccctcctgttcgactccggggagacggccgaagccacgcggctcaaaagaacagcacggcgcagatatacccgcagaaagaatcggatctgctacctgcaggagatctttagtaatgagatggctaaggtggatgactctttcttccataggctggaggagtcctttttggtggaggaggataaaaagcacgagcgccacccaatctttggcaatatcgtggacgaggtggcgtaccatgaaaagtacccaaccatatatcatctgaggaagaagcttgtagacagtactgataaggctgacttgcggttgatctatctcgcgctggcgcatatgatcaaatttcggggacacttcctcatcgagggggacctgaacccagacaacagcgatgtcgacaaactctttatccaactggttcagacttacaatcagcttttcgaagagaacccgatcaacgcatccggagttgacgccaaagcaatcctgagcgctaggctgtccaaatcccggcggctcgaaaacctcatcgcacagctccctggggagaagaagaacggcctgtttggtaatcttatcgccctgtcactcgggctgacccccaactttaaatctaacttcgacctggccgaagatgccaagcttcaactgagcaaagacacctacgatgatgatctcgacaatctgctggcccagatcggcgaccagtacgcagacctttttttggcggcaaagaacctgtcagacgccattctgctgagtgatattctgcgagtgaacacggagatcaccaaagctccgctgagcgctagtatgatcaagcgctatgatgagcaccaccaagacttgactttgctgaaggcccttgtcagacagcaactgcctgagaagtacaaggaaattttcttcgatcagtctaaaaatggctacgccggatacattgacggcggagcaagccaggaggaattttacaaatttattaagcccatcttggaaaaaatggacggcaccgaggagctgctggtaaagcttaacagagaagatctgttgcgcaaacagcgcactttcgacaatggaagcatcccccaccagattcacctgggcgaactgcacgctatcctcaggcggcaagaggatttctacccctttttgaaagataacagggaaaagattgagaaaatcctcacatttcggataccctactatgtaggccccctcgcccggggaaattccagattcgcgtggatgactcgcaaatcagaagagaccatcactccctggaacttcgaggaagtcgtggataagggggcctctgcccagtccttcatcgaaaggatgactaactttgataaaaatctgcctaacgaaaaggtgcttcctaaacactctctgctgtacgagtacttcacagtttataacgagctcaccaaggtcaaatacgtcacagaagggatgagaaagccagcattcctgtctggagagcagaagaaagctatcgtggacctcctcttcaagacgaaccggaaagttaccgtgaaacagctcaaagaagactatttcaaaaagattgaatgtttcgactctgttgaaatcagcggagtggaggatcgcttcaacgcatccctgggaacgtatcacgatctcctgaaaatcattaaagacaaggacttcctggacaatgaggagaacgaggacattcttgaggacattgtcctcacccttacgttgtttgaagatagggagatgattgaagaacgcttgaaaacttacgctcatctcttcgacgacaaagtcatgaaacagctcaagaggcgccgatatacaggatgggggcggctgtcaagaaaactgatcaatgggatccgagacaagcagagtggaaagacaatcctggattttcttaagtccgatggatttgccaaccggaacttcatgcagttgatccatgatgactctctcacctttaaggaggacatccagaaagcacaagtttctggccagggggacagtcttcacgagcacatcgctaatcttgcaggtagcccagctatcaaaaagggaatactgcagaccgttaaggtcgtggatgaactcgtcaaagtaatgggaaggcataagcccgagaatatcgttatcgagatggcccgagagaaccaaactacccagaagggacagaagaacagtagggaaaggatgaagaggattgaagagggtataaaagaactggggtcccaaatccttaaggaacacccagttgaaaacacccagcttcagaatgagaagctctacctgtactacctgcagaacggcagggacatgtacgtggatcaggaactggacatcaatcggctctccgactacgacgtggctgctatcgtgccccagtcttttctcaaagatgattctattgataataaagtgttgacaagatccgataaagctagagggaagagtgataacgtcccctcagaagaagttgtcaagaaaatgaaaaattattggcggcagctgctgaacgccaaactgatcacacaacggaagttcgataatctgactaaggctgaacgaggtggcctgtctgagttggataaagccggcttcatcaaaaggcagcttgttgagacacgccagatcaccaagcacgtggcccaaattctcgattcacgcatgaacaccaagtacgatgaaaatgacaaactgattcgagaggtgaaagttattactctgaagtctaagctggtctcagatttcagaaaggactttcagttttataaggtgagagagatcaacaattaccaccatgcgcatgatgcctacctgaatgcagtggtaggcactgcacttatcaaaaaatatcccaagcttgaatctgaatttgtttacggagactataaagtgtacgatgttaggaaaatgatcgcaaagtctgagcaggaaataggcaaggccaccgctaagtacttcttttacagcaatattatgaattttttcaagaccgagattacactggccaatggagagattcggaagcgaccacttatcgaaacaaacggagaaacaggagaaatcgtgtgggacaagggtagggatttcgcgacagtccggaaggtcctgtccatgccgcaggtgaacatcgttaaaaagaccgaagtacagaccggaggcttctccaaggaaagtatcctcccgaaaaggaacagcgacaagctgatcgcacgcaaaaaagattgggaccccaagaaatacggcggattcgattctcctacagtcgcttacagtgtactggttgtggccaaagtggagaaagggaagtctaaaaaactcaaaagcgtcaaggaactgctgggcatcacaatcatggagcgatcaagcttcgaaaaaaaccccatcgactttctcgaggcgaaaggatataaagaggtcaaaaaagacctcatcattaagcttcccaagtactctctctttgagcttgaaaacggccggaaacgaatgctcgctagtgcgggcgagctgcagaaaggtaacgagctggcactgccctctaaatacgttaatttcttgtatctggccagccactatgaaaagctcaaagggtctcccgaagataatgagcagaagcagctgttcgtggaacaacacaaacactaccttgatgagatcatcgagcaaataagcgaattctccaaaagagtgatcctcgccgacgctaacctcgataaggtgctttctgcttacaataagcacagggataagcccatcagggagcaggcagaaaacattatccacttgtttactctgaccaacttgggcgcgcctgcagccttcaagtacttcgacaccaccatagacagaaagcggtacacctctacaaaggaggtcctggacgccacactgattcatcagtcaattacggggctctatgaaacaagaatcgacctctctcagctcggtggagacagccccaagaagaagagaaaggtggaggccagctaagaattcaataaaagatctttattttcattagatctgtgtgttggttttttgtgtgcggccgcaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcaggggcgcctgatgcggtattttctccttacgcatctgtgcggtatttcacaccgcatacgtcaaagcaaccatagtacgcgccctgtagcggcgcattaagcgcggcgggtgtggtggttacgcgcagcgtgaccgctacacttgccagcgccttagcgcccgctcctttcgctttcttcccttcctttctcgccacgttcgccggctttccccgtcaagctctaaatcgggggctccctttagggttccgatttagtgctttacggcacctcgaccccaaaaaacttgatttgggtgatggttcacgtagtgggccatcgccctgatagacggtttttcgccctttgacgttggagtccacgttctttaatagtggactcttgttccaaactggaacaacactcaactctatctcgggctattcttttgatttataagggattttgccgatttcggtctattggttaaaaaatgagctgatttaacaaaaatttaacgcgaattttaacaaaatattaacgtttacaattttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtggaagccgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgt

SEQ ID NO: 24106 - DNA, 7685 bp, Artificial Sequence
  vector
cctgcaggcagctgcgcgctcgctcgctcactgaggccgcccgggcaaagcccgggcgtcgggcgacctttggtcgcccggcctcagtgagcgagcgagcgcgcagagagggagtggccaactccatcactaggggttcctgcggccgcacgcgttctaggtcttgaaaggagtgggaattggctccggtgcccgtcagtgggcagagcgcacatcgcccacagtccccgagaagttggggggaggggtcggcaattgatccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtgtcgtgacgcgcgtacgtaatacgactcactatagggccgccaccatgaaaaggccggcggccacgaaaaaggccggccaggcaaaaaagaaaaaggacaagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggcaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggaccacatcgtgcctcagagctttctgaaggacgactccatcgacaacaaggtgctgaccagaagcgacaaggcccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggcgacagcgctggaggaggtggaagcggaggaggaggaagcggaggaggaggtagcggacctaagaaaaagaggaaggtggcggccgctggatccggacgggctgacgcattggacgattttgatctggatatgctgggaagtgacgccctcgatgattttgaccttgacatgcttggttcggatgcccttgatgactttgacctcgacatgctcggcagtgacgcccttgatgatttcgacctggacatgctgatttaactgtacgaattcaataaataaaagatctttattttcattagatctgtgtgttggttttttgtgtgcggaccgagcggccgcaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcaggggcgcctgatgcggtattttctccttacgcatctgtgcggtatttcacaccgcatacgtcaaagcaaccatagtacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgatttgggtgatggttcacgtagtgggccatcgccctgatagacggtttttcgccctttgacgttggagtccacgttctttaatagtggactcttgttccaaactggaacaacactcaaccctatctcgggctattcttttgatttataagggattttgccgatttcggcctattggttaaaaaatgagctgatttaacaaaaatttaacgcgaattttaacaaaatattaacgtttacaattttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgt

SEQ ID NO: 24107 - DNA, 95 bp, Artificial Sequence
  primer
aatgatacggcgaccaccgagatctacactctttccctacacgacgctcttccgatcttcgatcgttaccatcttgtggaaaggacgaaacaccg

SEQ ID NO: 24108 - DNA, 96 bp, Artificial Sequence
  primer
aatgatacggcgaccaccgagatctacactctttccctacacgacgctcttccgatctatcgattccttggttcttgtggaaaggacgaaacaccg

SEQ ID NO: 24109 - DNA, 92 bp, Artificial Sequence
  primer
caagcagaagacggcatacgagataagtagaggtgactggagttcagacgtgtgctcttccgatctttctactattctttcccctgcactgt

SEQ ID NO: 24110 - DNA, 93 bp, Artificial Sequence
  primer
caagcagaagacggcatacgagatacacgatcgtgactggagttcagacgtgtgctcttccgatctattctactattctttcccctgcactgt

SEQ ID NO: 24111 - DNA, 94 bp, Artificial Sequence
  primer
caagcagaagacggcatacgagatcgcgcggtgtgactggagttcagacgtgtgctcttccgatctgattctactattctttcccctgcactgt

SEQ ID NO: 24112 - DNA, 95 bp, Artificial Sequence
  primer
caagcagaagacggcatacgagatcatgatcggtgactggagttcagacgtgtgctcttccgatctcgattctactattctttcccctgcactgt

SEQ ID NO: 24113 - DNA, 96 bp, Artificial Sequence
  primer
caagcagaagacggcatacgagatcgttaccagtgactggagttcagacgtgtgctcttccgatctcgatctctactattctttcccctgcactgt

SEQ ID NO: 24114 - DNA, 92 bp, Artificial Sequence
  primer
caagcagaagacggcatacgagattccttggtgtgactggagttcagacgtgtgctcttccgatctttctactattctttcccctgcactgt

SEQ ID NO: 24115 - DNA, 19 bp, Artificial Sequence
  Artificially generated sequence
gttttagagctaggccaac

SEQ ID NO: 24116 - DNA, 20 bp, Artificial Sequence
  Artificially generated sequence
gtggaaaggacgaaacaccg

What is claimed is:

1. A composition comprising a cancer vaccine, comprising a modified cell comprising a CRISPRa system capable of increasing expression of a plurality of endogenous human antigen presentation genes resulting in the modified cell expressing at least one tumor associated antigen (TAA),
   wherein the CRISPRa system comprises an sgRNA library,
   wherein the plurality of endogenous human antigen presentation genes are selected from the group consisting of CD70, CD80, CD86, IFNA4, IFNB1, and IFNG; and
   wherein the sgRNA library comprises every nucleic acid sequence of SEQ ID NOs: 1, 2, 5, 6, 9, 11-13, 16, 18, 21, 22, 24, 25, 28, 30, 31, and 33-35.

2. A method of vaccinating against cancer in a subject in need thereof, the method comprising
   administering to the subject a therapeutically effective amount of the composition of claim 1.

3. The method of claim 2, wherein the CRISPRa system is in an AAV vector, a lentiviral vector, or an adenoviral vector, wherein the AAV vector is selected from the group consisting of AAV2, AAV8, AAV9, or AAV-DJ.

4. The method of claim 2, wherein the CRISPRa system comprises:
   (a) a nucleic acid encoding dCas9-VP64, a nucleic acid encoding MS2-p65-HSF 1, and a genome-scale lentiviral synergistic activation mediator (SAM) CRISPRa sgRNA library; or
   (b) a nucleic acid encoding MS2-p65-HSF 1, and a nucleic acid encoding a genome-scale lentiviral SAM CRISPRa sgRNA library.

5. The method of claim 2, wherein the subject is a human.

6. The method of claim 2, wherein administering the therapeutically effective amount of the composition comprises a one dose, a two dose, a three dose, a four dose, or a multi-dose treatment.

7. The method of claim 2, further comprising contacting the cell with a substance that induces senescence in the cell prior to administering to the subject, wherein the substance that induces senescence in the cell is mitomycin.

* * * * *